United States Patent 7,745,391 (HUMAN THROMBOSPONDIN POLYPEPTIDE) - sequence listing, part 195

SEQ ID NO: 462427 - DNA, 1895 bp, Homo sapiens
ctcccagccccgcagcggccgagctgcagcccgggctcagtctccgccgccgccgtgaacatggagcccccggacgcaccggcccaggcggccggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggccaggtggcgacgagcgagactacgtgtgcgtggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctacctgaccctcctctgctcagaatctgccatggctccccagtacccttgggagaagcccaggtgtctcaccatggccttcaaggtccacctggccagttccaccattagctagctgatccttctccccagtcaaggctatctcctcatcaccccccaggctcctctggttcctaccttcactgcccatccttcctaccgtctatttctcaccaatcccttgaatcccaggcttctaagaatgattttcagttcattcgcatccaggccctggggaaaggctgtattctcccttggcacttcttacatatcccttcctggggtagaccctgcgccagatgctggggacacatctgtgaacaagacagaccacccctgttatttcagtaggggagacagatggtaaatgctaactaagccctttcgtaacagtagtgtatctacaggtgatatcaccagtgagagagagcaggagaggggattattttaggtggcaggtgttgcagtctgctttcctgagaagcagattctgacttggatgttttcaggcaagaagtttatgggaagtaccctgggttccgcacctcttgggtctagggaggtaaaggaagcaagatttggcaaggtgagaagttggactgaagtctaaggaaggtctcaggctgggtgcagtggttcatgcctataatcccagcactttgagaggctgaggcaggaggattgtatgagcctaggagtttgaggccagcctgggcaacagagggagaccccatttgcaca

SEQ ID NO: 462428 - DNA, 3384 bp, Homo sapiens
gttgtcccccctccacttccgggctgctggggagggggaccgggcggcctctctcctccctcttcccctgccacctgtctcataggcagaagcggccgtgcccagcgcgcagagcggagcgcgccgaagcctgagctcgtgagggggccgaggctgtggggaggtggcagttggacttcggaatctcaaggactccgactcctggcttgttcagagaaggagagccccgactcctggatccctgggagtcccagcggccatggggacgcgaagcagccccgaggaggggaccccgccgccgctggtcccggaatgcgacgtggaggtccagccccagggccatcccgaggagtcccgggaacaggaggcatccgaagtcctggcggaaccttcgagccgcgggggagctgagcagcaggcagaggaagaagaagtgggagaaggcagcagcactgagagcagccgcgacgcgcccgaggctacgcctccgatagctatggcggccacacctcccgcatccacctcttcgcgggaaggggtgcgaggggcggcgcggcgcctgcaaggacagcagctggaggcattgactcgtgtggccctgatggagcagcgagtgaaggagctacagcgccagaggaaggagctgaggatcgagatggaggtggaggtggccttgctgcggggtgagctggctggggagcgagtggccgctcgccgggaggaggagcagctgcgggagctgctggagcagcaggcggcctcggagcagcgcggccgccagcagcggggaacagaggcggctgagccaggaacgggatcgcctagagggtcttcgccagagactccgcaaggcccagggacagctcgactcacagccagaggaccaacgcgagcggcttctgcagggtgtgcaggagatgagggaacaactggatgtggcccaacgtgcctatgaggacctggagttccagcaactggagcgggagagccggcaggaggaggaggatcgggacagccctgggccccaggtgccagaccccaaggtccaggaactccaggccagcatggcgcagcacagacaccggatccgggtcctggaagagcagctcaagtcactgggggagcagatggcagccgagagccgggggttgagccggaagaaggaggaggcccttcaggccctgtcacaggaacggagccggctgctcgagctcaattgccttcagggaacacctggcggggacttctctgagcccaacccggccctcactaagctgctgttcacccagaagacagaccgccagctgctggtgctccaggatgccgtggcccactccgctgccacccctacttcttcctgcctcttttctgtccacagctccctgcagggctccattggcctccagaggactgggagcctgccccggaaaaggggggagagggggagccagagaggatccccccgacctctgtccttccattgtactggtgaggatccccctgttccccacttccttcccacatcagcactcatcctgcagcagaggatggaggaaacccgcacctatgcctgcaggggagaagtggataggctcaggccagggtgtatccagccctgtaacctggtcccctctaccctagaatccctggaggcctcagctctcccgccagcagtgggggactccggcagataccccctctaccagctgctgaactgtggccgtgggaatagctgtggggccatccatccagacattgcccacatggagcggctcctgcagcaggccatggcggagagggagcggctgctcaaggcccgggaaggaacaagaaggggcacggaaggttcctcaggccctgctgttcctgccatcacggccccacccaccccaccccaccctccaggcccgcgaatcttggatctccggcagcatctggagggatggggccacaacccggaaaactgcccacatgtgcaggtgtctgggtgctgctgccgtggacccctggtgaagatgggcggccgcatcaagacctggaggaagcgatggttctgctttgaccgccaagcccgccgcttggcctactatgcggacaaggaagagaccaagctcaaaggtgtcatctacttccaggccattgaggaagtctattatgaccacttacgctgtgccttcaagagccccaacccccgcctgaccttctgcgtcaaaacctacgaacgccttttctacatggtggctccgagccccgaagccatgcgcatttggatggacgtcatcgtgacagccgctgacgaaaaccacgccccctgagtggccccgccctcttggggggaagtcccttcgaggctccgccggcgcggggcgcgggggcgttcctaggccccgcccactgccggaaaacttggacgcaccgctttggaactctcccgggaattccgcaggcgcggcagttcagctggcctgagctgctgcgttctgggttgcaggtgccttgcccccgacgggatcgccggcccctaaggccctgcccggggcaggaggaagattgcaggggcgggaagaaactatttattggtgctcctgtgataccgaattaaatacggaggaaaaacaggaattgctgctgtggtttccagcccaggcatccggggccccttgacccctaggcaggacatctgagttatcggtacctctgggagccacgcgtcccacagccggctctctaggaatggaggccttcaactcttaaggtcatagctgggagaagagggtgagaggcatgtcccccttagtgtttggcagttttgcttttttagtttgtaggcccttctgtttccaccctttctggcctgaccggctgctggaaatttctaggaactcctaggcttcccccctttaggcctttgcctacgttgttccctctgcccttttcttccctttttttcttttatctatttatttttatagagatggggtctcactgtgttgcccaggctggtctccaactcctggacttaagcgatccactcaccttagcctcccaaggtgctgagattacaggtgtgagccaccacgcctggcccccctccttcccttaatcagctgcacctcattcttccagccttagttcagttggcacctccttcaggaagccctcactgactttcctggctgggtcaggcacccccttttgagctctgtcatcccatccctgaggaccctgggtcatcatgggcgatggatctgtgtcctttatgcactgggagctccatgaggcagagccagcattgtcctggtcactgctgttcccagcaccatagagcatgtctcattccatgaaagtggaaaaaaacaaaaaataaaactcgcttccctttca

SEQ ID NO: 462429 - DNA, 3231 bp, Homo sapiens
gttgtcccccctccacttccgggctgctggggagggggaccgggcggcctctctcctccctcttcccctgccacctgtctcataggcagaagcggccgtgcccagcgcgcagagcggagcgcgccgaagcctgagctcgtgagggggccgaggctgtggggaggtggcagttggacttcggaatctcaaggactccgactcctggcttgttcagagaaggagagccccgactcctggatccctgggagtcccagcggccatggggacgcgaagcagccccgaggaggggaccccgccgccgctggtcccggaatgcgacgtggaggtccagccccagggccatcccgaggagtcccgggaacaggaggcatccgaagtcctggcggaaccttcgagccgcgggggagctgagcagcaggcagaggaagaagaagtgggagaaggcagcagcactgagagcagccgcgacgcgcccgaggctacgcctccgatagctatggcggccacacctcccgcatccacctcttcgcgggaaggggtgcgaggggcggcgcggcgcctgcaaggacagcagctggaggcattgactcgtgtggccctgatggagcagcgagtgaaggagctacagcgccagaggaaggagctgaggatcgagatggaggtggaggtggccttgctgcggggtgagctggctggggagcgagtggccgctcgccgggaggaggagcagctgcgggagctgctggagcagcaggcggcctcggagcagcgcggccgccagcagcggggaacagaggcggctgagccaggaacgggatcgcctagagggtcttcgccagagactccgcaaggcccagggacagctcgactcacagccagaggaccaacgcgagcggcttctgcagggtgtgcaggagatgagggaacaactggatgtggcccaacgtgcctatgaggacctggagttccagcaactggagcgggagagccggcaggaggaggaggatcgggacagccctgggccccaggtgccagaccccaaggtccaggaactccaggccagcatggcgcagcacagacaccggatccgggtcctggaagagcagctcaagtcactgggggagcagatggcagccgagagccgggggttgagccggaagaaggaggaggcccttcaggccctgtcacaggaacggagccggctgctcgagctcaattgccttcagggaacacctggcggggacttctctgagcccaacccggccctcactaagctgctgttcacccagaagacagaccgccagctgctggtgctccaggatgccgtggcccactccgctgccacccctacttcttcctgcctcttttctgtccacagctccctgcagggctccattggcctccagaggactgggagcctgccccggaaaaggggggagagggggagccagagaggatccccccgacctctgtccttccattgtactgaatccctggaggcctcagctctcccgccagcagtgggggactccggcagataccccctctaccagctgctgaactgtggccgtgggaatagctgtggggccatccatccagacattgcccacatggagcggctcctgcagcaggccatggcggagagggagcggctgctcaaggcccgggaaggaacaagaaggggcacggaaggttcctcaggccctgctgttcctgccatcacggccccacccaccccaccccaccctccaggcccgcgaatcttggatctccggcagcatctggagggatggggccacaacccggaaaactgcccacatgtgcaggtgtctgggtgctgctgccgtggacccctggtgaagatgggcggccgcatcaagacctggaggaagcgatggttctgctttgaccgccaagcccgccgcttggcctactatgcggacaaggaagagaccaagctcaaaggtgtcatctacttccaggccattgaggaagtctattatgaccacttacgctgtgccttcaagagccccaacccccgcctgaccttctgcgtcaaaacctacgaacgccttttctacatggtggctccgagccccgaagccatgcgcatttggatggacgtcatcgtgacagccgctgacgaaaaccacgccccctgagtggccccgccctcttggggggaagtcccttcgaggctccgccggcgcggggcgcgggggcgttcctaggccccgcccactgccggaaaacttggacgcaccgctttggaactctcccgggaattccgcaggcgcggcagttcagctggcctgagctgctgcgttctgggttgcaggtgccttgcccccgacgggatcgccggcccctaaggccctgcccggggcaggaggaagattgcaggggcgggaagaaactatttattggtgctcctgtgataccgaattaaatacggaggaaaaacaggaattgctgctgtggtttccagcccaggcatccggggccccttgacccctaggcaggacatctgagttatcggtacctctgggagccacgcgtcccacagccggctctctaggaatggaggccttcaactcttaaggtcatagctgggagaagagggtgagaggcatgtcccccttagtgtttggcagttttgcttttttagtttgtaggcccttctgtttccaccctttctggcctgaccggctgctggaaatttctaggaactcctaggcttcccccctttaggcctttgcctacgttgttccctctgcccttttcttccctttttttcttttatctatttatttttatagagatggggtctcactgtgttgcccaggctggtctccaactcctggacttaagcgatccactcaccttagcctcccaaggtgctgagattacaggtgtgagccaccacgcctggcccccctccttcccttaatcagctgcacctcattcttccagccttagttcagttggcacctccttcaggaagccctcactgactttcctggctgggtcaggcacccccttttgagctctgtcatcccatccctgaggaccctgggtcatcatgggcgatggatctgtgtcctttatgcactgggagctccatgaggcagagccagcattgtcctggtcactgctgttcccagcaccatagagcatgtctcattccatgaaagtggaaaaaaacaaaaaataaaactcgcttccctttca

SEQ ID NO: 462430 - DNA, 2787 bp, Homo sapiens
tgggaagcctggccccaactcaagcggaacccgcaaagccggactcccagctttttcctcgggtgggatcagattttaggccctccgctcttcctccctccaaattcaggtccctggagtccatcctcccttcgaatccggtagttcaggccctgggcctcttccttggacctaggcgtccgagcccccagccctggcattctctccgcagatggaggtggaggtggccttgctgcggggtgagctggctggggagcgagtggccgctcgccgggaggaggagcagctgcgggagctgctggagcagcaggcggcctcggagcagcgcggccgccagcagcggggaacagaggcggctgagccaggaacgggatcgcctagagggtcttcgccagagactccgcaaggcccagggacagctcgactcacagccagaggaccaacgcgagcggcttctgcagggtgtgcaggagatgagggaacaactggatgtggcccaacgtgcctatgaggacctggagttccagcaactggagcgggagagccggcaggaggaggaggatcgggacagccctgggccccaggtgccagaccccaaggtccaggaactccaggccagcatggcgcagcacagacaccggatccgggtcctggaagagcagctcaagtcactgggggagcagatggcagccgagagccgggggttgagccggaagaaggaggaggcccttcaggccctgtcacaggaacggagccggctgctcgagctcaattgccttcagggaacacctggcggggacttctctgagcccaacccggccctcactaagctgctgttcacccagaagacagaccgccagctgctggtgctccaggatgccgtggcccactccgctgccacccctacttcttcctgcctcttttctgtccacagctccctgcagggctccattggcctccagaggactgggagcctgccccggaaaaggggggagagggggagccagagaggatccccccgacctctgtccttccattgtactgaatccctggaggcctcagctctcccgccagcagtgggggactccggcagataccccctctaccagctgctgaactgtggccgtgggaatagctgtggggccatccatccagacattgcccacatggagcggctcctgcagcaggccatggcggagagggagcggctgctcaaggcccgggaaggaacaagaaggggcacggaaggttcctcaggccctgctgttcctgccatcacggccccacccaccccaccccaccctccaggcccgcgaatcttggatctccggcagcatctggagggatggggccacaacccggaaaactgcccacatgtgcaggtgtctgggtgctgctgccgtggacccctggtgaagatgggcggccgcatcaagacctggaggaagcgatggttctgctttgaccgccaagcccgccgcttggcctactatgcggacaaggaagagaccaagctcaaaggtgtcatctacttccaggccattgaggaagtctattatgaccacttacgctgtgccttcaagagccccaacccccgcctgaccttctgcgtcaaaacctacgaacgccttttctacatggtggctccgagccccgaagccatgcgcatttggatggacgtcatcgtgacagccgctgacgaaaaccacgccccctgagtggccccgccctcttggggggaagtcccttcgaggctccgccggcgcggggcgcgggggcgttcctaggccccgcccactgccggaaaacttggacgcaccgctttggaactctcccgggaattccgcaggcgcggcagttcagctggcctgagctgctgcgttctgggttgcaggtgccttgcccccgacgggatcgccggcccctaaggccctgcccggggcaggaggaagattgcaggggcgggaagaaactatttattggtgctcctgtgataccgaattaaatacggaggaaaaacaggaattgctgctgtggtttccagcccaggcatccggggccccttgacccctaggcaggacatctgagttatcggtacctctgggagccacgcgtcccacagccggctctctaggaatggaggccttcaactcttaaggtcatagctgggagaagagggtgagaggcatgtcccccttagtgtttggcagttttgcttttttagtttgtaggcccttctgtttccaccctttctggcctgaccggctgctggaaatttctaggaactcctaggcttcccccctttaggcctttgcctacgttgttccctctgcccttttcttccctttttttcttttatctatttatttttatagagatggggtctcactgtgttgcccaggctggtctccaactcctggacttaagcgatccactcaccttagcctcccaaggtgctgagattacaggtgtgagccaccacgcctggcccccctccttcccttaatcagctgcacctcattcttccagccttagttcagttggcacctccttcaggaagccctcactgactttcctggctgggtcaggcacccccttttgagctctgtcatcccatccctgaggaccctgggtcatcatgggcgatggatctgtgtcctttatgcactgggagctccatgaggcagagccagcattgtcctggtcactgctgttcccagcaccatagagcatgtctcattccatgaaagtggaaaaaaacaaaaaataaaactcgcttccctttca

SEQ ID NO: 462431 - DNA, 209 bp, Homo sapiens
tatttcttataaacgggatcatacccctgtgaggtcctttcactcagcacatggacagtagtgttttgatttgtgctgactgggtggtggcttcactgggcagtgctctgacttaggttggagatcaagcctttttcctatgctcatgagccttttgtgttttcagggctccattggcctccagaggactgggagcctgccccggaaaa

SEQ ID NO: 462432 - DNA, 834 bp, Homo sapiens
ggcgtcataagtcctacttttaaatttctcggcctggcacagtggctcacgcctgtaagcccagcactctgggaggccgaagcaggcggatcacgaggtcaagagatcgagaccatcctgacaaacactgtgaaaccctggtctgtactaaaaatacaaaaattagctgggcgtggtggcacacgcctgtagtcccagctactcgggaggctgaggcaggagaatcgcttgaactcgagaggtggaggttgcagtgagccaagattgcgccactgcactccagcctggcgacagagccagactcagtttcaaaaaaaaaagaaaaaaaatttatcttgcccctaatttatcaatagcgctctacatatgataattttaagcacttccttgtgttaattcatttaatccttataacccagtgaggtaggtggcatcatttgggaagacagggaaactgacattcagatacttaagtaccttgtccagtgccacacagactataagtagcaaggctgggttcgcacccagactgtggccggtgtcttttgtctgaattaccctcactttctgcttattccagagccccaacccccgcctgaccttctgcgtcaaaacctacgaacgccttttctacatggtggctccgagccccgaagccatgcgcatttggatggacgtcatcgtgacagccgctgacgaaaaccacgccccctgagtggccccgccctcttggggggaagtcccttcgaggctccgccggcgcggggcgcgggggcgttcctaggccccgcccactgccggaaaacttggacgcaccgctttggaactctcccg

SEQ ID NO: 462433 - DNA, 588 bp, Homo sapiens
tgggaagcctggccccaactcaagcggaacccgcaaagccggactcccagctttttcctcgggtgggatcagattttaggccctccgctcttcctccctccaaattcaggtccctggagtccatcctcccttcgaatccggtagttcaggccctgggcctcttccttggacctaggcgtccgagcccccagccctggcattctctccgcagatggaggtggaggtggccttgctgcggggtgagctggctggggagcgagtggccgctcgccgggaggaggagcagctgcgggagctgctggagcagcagaacaggtctgtttggctcaccgggtcttcatcagcagtgtccttcctggtccatggatgttggtgtgctcctagccacctgcgccccggggttgtccccattccccaaaggaagacatttgggctcctgagagagtgaggggcagatgcccctcctggttttccttctccctccctgggcgagatttttggggctcttcctttgtcccctgtccgtttgctatttaaatgtgggtgtgtaaaaacttccaaactggccggaagcagtggctcacgcct

SEQ ID NO: 462434 - DNA, 3131 bp, Homo sapiens
gttgtcccccctccacttccgggctgctggggagggggaccgggcggcctctctcctccctcttcccctgccacctgtctcataggcagaagcggccgtgcccagcgcgcagagcggagcgcgccgaagcctgagctcgtgagggggccgaggctgtggggaggtggcagttggacttcggaatctcaaggactccgactcctggcttgttcagagaaggagagccccgactcctggatccctgggagtcccagcggccatggggacgcgaagcagccccgaggaggggaccccgccgccgctggtcccggaatgcgacgtggaggtccagccccagggccatcccgaggagtcccgggaacaggaggcatccgaagtcctggcggaaccttcgagccgcgggggagctgagcagcaggcagaggaagaagaagtgggagaaggcagcagcactgagagcagccgcgacgcgcccgaggctacgcctccgatagctatggcggccacacctcccgcatccacctcttcgcgggaaggggtgcgaggggcggcgcggcgcctgcaaggacagcagctggaggcattgactcgtgtggccctgatggagcagcgagtgaaggagctacagcgccagaggaaggagctgaggatcgagatggaggtggaggtggccttgctgcggggtgagctggctggggagcgagtggccgctcgccgggaggaggagcagctgcgggagctgctggagcagcaggcggcctcggagcagcgcggccgccagcagcggggaacagaggcggctgagccaggaacgggatcgcctagagggtcttcgccagagactccgcaaggcccagggacagctcgactcacagccagaggaccaacgcgagcggcttctgcagggtgtgcaggagatgagggaacaactggatgtggcccaacgtgcctatgaggacctggagttccagcaactggagcgggagagccggcaggaggaggaggatcgggacagccctgggccccaggtgccagaccccaaggtccaggaactccaggccagcatggcgcagcacagacaccggatccgggtcctggaagagcagctcaagtcactgggggagcagatggcagccgagagccgggggttgagccggaagaaggaggaggcccttcaggccctgtcacaggaacggagccggctgctcgagctcaattgccttcagggaacacctggcggggacttctctgagcccaacccggccctcactaagctgctgttcacccagaagacagaccgccagctgctggtgctccaggatgccgtggcccactccgctgccacccctacttcttcctgcctcttttctgtccacagctccctgcagaatccctggaggcctcagctctcccgccagcagtgggggactccggcagataccccctctaccagctgctgaactgtggccgtgggaatagctgtggggccatccatccagacattgcccacatggagcggctcctgcagcaggccatggcggagagggagcggctgctcaaggcccgggaaggaacaagaaggggcacggaaggttcctcaggccctgctgttcctgccatcacggccccacccaccccaccccaccctccaggcccgcgaatcttggatctccggcagcatctggagggatggggccacaacccggaaaactgcccacatgtgcaggtgtctgggtgctgctgccgtggacccctggtgaagatgggcggccgcatcaagacctggaggaagcgatggttctgctttgaccgccaagcccgccgcttggcctactatgcggacaaggaagagaccaagctcaaaggtgtcatctacttccaggccattgaggaagtctattatgaccacttacgctgtgccttcaagagccccaacccccgcctgaccttctgcgtcaaaacctacgaacgccttttctacatggtggctccgagccccgaagccatgcgcatttggatggacgtcatcgtgacagccgctgacgaaaaccacgccccctgagtggccccgccctcttggggggaagtcccttcgaggctccgccggcgcggggcgcgggggcgttcctaggccccgcccactgccggaaaacttggacgcaccgctttggaactctcccgggaattccgcaggcgcggcagttcagctggcctgagctgctgcgttctgggttgcaggtgccttgcccccgacgggatcgccggcccctaaggccctgcccggggcaggaggaagattgcaggggcgggaagaaactatttattggtgctcctgtgataccgaattaaatacggaggaaaaacaggaattgctgctgtggtttccagcccaggcatccggggccccttgacccctaggcaggacatctgagttatcggtacctctgggagccacgcgtcccacagccggctctctaggaatggaggccttcaactcttaaggtcatagctgggagaagagggtgagaggcatgtcccccttagtgtttggcagttttgcttttttagtttgtaggcccttctgtttccaccctttctggcctgaccggctgctggaaatttctaggaactcctaggcttcccccctttaggcctttgcctacgttgttccctctgcccttttcttccctttttttcttttatctatttatttttatagagatggggtctcactgtgttgcccaggctggtctccaactcctggacttaagcgatccactcaccttagcctcccaaggtgctgagattacaggtgtgagccaccacgcctggcccccctccttcccttaatcagctgcacctcattcttccagccttagttcagttggcacctccttcaggaagccctcactgactttcctggctgggtcaggcacccccttttgagctctgtcatcccatccctgaggaccctgggtcatcatgggcgatggatctgtgtcctttatgcactgggagctccatgaggcagagccagcattgtcctggtcactgctgttcccagcaccatagagcatgtctcattccatgaaagtggaaaaaaacaaaaaataaaactcgcttccctttca

SEQ ID NO: 462435 - DNA, 1022 bp, Homo sapiens
tggttactgggatgtggtctggtggtgctggttactgcgtaagatgggaatcattgtgcctggaagtattgttgacttacttgtggagtgcgggtcactggcagtcattgaagttcttggatcgttctctaataccctgtttcaagttaactgtttgttggctaatcttcaccagtacccactaccaactcctgcatagatccgctcctccccatgcttgggctctgaatctctatgctcagtcaccccagtcctcctgcaaggacacccacctcaccttactttggttctgccaaatcatgctaggctgcttctccacatggatgtccttcttctcttacttaggttctgacattgggctggtattagaccaccccgatatgtggatgcccttgtcagccaagggatgcttgagccccaacatcccaccccaggaaactcttctgtacagatgctctctttatccccctcagattctgactctgcttgtcattatggtcttagaattgttcaggaggaaaaggaaagtggaaaataaatttaaaaaaaaggagtgaaagttcaaatttcagatgagaaaaaagtgatctctttgagtaaagacattaagtgtatttccttgttaatgaacaaacacattatatttatatacttttttcccaattatatcatataaaataagacaaaccctctgcttcttttgtcttctgcctatcttgcctgatatattgcatttttaatcagtcaacttttggataaatagagaatcataaaaaagtattaatagagaatgactaggaggctgaagttttaaaagttgttttgatttacatcttttcagaaaataatagctcattagttttaatagtagttatttacataagcgtacatcccattaaccgccatcagggctggaaaacatgctgaactgttcatattttcatataattattgaacataatggtttcatttgcatttctaaacagtgatgtttctgtcagccttggaaatagtgtctttac

SEQ ID NO: 462436 - DNA, 1322 bp, Homo sapiens
tgccctgtaaatgacaggatacctatatacatgcgaggacctatgtgatatgcagggatgctcatgtggatgcacggatgtaaaggtcaagaccacagtgacctctggactccagcccctggctaagaatgcaatctacctgtccatgggccagtgtgactcaagatgtcaagggatggtgatcactgagagaccaaagatttcctctgaatttgcctggaatttccaccctcgattgttcactgtcaaaaggaagaacatgataccagcatgtaggcttgtggacttccaaatgctgtcttccaagaacttggagtttaaacatgatcccttggatgatatgtccaaagaagttctcactgaaattccccgcatcgtaaaatgtcaggatgaagtttccatgactactcagagctacatcccagcatcccactttctccctggtaccatctacactctgcccattttaatgatgatttatctccgggctgcttttaaagatgagattattctgggtcagaatcatgaaggatcttgggatgaggacattatcctggattattccagcgggctctgtgtagtcacaatgggtcctggaagagaacacaagagaatagagaattcagtgtgagaagaaggccatgcaacacgagaggcagaatcagagagagaagatgccatgctgatggcttcgaaaatgaaaaaagggtcctgagtcaaagaatacaagtggattctaggagctaggaaagtcaggaaacaggctgtgctctggagcctccataaaaaaccagtcatgtgaacaccttggtgttagcccgtgtgatcatcatcagaggaggaggaaggaagttgagaaggaggaggaaggaagttgagaaggaggaggaaggggagcaaagatgagccgcagccgagatgttgccagctcagggggagtcagattctaggccagatccctggctctgtgccccacagcccaccctttgcatcccccgctccggcacctgtcatgcacacaccacgttatggtgatctctggtccagtctgcaaatatgttgttgcctgacacaaagtaaacagtcgatggatgctgctgtgctcgtcatcgttaagtcatcactatcatcatttgctctggccaactcctggtgtttgctgtcctcttagaagctgtggtatgaattgcacggattgcattcatgcgtcaaccttccctgtgtctacatcccatgcctgtcactttgcagttctcctctctaaagaggcccactctgtttcccaccccttaagtctgggctggctttcacccatagaatgc

SEQ ID NO: 462437 - DNA, 1141 bp, Homo sapiens
gacaaataaaaatggagttatatttgtagtgtcagagcaaaacctcctctatctgcacatcctggggacgaaccgggcagccggagagctgcggccggcccagtcccgctccgcctttgaagggtaaaacccaaggcggggccttggttctggcagaagggacgctatgaccgcagaattcctctccctgctttgcctcgggctgtgtctgggctacgaagatgagaaaaagaatgagaaaccgcccaagccctccctccacgcctggcccagctcggtggttgaagccgagagcaatgtgaccctgaagtgtcaggctcattcccagaatgtgacatttgtgctgcgcaaggtgaacgactctgggtacaagcaggaacagagctcggcagaaaacgaagctgaattccccttcacggacctgaagcctaaggatgctgggaggtacttttgtgcctacaagacaacagcctcccatgagtggtcagaaagcagtgaacacttgcagctggtggtcacagataaacacgatgaacttgaagctccctcaatgaaaacagacaccagaaccatctttgtcgccatcttcagctgcatctccatccttctcctcttcctctcagtcttcatcatctacagatgcagccagcacggttcatcatctgaggaatccaccaagagaaccagccattccaaacttccggagcaggaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacagccctggccactaaaggaggggggatcgtgctggccaaggttatcggaaatctggagatgcagatactgtgtttccttgctcttcgtccatatcaataaaattaagctgctatcaacataccaaagacctggcagcttacagacaacacatagttatttctcatggttctggaggctggaagtccaagaccaaagcactggtagattcagtgtctgctgagggcttttttcctggttcatagctggcaccttct

SEQ ID NO: 462438 - DNA, 835 bp, Homo sapiens
gaccttgcatgctcccggccgccatgccggccgcgggaattcgattatccccggatctgggtacaagcaggaacagagctcggcagaaaacgaagctgaattccccttcacggacctgaagcctaaggatgctgggaggtacttttgtgcctacaagacaacagcctcccatgagtggtcagaaagcagtgaacacttgcagctggtggtcacagataaacacgatgaacttgaagctccctcaatgaaaacagacaccagaaccatctttgtcgccatcttcagctgcatctccatccttctcctcttcctctcagtcttcatcatctacagatgcagccagcacggttcatcatctgaggaatccaccaagagaaccagccattccaaacttccggagcaggaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacagccctggccactaaaggaggggggatcgtgctggccaaggttatcggaaatctggagatgcagatactgtgtttccttgctcttcgtccatatcaataaaattaagctgctatcaacataccaaagacctggcagcttacagacaacacatagttatttctcatggttctggaggctggaagtccaagaccaaagcactggtagattcagtgtctgctgagggcttttttcctggttcatagctggcaccttct

SEQ ID NO: 462439 - DNA, 482 bp, Homo sapiens
cactttacagatggggaaacagaagcttggagaagattaaggaaattccccaaagcaataggaagttccagctccgaggtgggagatccaggcttggaagccaggccatctgtctggcttctcttagcttttcggctcgcccctatcagtggatttcaggagccaggctgattccctgacctgctcttccccctccagacaccagaaccatctttgtcgccatcttcagctgcatctccatccttctcctcttcctctcagtcttcatcatctacagatgcagccagcacggtgagctcagagaacgcaaagggagagagggggagtgaaggattttctcggtaggtaaattcctcctgcattttttgtaggttcatcatctgaggaatccaccaagaggtagatgcttggcatagctcatgctccacttattcccatgtcattctcaagggaacccattggcacatccgggattggcaccc

SEQ ID NO: 462440 - DNA, 888 bp, Homo sapiens
  misc_feature (20)..(21): n is a, c, g, or t
  misc_feature (42)..(42): n is a, c, g, or t
  misc_feature (49)..(49): n is a, c, g, or t
  misc_feature (684)..(684): n is a, c, g, or t
ccgaacaacccattaccctnnctttgtgcgacctgcttacanctggctnctgccatccttactcctctatcctctgcagtcttcatcatctacagatgcagccagcacggtgtcatcatgctgagggaatccaccaagagaaccaggcattccaaacttccagagcagaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacagccctggccactaaaggaggggggatcgtgctggccaaggttatcggaaatctggagatgcagatactgggataacttggtcttggggcgtgtgagtgacgggacgggctccccttacaaaaaacaacaaaccctaaaaataaagtgggctagaagatctaaaagaagaaaactatgaaaacaattaaactttgaggagggagggaagagggaggctagtggctgactgagtgagctaaatcacacacgtaccacttcacctcaaccatcgcttgttgtccgcgccccgcctccaccccgaccccagccatgccgcccaatccacgctggttcctcctnccaccttactaattcatcacccccattctaccgtacccctgtcttctgtctccgctcatttccaccctgccctgcccccccttctggccccgccacgcgccccccacatgtcccctctcctcgacacatatctccgtttccgcggcttgccacttttcccccacacctcccctctatcatttggcctccgtcaaaaccttccac

SEQ ID NO: 462441 - DNA, 1048 bp, Homo sapiens
gacaaataaaaatggagttatatttgtagtgtcagagcaaaacctcctctatctgcacatcctggggacgaaccgggcagccggagagctgcggccggcccagtcccgctccgcctttgaagggtaaaacccaaggcggggccttggttctggcagaagggacgctatgaccgcagaattcctctccctgctttgcctcgggctgtgtctgggctacgaagatgagaaaaagaatgagaaaccgcccaagccctccctccacgcctggcccagctcggtggttgaagccgagagcaatgtgaccctgaagtgtcaggctcattcccagaatgtgacatttgtgctgcgcaaggtgaacgactctgggtacaagcaggaacagagctcggcagaaaacgaagctgaattccccttcacggacctgaagcctaaggatgctgggaggtacttttgtgcctacaagacaacagcctcccatgagtggtcagaaagcagtgaacacttgcagctggtggtcacagataaacacgatgaacttgaagctccctcaatgaaaacaggttcatcatctgaggaatccaccaagagaaccagccattccaaacttccggagcaggaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacagccctggccactaaaggaggggggatcgtgctggccaaggttatcggaaatctggagatgcagatactgtgtttccttgctcttcgtccatatcaataaaattaagctgctatcaacataccaaagacctggcagcttacagacaacacatagttatttctcatggttctggaggctggaagtccaagaccaaagcactggtagattcagtgtctgctgagggcttttttcctggttcatagctggcaccttct

SEQ ID NO: 462442 - DNA, 1378 bp, Homo sapiens
ggagagtgccttgcagccagagagtcttgaaggagatgtcagggacgcatcttaacagctgttcaccatgaattcactcagtgaagccaacaccaagttcatgttcgacctgttccaacagttcagaaaatcaaaagagaacaacatcttctattcccctatcagcatcacatcagcattagggatggtcctcttaggagccaaagacaacactgcacaacagattaagaaggttcttcactttgatcaagtcacagagaacaccacaggaaaagctgcaacatatcatgttgataggtcaggaaatgttcatcaccagtttcaaaagcttctgactgaattcaacaaatccactgatgcatatgagctgaagatcgccaacaagctcttcggagaaaaaacgtatctatttttacaggaatatttagatgccatcaagaaattttaccagaccagtgtggaatctgttgattttgcaaatgctccagaagaaagtcgaaagaagattaactcctgggtggaaagtcaaacgaatgaaaaaattaaaaacctaattcctgaaggtaatattggcagcaataccacattggttcttgtgaacgcaatctatttcaaagggcagtgggagaagaaatttaataaagaagatactaaagaggaaaaattttggccaaacaagaatacatacaagtccatacagatgatgaggcaatacacatcttttcattttgcctcgctggaggatgtacaggccaaggtcctggaaataccatacaaaggcaaagatctaagcatgattgtgttgctgccaaatgaaatcgatggtctccagaagcttgaagagaaactcactgctgagaaattgatggaatggacaagtttgcagaatatgagagagacacgtgtcgatttacacttacctcggttcaaagtggaagagagctatgacctcaaggacacgttgagaaccatgggaatggtggatatcttcaatggggatgcagacctctcaggcatgaccgggagccgcggtctcgtgctatctggagtcctacacaaggcctttgtggaggttacagaggagggagcagaagctgcagctgccaccgctgtagtaggattcggatcatcacctacttcaactaatgaagagttccatttgttatgtctccttggttttttatgtttgttgttgtcttacctggatgtctgcgtgtttgaagaagcagataattttccagtctttgcagactggctttctctgggaaagtccttcaccagttattccattcagagattctgggcaggcccattgggcaggtttgctgctggagtcctcagtaaggctggcctggtgctgagtcaatgagtggtcagg

SEQ ID NO: 462443 - DNA, 1077 bp, Homo sapiens
gcgcttttccttgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggccactgaatgggtaggagcaaccactgactggtcttaagctgttcttgcataggctcttaagcagcatggaaaaatggttgatggaaaataaacatcagtttctaaaaaaaaaaaaagttactggcaattttttttctgtatttcaaaaaaaaaaaaaaaaagaacac

SEQ ID NO: 462444 - DNA, 1036 bp, Homo sapiens
gcgcttttccttgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttcta

SEQ ID NO: 462445 - DNA, 1177 bp, Homo sapiens
  misc_feature (1132)..(1132): n is a, c, g, or t
gcgcttttccttgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactgaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaaaaaaataaatgtgtttgtgctaanaaaaatagaaattatatgataaaatagtttgtaaagttgtttttt

SEQ ID NO: 462446 - DNA, 1099 bp, Homo sapiens
gcgcttttccttgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaaaaaaaaaaagttactggcaattttttttctgtatttcaaaaaaaaaaaaaaaaagaacac

SEQ ID NO: 462447 - DNA, 1030 bp, Homo sapiens
aaggctaggtacgaggcctggtgttgaatcggccgaggctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttcta

SEQ ID NO: 462448 - DNA, 1430 bp, Homo sapiens
  misc_feature (1)..(3): n is a, c, g, or t
  misc_feature (5)..(6): n is a, c, g, or t
nnntnnaggaggcatatggatgaggcggtgtgtctccgcaggtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcgttctgacaccttcgcttcagccccctccactttccctccgtgtgcccgaaatgggtccctgcccatcaccatccacagcagtggccactccccaggctgggcacccctcatgggccatggcttcggggacagcaaccttgcttgtgacaccaggagattggaccagatgctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagcgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgaccccgcctcatgggcaccgggcaggcgcctcacagagcacagacgtccctcggccttggtcgtgtcggggccgttttcttgaacgactattcccatccccgcatgcttctagggagcgcctcttttccgttcttgaggaatttctgttctggggcttgtccttcctttgcagctgttttgaatgtagttttccttttctatttatttgcacattaaagttaataattgaatattgacatcaagcc

SEQ ID NO: 462449 - DNA, 1156 bp, Homo sapiens
  misc_feature (1)..(3): n is a, c, g, or t
  misc_feature (5)..(6): n is a, c, g, or t
nnntnnaggaggcatatggatgaggcggtgtgtctccgcaggtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcgttctgacaccttcgcttcagccccctccactttccctccgtgtgcccgaaatgggtccctgcccatcaccatccacagcagtggccactccccaggctgggcacccctcatgggccatggcttcggggacagcaaccttgcttgtgacaccaggagattggaccagatgctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggtaagaggccctgagatgcatgctccgttccttccttcctgggcccagggagtgtcccctttgtcctgacgggggctggaccatggcacactgtctgggagcacttagtaggtgcctgctgtgtgctgaggcaggccctgcccttttgaggcttgtggtttgcagtggagggattagtaaccccaggacggtgaggtgtaggaggggcaaggccaaccccacgatgcgtcagtgggtgaagagtgaatgcccggactggagggagacgctgccagagctggtggggccaggccagaggcgggtggctgtggcaggaccctggaccacctcaggtcgggctaggatggcacctatgggaccagtgggggctgctggtgggtgttcagatctgggggcatttcttgttgct

SEQ ID NO: 462450 - DNA, 2646 bp, Homo sapiens
tgtgatataagattatagtgtcccctcccttcaccaacaatgaatttcatggtggatgaaacagcagcaatcaactcaaacaaggaatcccagcaattggtgcaaaaaacgtatacactggagaagaaagaagcaatggaggaagatgaagcgccccagcacagagatgctgacatagtacagggaaaaggggaggcagcactgtggggagaagcaggagctgttcatgaggctcccttgagggcgtggaagccaacagcagagcagccagaattggcagaagagtttacagaaaaaagggagatccctccaggcatagaaaggggggcagagggagcagcagaagcagaaggggtcagaaggctgggtgaaggggggtcagaccccataggacaagcagcagcaaaagatgctgtgggtctgagtaaagatgaggctcctgaaaagcaagccttgatgctcacagtgcttgagacagacaaagcagcttctgaaggggaacagggtttagagaaggcagtgcttgcaaatgaagcagcagccctgaacttggagcatcttcatgaagtagcagccctgagagaggcagcgacatcggaggagggagaggctgagggtggggtggctgtgagtgatgtcggagaaagtgaagaggaagcatccatagacctagaggacacaggacccatggaggacacagcatcaaagagagaggacggttctgaagaggcaattcttgggggagaggaaccagccaaagagagaaaagaggttatgagaacagaaacacgcttgagccccttcacaggagaggcagaggcaagccggatgcaggtttcggagggcagccctgaggaaggaagccttgcaaaggaagccttcctttgcaaggaagatgtggaaggggaagagatggtgactgaggcagaagctaatagggaagatgataggaaagaaattttacccaaggaattagatttagcaagagagcgaaggaaagctgagaggccaaaaacatctctgaggaaaactgactctgagagagaagaggtgacaagggcaaatgcactcaaggatgaagatgcttttaaagaagagcaaaaacttaaagcggaagaaggggaaacagagacagaagtaagagctgaggaagagacaaaagctcccccaaatgaaatgggatctgatgctgagaacgaagcacctgtggaggcttctgagttgtctgacaatccagggcttctaggagaagattcactaaaagagacagtggttcccatatttgaagcaacgcctggatttgaaaagtcgctggaaaacataacagctctgaggaaagaaggaggaggggaaagactgagtgaagccagagacacagagcacaaagacagagaagagctgtccagcagggagaatagggccctgaaggaagggcaccgccaagatggagagggggccttagcagctcctgaagctgagccagcaggaaaggtgcaggcccctgaggggctgatcccagccacaggccaggcagaggagctagcagccaaagatcacgactcctgcgcaggactggaggggagagctgaagggcaaggaggagtggatgtcgtgctaaggacccaggaagctgttgctgaggaagatcccataatggcagaaaagttcagggaggaagcggtggatgaggacccagaggaggaagaggacaaagagtgcactctggagacagaagcgatgcaggacaggaactcggaaggggacggggacatggaaggagaaggaaacacacaaaagaatgagggcatgggaggaggaagggttgtggctgtggaagttctacacggaggtggtgaaacggcagaaacagccgcagaggagagggaggtgttggcaggttcggagacagccgaggagaaaacaatagcaaataaagcctcctccttttcagatgttgctgaggaagaaacctggcaccaacaggatgagttagtaggaaaaacagcagctgcagggaaggtggtggtagaggaattagcacggagtggggaggaagtgccagcagcagaggagatgacagtgacatatacaacagaggctggggtgggcactccaggagccctggagcggaagacctcagggctaggacaggagcaagaggaagggtcagagggccaggaggcagccactgggagtggcgatgggaggcaggagacaggagcagctgaaaaattccgattaggattatcacgggagggagagagggaattgagtccggagagtctacaggcgatggcaacacttccagtgaagcctgatttcactgaaacccgagagaagcaacagcatatggtgcaaggagaaagcgagactgcagatgtttcccccaacaacgtgcaggtctaggagacttgctggcagacaggtggtgaggtatgcttaaaaggaaggaacaagaagcaccatgaagacagagtttgtttggggggttagtatcctccagaccacaccaggaatccaattattttcaggcaaataacagaagatcctgaaaaacaggtaaaaagtccttgccaccttgtggagacatggatcaagcaaatcaagaatactattaataatgtgaagtttaaatattaatattct

SEQ ID NO: 462451 - DNA, 1859 bp, Homo sapiens
acccccagcggcctcacctgcgtttccctccgcttcagctttgtgatggtcaacagcgtggcgctgaacggggatggctgtggcatctgctctgaaacagaagaagagctcattgaagtttctcacagactgaactgctcccgagaggcacgtggctccagccggtgtggacctgggcctctgctgcccacgtctgcccctgtcctcctgcagcattatcctctgtatcggagaagtgatgctaactgttctggggaagacgctgctcctccagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactctagcctgggcaacagagtgagactccgtctcaaaaaatatattttaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgtttttttttcttaacagtctggctgttgtttgaattaaactcttaaa

SEQ ID NO: 462452 - DNA, 1771 bp, Homo sapiens
ttttacttcataaaaaggtggaggaaaccctaacattttcaaattcaaagtaaatgaaaacatttgccactgttgttccacataaaagtatctgcagagaaaagcccatggagacgacctggacacatgtatttctagggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacaggtcagtgtcccagacattttccactcaggcacacttgggccttacttgtctctcctgctggagcctgggctggtcgggggtgagctgtgcagggagaaggctgggcccccttggtctcaggtgaggagggcccgttccctgcctcacctgagggggacctgagaaggcagtcttccctctgctgtttctaagactgcggtgttcaacctgtgcctggtgctctcagcataactttcccttctcctttccagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactctagcctgggcaacagagtgagactccgtctcaaaaaatatattttaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgtttttttttcttaacagtctggctgttgtttgaattaaactcttaaa

SEQ ID NO: 462453 - DNA, 662 bp, Homo sapiens
ttttacttcataaaaaggtggaggaaaccctaacattttcaaattcaaagtaaatgaaaacatttgccactgttgttccacataaaagtatctgcagagaaaagcccatggagacgacctggacacatgtatttctagggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacaggtcagtgtcccagacattttccactcaggcacacttgggccttacttgtctctcctgctggagcctgggctggtcgggggtgagctgtgcagggagaaggctgggcccccttggtctcaggtgaggagggcccgttccctgcctcacctgagggggacctgagaaggcagtcttccctctgctgtttctaagactgcggtgttcaacctgtgcctggtgctctcagcataactttcccttctcctttccagggtagcatcacgcccacagactacaccctctccaagtgctacctcccacgtgaggatgtggttttgatcatctactgtggagtgcacttggagagtctccgtcgaact

SEQ ID NO: 462454 - DNA, 1011 bp, Homo sapiens
acccccagcggcctcacctgcgtttccctccgcttcagctttgtgatggtcaacagcgtggcgctgaacggggatggctgtggcatctgctctgaaacagaagaagagctcattgaagtttctcacagactgaactgctcccgagaggcacgtggctccagccggtgtggacctgggcctctgctgcccacgtctgcccctgtcctcctgcaggtgagctgggggaggaaagggctcatggcagacagcaggcagcctgtggtttcacgatagccgcctgaactcctctctccaccccggacagcattatcctctgtatcggagaagtgatgctaactgttctggggaagacgctgctcctccagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatggtaacgtgaaagtttatttttgtctgaaagctttcataagtatttaaatcaacacagtaatcaactatttaattgctgcaatcggtcaaaatttacaagagccacacacaaatttctctccctctacacgtagctccatacactgccccttgccaaacacccttccgggaaccaatcagcatgacattcctgggcagttaatgtgagaagcgagggcagggcaccgtccaggtggactttatccttcagggagggccgtatcctctcctcttacactctgtgtgtgtttaattttctaaagaaacaaccatttattcattagctatactcagccatcttctcttattttctaaacatgcccatttgacctggcagagaacgctacagcttttgcaggttgataaaagatgtttcacttaatgaccactgggcgttttaactcc

SEQ ID NO: 462455 - DNA, 1785 bp, Homo sapiens
acccccagcggcctcacctgcgtttccctccgcttcagctttgtgatggtcaacagcgtggcgctgaacggggatggctgtggcatctgctctgaaacagaagaagagctcattgaagtttctcacagactgaactgctcccgagaggcacgtggctccagccggtgtggacctgggcctctgctgcccacgtctgcccctgtcctcctgcaggtgagctgggggaggaaagggctcatggcagacagcaggcagcctgtggtttcacgatagccgcctgaactcctctctccaccccggacagcattatcctctgtatcggagaagtgatgctaactgttctggggaagacgctgctcctccagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactctagcctgggcaacagagtgagactccgtctcaaaaaatatattttaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgtttttttttcttaacagtctggctgttgtttgaattaaactcttaaa

SEQ ID NO: 462456 - DNA, 591 bp, Homo sapiens
acccccagcggcctcacctgcgtttccctccgcttcagctttgtgatggtcaacagcgtggcgctgaacggggatggctgtggcatctgctctgaaacagaagaagagctcattgaagtttctcacagactgaactgctcccgagaggcacgtggctccagccggtgtggacctgggcctctgctgcccacgtctgcccctgtcctcctgcaggtgagctgggggaggaaagggctcatggcagacagcaggcagcctgtggtttcacgatagccgcctgaactcctctctccaccccggacagcattatcctctgtatcggagaagtgatgctaactgttctggggaagacgctgctcctccagaggaaagggacatcccatttaaggagaactatgacgtgtttcacagtatctcagattttcatttaatcgctttttttttttccagtaaacctacttctgtttcctaccctcaagtcagtaatagtctcagctattctttgtattcagagtttttcaccaacttaaatgtatttagaaatgtgaatggaactgaaaagtcaattttttagggacttaattaaaaatt

SEQ ID NO: 462457 - DNA, 4778 bp, Homo sapiens
tgctgcagggatgttaggatttcttgggcctgggaatccacttctccctccccctggtctctccttgtctctcttcacctctgtctctgactttcctggtctctgtcccaggccccctccccactggcaggaagatcaaagccacctaaggccgtagccccaaacacagattcctgggagccgccgcagggggaatccctgccggaaggttttgcctggagcagagacatagcgtctcacctcccacccctcctgccttcccactgcaccatggctccaggacccttctcctcggccctcctctcgccgccgcccgctgccctgccctttctgctgctgctctgggcgggggcatctcgtggccagccctgccccggccgctgcatctgccagaacgtggcgcccacactgacaatgctgtgcgccaagaccggcttgctctttgtgccgcccgccatcgaccggcgcgtggtggagctgcggctcaccgacaacttcatcgccgccgtgcgccgccgagacttcgccaacatgaccagcctggtgcacctcactctctcccggaacaccatcggccaggtggcagctggcgccttcgccgacctgcgtgccctccgggccctgcacctggacagcaaccgcctggcggaggtgcgcggcgaccagctccgcggcctgggcaacctccgccacctgatccttggaaacaaccagatccgccgggtggagtcggcggcctttgacgccttcctgtccaccgtggaggacctggatctgtcctacaacaacctggaggccctgccgtgggaggcggtgggccagatggtgaacctaaacaccctcacgctggaccacaacctcatcgaccacatcgcggaggggaccttcgtgcagcttcacaagctggtccgtctggacatgacctccaaccgcctgcataaactcccgcccgacgggctcttcctgaggtcgcagggcaccgggcccaagccgcccaccccgctgaccgtcagcttcggcggcaaccccctgcactgcaactgcgagctgctctggctgcggcggctgacccgcgaggacgacttagagacctgcgccacgcccgaacacctcaccgaccgctacttctggtccatccccgaggaggagttcctgtgtgagcccccgctgatcacacggcaggcggggggccgggccctggtggtggaaggccaggcggtgagcctgcgctgccgagcggtgggtgaccccgagccggtggtgcactgggtggcacctgatgggcggctgctggggaactccagccggacccgggtccggggggacgggacgctggatgtgaccatcaccaccttgagggacagtggcaccttcacttgtatcgcctccaatgctgctggggaagcgacggcgcccgtggaggtgtgcgtggtacctctgcctctgatggcacccccgccggctgccccgccgcctctcaccgagcccggctcctctgacatcgccacgccgggcagaccaggtgccaacgattctgcggctgagcgtcggctcgtggcagccgagctcacctcgaactccgtgctcatccgctggccagcccagaggcctgtgcccggaatacgcatgtaccaggttcagtacaacagttccgttgatgactccctcgtctacaggatgatcccgtccaccagtcagaccttcctggtgaatgacctggcggcgggccgtgcctacgacttgtgcgtgctggcggtctacgacgacggggccacagcgctgccggcaacgcgagtggtgggctgtgtacagttcaccaccgctggggatccggcgccctgccgcccgctgagggcccatttcttgggcggcaccatgatcatcgccatcgggggcgtcatcgtcgcctcggtcctcgtcttcatcgttctgctcatgatccgctataaggtgtatggcgacggggacagccgccgcgtcaagggctccaggtcgctcccgcgggtcagccacgtgtgctcgcagaccaacggcgcaggcacaggcgcggcacaggccccggccctgccggcccaggaccactacgaggcgctgcgcgaggtggagtcccaggctgcccccgccgtcgccgtcgaggccaaggccatggaggccgagacggcatccgcggagccggaggtggtccttggacgttctctgggcggctcggccacctcgctgtgcctgctgccatccgaggaaacttccggggaggagtctcgggccgcggtgggccctcgaaggagccgatccggcgccctggagccaccaacctcggcgccccctactctagctctagttcctgggggagccgcggcccggccgaggccgcagcagcgctattcgttcgacggggactacggggcactattccagagccacagttacccgcgccgcgcccggcggacaaagcgccaccggtccacgccgcacctggacggggctggagggggcgcggccggggaggatggagacctggggctgggctccgccagggcgtgcctggctttcaccagcaccgagtggatgctggagagtaccgtgtgagcggcgggcgggcgccgggacgcctgggtgccgcagaccaaacgcccagccgcacggacgctggggcgggactgggagaaagcgcagcgccaagacattggaccagagtggagacgcgcccttgtccccgggagggggcggggcagcctcgggctgcggctcgaggccacgcccccgtgcccagggcggggttcggggaccggctgccggcctcccttcccctatggactcctcgacccccctcctacccctcccctcgcgcgctcgcggacctcgctggagccggtgccttacacagcgaagcgcggggaggggcagggccccctgacactgcagcactgagacacgagccccctcccccagcccgtcacccggggccggggcgaggggcccatttcttgtatctggctggactagatcctattctgtcccgcggcggcctccaaagcctcccaccccaccccacgcacattcctggtccggtcgggtctggcttggggtccccctttctctgtttccctcgtttgtctctatcccgccctcttgtcgtctctctgtagtgcctgtctttccctatttgcctctcctttctctctgtcctgtcgtctcttgtccctcggccctccctggttttgtctagtctccctgtctctcctgatttcttctctttactcattctcccgggcaggtcccactggaaggaccagactctcccaaataaatccccacacgaacaaaatccaaaaccaaatccccctccctaccggagccgggaccctccgccgcagcagaattaaacttttttctgtgtctgaggccctgctgacctgtgtgtgtgtgtgtgtgtgtgtgttgggggagggtgacctagattgcagcataaggactctaagtgagactgaaggaagatgggaagatgactaactggggccggaggagactggcagacaggcttttatcctctgagagacttagaggtggggaataatcacaaaaataaaatgatcataatagctaacgcttagtgaatacttacttactatgtgccaagcacttaagtcatttaattctcacaacaccaggacatatcggtattattatcctgttttccagatgagggaattttggcccagaaaagttaaataactggcccaaggtggtaaaactgggatttaaaaaggcaggcaggccaacttctgagtctctactataggggtgaaaagacagcttccccttcactctctgaaatttcactggaatgggctgacaatagattaacaagagaaaaggaatatggagggtatttaacatgcactaggaaaatcacaggaaagtgattacccaataacccagtgaggtttatatacttatatacctttcttcacaggaggggagatggggaaaggaaggcaattttgaggggtaataaatgattttggggaaaataaatgggtccaggagatagaatttagcttgtaaatgtctctggaatttgagactgacagacagataatttcttgtgacaaagtccgtccaggtgtagacatttctctgtctttttttcctgttaaagataatgaaatgtcagggagaggacagaaggcacttgtgttctttttgatctttaggcagataagaagacataggaggaaagcctcttccagcatctatggatctctaagtgcctttaatttaaaataatcagcataccagggtgccatattttggggtgacattccctgaactcctttaatactcaactagagcactgtactgctgagcagttattgaatattcattccaccctctgagacctcacaactcagtggggtagggtagatctatccttggtcccattttacagacaagaacctgaaccacagagagatgaagtcacttgccgtagtccctccatccccccaatgaataaatagcggagctggaagtttgattgtacccctacactatgctgcctctggggtctgtgtccggaagctggggtatggcccccatgagcttagctgagcttggatatccacagctagcctggtgagctcagggacaagacctcttgtgtcgctctgcctggaatctgagggaccctggcggagggcatggaggatggtgtggggagaggagtttctcaggtgaggctgagggctgtggctggggaaggaaagctggttggggag

SEQ ID NO: 462458 - DNA, 4827 bp, Homo sapiens
tgctgcagggatgttaggatttcttgggcctgggaatccacttctccctccccctggtctctccttgtctctcttcacctctgtctctgactttcctggtctctgtcccaggccccctccccactggcaggaagatcaaagccacctaaggccgtagccccaaacacagattcctgggagccgccgcagggggaatccctgccggaaggttttgcctggagcagagacatagcgtctcacctcccacccctcctgccttcccactgcaccatggctccaggacccttctcctcggccctcctctcgccgccgcccgctgccctgccctttctgctgctgctctgggcgggggcatctcgtggccagccctgccccggccgctgcatctgccagaacgtggcgcccacactgacaatgctgtgcgccaagaccggcttgctctttgtgccgcccgccatcgaccggcgcgtggtggagctgcggctcaccgacaacttcatcgccgccgtgcgccgccgagacttcgccaacatgaccagcctggtgcacctcactctctcccggaacaccatcggccaggtggcagctggcgccttcgccgacctgcgtgccctccgggccctgcacctggacagcaaccgcctggcggaggtgcgcggcgaccagctccgcggcctgggcaacctccgccacctgatccttggaaacaaccagatccgccgggtggagtcggcggcctttgacgccttcctgtccaccgtggaggacctggatctgtcctacaacaacctggaggccctgccgtgggaggcggtgggccagatggtgaacctaaacaccctcacgctggaccacaacctcatcgaccacatcgcggaggggaccttcgtgcagcttcacaagctggtccgtctggacatgacctccaaccgcctgcataaactcccgcccgacgggctcttcctgaggtcgcagggcaccgggcccaagccgcccaccccgctgaccgtcagcttcggcggcaaccccctgcactgcaactgcgagctgctctggctgcggcggctgacccgcgaggacgacttagagacctgcgccacgcccgaacacctcaccgaccgctacttctggtccatccccgaggaggagttcctgtgtgagcccccgctgatcacacggcaggcggggggccgggccctggtggtggaaggccaggcggtgagcctgcgctgccgagcggtgggtgaccccgagccggtggtgcactgggtggcacctgatgggcggctgctggggaactccagccggacccgggtccggggggacgggacgctggatgtgaccatcaccaccttgagggacagtggcaccttcacttgtatcgcctccaatgctgctggggaagcgacggcgcccgtggaggtgtgcgtggtacctctgcctctgatggcacccccgccggctgccccgccgcctctcaccgagcccggctcctctgacatcgccacgccgggcagaccaggtgccaacgattctgcggctgagcgtcggctcgtggcagccgagctcacctcgaactccgtgctcatccgctggccagcccagaggcctgtgcccggaatacgcatgtaccaggttcagtacaacagttccgttgatgactccctcgtctacaggatgatcccgtccaccagtcagaccttcctggtgaatgacctggcggcgggccgtgcctacgacttgtgcgtgctggcggtctacgacgacggggccacagcgctgccggcaacgcgagtggtgggctgtgtacagttcaccaccgctggggatccggcgccctgccgcccgctgagggcccatttcttgggcggcaccatgatcatcgccatcgggggcgtcatcgtcgcctcggtcctcgtcttcatcgttctgctcatgatccgctataaggtgtatggcgacggggacagccgccgcgtcaagggctccaggtcgctcccgcgggtcagccacgtgtgctcgcagaccaacggcgcaggcacaggcgcggcacaggccccggccctgccggcccaggaccactacgaggcgctgcgcgaggtggagtcccaggctgcccccgccgtcgccgtcgaggccaaggccatggaggccgagacggcatccgcggagccggaggtggtccttggacgttctctgggcggctcggccacctcgctgtgcctgctgccatccgaggaaacttccggggaggagtctcgggccgcggtgggccctcgaaggagccgatccggcgccctggagccaccaacctcggcgccccctactctagctctagttcctgggggagccgcggcccggccgaggccgcagcagcgctattcgttcgacggggactacggggcactattccagagccacagttacccgcgccgcgcccggcggacaaagcgccaccggtccacgccgcacctggacggggctggagggggcgcggccggggaggatggagacctggggctgggctccgccagggcgtgcctggctttcaccagcaccgagtggatgctggagagtaccgtgtgagcggcgggcgggcgccgggacgcctgggtgccgcagaccaaacgcccagccgcacggacgctggggcgggactgggagaaagcgcagcgccaagacattggaccagagtggagacgcgcccttgtccccgggagggggcggggcagcctcgggctgcggctcgaggccacgcccccgtgcccagggcggggttcggggaccggctgccggcctcccttcccctatggactcctcgacccccctcctacccctcccctcgcgcgctcgcggacctcgctggagccggtgccttacacagcgaagcgcggggaggggcagggccccctgacactgcagcactgagacacgagccccctcccccagcccgtcacccggggccggggcgaggggcccatttcttgtatctggctggactagatcctattctgtcccgcggcggcctccaaagcctcccaccccaccccacgcacattcctggtccggtcgggtctggcttggggtccccctttctctgtttccctcgtttgtctctatcccgccctcttgtcgtctctctgtagtgcctgtctttccctatttgcctctcctttctctctgtcctgtcgtctcttgtccctcggccctccctggttttgtctagtctccctgtctctcctgatttcttctctttactcattctcccgggcaggtcccactggaaggaccagactctcccaaataaatccccacacgaacaaaatccaaaaccaaatccccctccctaccggagccgggaccctccgccgcagcagaattaaacttttttctgtgtctgaggccctgctgacctgtgtgtgtgtctgtatgtgtgtccgcgtgtagtgtgtgtgtgtgtgtgtgtgtgtgtgtgtgtgtgtgtgtgttgggggagggtgacctagattgcagcataaggactctaagtgagactgaaggaagatgggaagatgactaactggggccggaggagactggcagacaggcttttatcctctgagagacttagaggtggggaataatcacaaaaataaaatgatcataatagctaacgcttagtgaatacttacttactatgtgccaagcacttaagtcatttaattctcacaacaccaggacatatcggtattattatcctgttttccagatgagggaattttggcccagaaaagttaaataactggcccaaggtggtaaaactgggatttaaaaaggcaggcaggccaacttctgagtctctactataggggtgaaaagacagcttccccttcactctctgaaatttcactggaatgggctgacaatagattaacaagagaaaaggaatatggagggtatttaacatgcactaggaaaatcacaggaaagtgattacccaataacccagtgaggtttatatacttatatacctttcttcacaggaggggagatggggaaaggaaggcaattttgaggggtaataaatgattttggggaaaataaatgggtccaggagatagaatttagcttgtaaatgtctctggaatttgagactgacagacagataatttcttgtgacaaagtccgtccaggtgtagacatttctctgtctttttttcctgttaaagataatgaaatgtcagggagaggacagaaggcacttgtgttctttttgatctttaggcagataagaagacataggaggaaagcctcttccagcatctatggatctctaagtgcctttaatttaaaataatcagcataccagggtgccatattttggggtgacattccctgaactcctttaatactcaactagagcactgtactgctgagcagttattgaatattcattccaccctctgagacctcacaactcagtggggtagggtagatctatccttggtcccattttacagacaagaacctgaaccacagagagatgaagtcacttgccgtagtccctccatccccccaatgaataaatagcggagctggaagtttgattgtacccctacactatgctgcctctggggtctgtgtccggaagctggggtatggcccccatgagcttagctgagcttggatatccacagctagcctggtgagctcagggacaagacctcttgtgtcgctctgcctggaatctgagggaccctggcggagggcatggaggatggtgtggggagaggagtttctcaggtgaggctgagggctgtggctggggaaggaaagctggttggggag

SEQ ID NO: 462459 - DNA, 969 bp, Homo sapiens
gcagcaactcctccccaattaccacaatcgtcacctcctggccgctgtcacagccacatgctctcatcctcactgactgaatgacgagaaatgaaagctgaagtggtctacacagcagagagctgtggggtggggtcagccctggccacctcttactttgcgtcttatggtgactctgtgattctccctgggccaccttctgtcttccaggtcctgccctatccttggatccagggataccaccctggcatccccaccacctacagatgggagcttgctccctgttcccgcccccccggggccccctctggccggcccgctgcagggctggcggcggagaccccgccagctgtggctccgggtgccgcgcgccccctagtggccatggcaggttttgcagcacatctggcggaagtaggctcggctgcagaactgaaatttgagcaccagggggcagtctcagctgccctccccgcagggctgcacacacgacctgcagtgcttcctggccagtgactttctgtgccttggtttctttctttttaaatttactttttttttttttttttttttttttttttacagatgttatcttgctatgttgaccaggctggtctccacctcttgagctcaagtgatcctctcacctcagcctcctaagtagttgggactacaggtgtgagcaaaccacgcctgacttctgtgccttagtttcctcaactatcaaagggggcttataatagcaccgatgtcactaggctgttttgaggatttaagagagagagtgtaggggtatttttcagaacattgactattttgtgtgatcatgatgtctgttgatgactatggatggatatgagcttccatctagcggccagtgatttatggcaggaccaggggcgaattaaaagctacagatggattttttttttttttttggtcgcccaggctggagtgcagtggcacaat

SEQ ID NO: 462460 - DNA, 638 bp, Homo sapiens
cctccaggaaaaacaacagcagcagtatttatttgtcggtaccgaaactcgtatgctctcagctcaccgtcatggatgctctatcagaagcaaatggcacatttgcattaaaccttttgaaaaagctaggggaaaacaactcaaacaacttatttttttccccatgagcatatcatcagccttggccatggttttcatgggggcaaagggaaacactgcagctcagatgtctcaggcactttgttttagtaaaatcggaggtgaagatggagatattcatcgaggttttcagtcacttcttgttgcaattaacagaactgacactgaatatgtgcttagaactgccaacgggctctttggagaaaagtcttatgatttcctcacaggttttacagattcctgtggcaaattctaccaagcaacgataaaacagctagactttgtgaatgatacagagaagtccacaacacgtgtaaactcctgggttgctgataaaactaaaggtgaaaatatattgttattctatttcgataatattttaaacagttttatagtcagttctttacaaaactgtcaaatataaaaaggagtccttttttctctaaacaactatgcaaacattaaaacctttctttgga

SEQ ID NO: 462461 - DNA, 711 bp, Homo sapiens
cctccaggaaaaacaacagcagcagtatttatttgtcggtaccgaaactcgtatgctctcagctcaccgtcatggatgctctatcagaagcaaatggcacatttgcattaaaccttttgaaaaagctaggggaaaacaactcaaacaacttatttttttccccatgagcatatcatcagccttggccatggttttcatgggggcaaagggaaacactgcagctcagatgtctcaggcactttgttttagtaaaatcggaggtgaagatggagatattcatcgaggttttcagtcacttcttgttgcaattaacagaactgacactgaatatgtgcttagaactgccaacgggctctttggagaaaagtcttatgatttcctcacaggttttacagattcctgtggcaaattctaccaagcaacgataaaacagctagactttgtgaatgatacagagaagtccacaacacgtgtaaactcctgggttgctgataaaactaaagcctggaaaattattcaaacaagcctgtcacatctggaggagccaggaatcgcctcttcctcttgttactgcaaagcctgccttccacagcccctactggttcactctattcccaaatgcaactctcctgtgaccccgcatggcatgtggtgacctccctccctgtgagcagttgtgactaataaactgccgccaatttcatctgtcca

SEQ ID NO: 462462 - DNA, 985 bp, Homo sapiens
cctccaggaaaaacaacagcagcagtatttatttgtcggtaccgaaactcgtatgctctcagctcaccgtcatggatgctctatcagaagcaaatggcacatttgcattaaaccttttgaaaaagctaggggaaaacaactcaaacaacttatttttttccccatgagcatatcatcagccttggccatggttttcatgggggcaaagggaaacactgcagctcagatgtctcaggcactttgttttagtaaaatcggaggtgaagatggagatattcatcgaggttttcagtcacttcttgttgcaattaacagaactgacactgaatatgtgcttagaactgccaacgggctctttggagaaaagtcttatgatttcctcacaggttttacagattcctgtggcaaattctaccaagcaacgataaaacagctagactttgtgaatgatacagagaagtccacaacacgtgtaaactcctgggttgctgataaaactaaagtccacaagggaacgaagaaacaccaccaacagcgtccacatggccttcacgacatggccctgtggacacatcagacgttgtcttgcagtgcctcatccacactatctgtaccactgcaggcctggatacgtcatggttttcatggtgctatcttgtgcctctttgcacctgcacgcactgtgtttcctacatgggatatctgtgtttacaaccaaactcccaggggccaaattatatcctttgtaaaggacttcaaaccaccaggcatttgctggaagtttcacggaggaaaacaagcatttttcatcttttaatctgttttgctggtcaaagaggaaaaggagtggatggacaaagtggggcccaaagtctggatctagttctgaccaacaaggagaaattgatgcacaatggggaagtgaccttggcattttcaactggcagagccggtaagtttgggcacagttcaaatgtgagtctgt

SEQ ID NO: 462463 - DNA, 2127 bp, Homo sapiens
gcaaatgcgtgctacgtcactgtgcgatcgggttgtgcttagcttggggtctcctggccccttgacgcgtcaggttgctgtacccctgcatcggatgcgctgtaccctgcgctggctccgtgaaccttagggacaacaccgggacacccgcgaggccggaaaatggactcagtggcttttgaggatgtgtctgtgagcttcagccaggaggagtgggctctgctggctccttcacagaagaaactctacagagatgtgatgcaggaaacattcaagaacctggcatctataggggaaaaatgggaagacccgaatgttgaagatcaacacaaaaaccaaggacgaaatctaagaagccatacgggagagagactctgtgaaggtaaagaaggtagtcaatgtgcagaaaacttcagtcccaatctcagtgtgacgaagaagactgccggagtaaaaccatatgagtgtactatctgtggaaaagccttcatgcgtctctcatcccttactagacacatgaggtctcacactggatacgagctatttgagaagccatataaatgtaaggagtgtgagaaagcctttagttatctcaaatcctttcaaagacatgaaaggagtcacactggagaaaaaccctataaatgtaaacaatgtggaaaaaccttcatatatcaccagccctttcaaagacatgagcggactcacattggagaaaaaccctatgaatgtaagcaatgtggaaaagctcttagttgttccagttcgcttcgagttcatgaaaggattcacactggagaaaagccctatgaatgtaaacaatgtgggaaagccttcagttgttccagttctattcgagtacacgaaagaactcacactggagagaaaccctatgcatgtaaggaatgtgggaaagccttcatttcccacacaagtgttctaacacacatgataacacacaacggagatagaccttataaatgcaaagaatgtggaaaggcattcatttttcccagttttttacgagtacatgaaagaattcacactggagagaaaccctataaatgtaaacaatgtggtaaagccttcagatgttccacctccattcaaattcatgaaagaattcatactggagagaagccctataaatgtaaagaatgtgggaaatctttcagtgcacgcccagcctttcgagtacacgtgagagtgcatactggagagaaaccctataagtgtaaagaatgtgggaaagcctttagtagaatcagttactttcgaatacatgaaaggactcacactggagagaaaccctacgaatgtaaaaaatgtgggaaaactttcaattatcctctagatttgaaaatccacaagagaaatcacactggagaaaaaccctatgagtgtaaggaatgtgcaaaaaccttcatttctcttgagaactttcgaagacacatgatcacccacactggagacggaccttataaatgtagggactgtgggaaggtgttcatttttcctagtgcgttacgaacacatgaaagaactcacactggagagaaaccctatgaatgtaaacaatgtggaaaagcctttagttgttctagttacattcggatacataaaagaactcacactggggagaaaccttatgaatgtaaggaatgcgggaaggcctttatttatcccacaagctttcaaggacacatgagaatgcatactggagagaaaccctataaatgtaaagaatgtgggaaggcctttagtcttcacagttcctttcaaagacatacaagaattcacaattatgagaaacctcttgaatgtaagcaatgtggaaaagccttcagtgtgtccacatccttaaaaaaacatatgagaatgcacaatcgatagaaactctataaatgtgagaaataggagaaagttttcaattctaacagatgctttcaaagttgtgaaaattcccactgaagagagaaatcctgtcaatgtaagtaatatagaaagcgagatacaagatgattcatgtatagtcaggtaccacataatcatgtttcagtcagcaatggaccatataggttggtagccccataagattatataacacctaaaacatttctatcaacc

SEQ ID NO: 462464 - DNA, 964 bp, Homo sapiens
ctgacacctcctaagatgaactgcagccacgatgcttcttcctaacggctcaatatggggtacagcgcgcggccatcttatttttttgctcaggctgtgccctgaaattaattcactgtcttccaacgccgtggtaacagcccttccgggttctctggtgggagtcgccgagatgggcgtggccatgatacgtcacaatacgaggccgagggaggaattctgtcgtctgggaacggctggtttcgcggtcagacgccgagggccctcgaagtccctagcaacggctgcggagggagatgtaagtcgttttggacgcaggctcagtgtttggtcccagcgttcggtggagtccggagagactcaggatcagatgagtcggggtctggatgtggctccaagtgaaaggcctgtgggggtcagtgaaggggagccccctgttctgagaccgtgtgggaccccgcgtcctggggttctttctgggtttactcaatggagaagcctggctttggtgatagggcgcctggcgctggactacatataaaatttttcaatggcagtatcacatcagaaggttgtaccagtggcttagtaaatggagtcacattaaatgtttgccttaattaggatggaattgacatgtataaaatattcaattctatttctatattttctatctatatataacattctgatactccaattactcaagttcttctgttcccaccccaagatttgtgattcacttttttatgtcctagatcttatggttacatttattcttaagtggcttatactgttttttttgataattcctctagaagaggaagtcattttttaaaaattgagacagagtctcacaccgttgcccaggctagagttgcagtgagccaaaatcacaccactgcagtccagcctgggcaatagagccagaccctgtctcaaaaaaaaaaaaaaaaaaaaaaaa

SEQ ID NO: 462465 - DNA, 514 bp, Homo sapiens
gcggcgcctactactactaaattcgcggccgcgtcgactgctgcgctgcctgcaatttactttcaaatagctcagcagaaacgatacgcagggacaaggagagagcagacctggtgaaacgttaacaactgatgaatccaagtgaagagtgcatgcccttacttgtactgttgtttcaacttttctgcaggaggttcttatttccccctcattgagtctgggctggccgtgtggctgttcaaccaacagaaagcagcagaagtgtactgtgcagtccggggcccaggcttttagagaactgtggctttctctgcctccttcttggaatccacttaccatgttgagaggggcccaagccacatagaggccaacagccaagtatttgcagccatctgggtgagccatctaggacattccacgccaatcagacccctggattggagcagtggagcagacatggagcagatgcagcccagcgaaggccagtatcacaggccagaacaaaatgttttaa

SEQ ID NO: 462466 - DNA, 1600 bp, Homo sapiens
ttggggcagtaatgatttctgagaagcaggtgattgataacgcgcaaattcaaagccccttgggggctgcattgtagcatggtgtggggatggggagacagagggctggtaggatcccgaattcctagtttttctctccctctcccttgcttcttcattttcttccttcaggctttcttccatttctttcttccatcaaatatttgtggagctggaactgggcttcactatcatattccaaggccctgtactgggaacagacaaagaagctcctcccagagactggaagaatggtacaaggtgtgaaaaccaaggcttaaagcatgcaagttatttgcccgaggtttttcagccacaaatgaagaagctgggtctgctccacacctgtgaaccaggctatttccaccataacctgaactcagatgagcaccagcccatggagaatagtccagaaggctgcccatagccttaaaggacagtggatgagcggttgcaggcagagatgacagcatgagatatttcaccaaagagtgggtgtttaaccaccacttgtctaggagatgggcaacatgtcccagagatgattctaacagggaactcttcctggcagagtccagtgaagggaaccaggaaattcgggggcagggcaatcccactctctctgtcaggctctgcaagctccacttccttctccactttcccacaaatatagtgtttcttaaaagcaaatctggttgcatcacactgctgtttgaaaatgccaatgattccttgttgtctatgactcattcccacactgggtcctcagggccacctggatgtagacttttgggtcccaccagggagaactttgatggtgtgcttcaagtcaacagtgatgtctgtggctcggatgaagatggacaggccatgctcagagaattctcaagacttgaaggagtgaatagcttcctggaggacagatggaagaaccccaaagcatccaaaacactaatcctgtgaaatttcatggggaataagggccagttctttctttggttataaatgatcaattgctcaagggatgggggatatctggcttgatcaaacccaaggcgatttcgtgctgaagtacttggggtgattgctgcgctgcctgcaatttactttcaaatagctcagcagaaacgatacgcagggacaaggagagagcagacctggtgaaacgttaacaactgatgaatccaagtgaagagtgcatgcccttacttgtactgttgtttcaacttttctgcaggaggttcttatttccccctcattgagtctgggctggccgtgtggctgttcaaccaacagaaagcagcagaagtgtactgtgcagtccggggcccaggcttttagagaactgtggctttctctgcctccttcttggaatccacttaccatgttgagaggggcccaagccacatagaggccaacagccaagtatttgcagccatctgggtgagccatctaggacattccacgccaatcagacccctggattggagcagtggagcagacatggagcagatgcagcccagcgaaggccagtatcacaggccagaacaaaatgttttaa

SEQ ID NO: 462467 - DNA, 1142 bp, Homo sapiens
cagcctggctaacatggcgaaacaccgtctctactaaaaatacgaaaattaggcgtggtggcaaatgcctgtaatcccagctccttgggaggctgaggcacgagaattgcttgaacccgggagccggaggttgccgtgagccgagatcgcgccgtcgcattccaatatgcgcgacagagcgagactccatcgcaaaaaaaaaaaagtattgttctctccaagccagaactgatcacctgtctggagcaaggaaaaaaacctctgaccgtgaagagacatgagatgattgccaaacccccagatggaattaaattcacctgtctcggccttccaaaatgctgggataacaggcatgagccaccgcacccagcccagttatttcaacaagtgcatgctcaagagtgtgttgtatcatttctatatagctgtaaatttatcaattatttatattattgttttatactctaattccattttttgtcgtagaaggtaatctatgaaatttcggttttaaaaaatgtgttaagtctttgtttttggcctatcaggtggtttataaagaagaatgttgaatgagctattgagaaggctgtgtatcccgatgttgttgaggagtgttctctataccttcattagaaattattgtttttgactgccttttagtcctctgttcccttactaatatcatcttgttgtattcattattacagaaagtggggtattggaaatatcctactataattatattgctctctctgtgtttattcagttttgttagtatttactttatatatctgaaagcctaatttgagacaccacacacaaatacatgcatgtataaacaaatttgtcatacattcacagggaatgaatctatgtattgttaaatgtccttttttgtctgtttgaagttttgacttaaagtacattttataaaatatgacagttttttacttaagatgtagcttgtgtaatattattttgagctcttctgctctaatttggttaatatttacattaaatttctacttccatctcaccactttcagtctttttttgtcattagatctcaactgactcttgtagaaagtcaagttgaatcttgatttcacagaatttttaataaacctttttattgaaag

SEQ ID NO: 462468 - DNA, 1746 bp, Homo sapiens
  misc_feature (545)..(545): n is a, c, g, or t
ggcatcataaacagaattcgaaaacaaaattcccttatgggatatgccagtagaactgcaagtaactatcctaaatcaacatgctaattggagccttaggcagaaacaagatgggaagaggctaccttttgggttttggactcagaaactgccagaggctggaaaaccttatactcctttcaagaagaaattcttagcttgctattgggctttgctggaaacagaacacctctgcttcaaccatgatgtctttatgagacctgaaattcctactatgacttgggtcatgagttccacacaatctcatcagatagggcacgcccaagaaagtagcatcataaaatggaaatggtacatacaagatcagtctaagccaaaaccaaaggggttatcacttttacatgagggtgtaaaaaacttgacagctcatggccttaatgctccacttaaaagatacagaatagcagaatggataagaatttaataaccaaaaatctgctgtcttccagagactcacccaacacacaaagacacacatgaagttnaggtactgagggggcagagccttaagcataatccaatcagggaggctggtctggaaaccctccaatcaggcaggcagctggagcgaagaggacggctttctggtatggcgcggcctttgtctcttgctgccgctggagctccagatctcttgttcactgctctgtgttctctgctcatagaggcccagcctctgaggccctttgacctgcaggtattgggagatccacagccaagagccaggaccccctagaagtctagaaatggtattgttctctccaagccagaactgatcacctgtctggagcaaggaaaaaaacctctgaccgtgaagagacatgagatgattgccaaacccccagatggaattaaattcacctgtctcggccttccaaaatgctgggataacaggcatgagccaccgcacccagcccagttatttcaacaagtgcatgctcaagagtgtgttgtatcatttctatatagctgtaaatttatcaattatttatattattgttttatactctaattccattttttgtcgtagaaggtaatctatgaaatttcggttttaaaaaatgtgttaagtctttgtttttggcctatcaggtggtttataaagaagaatgttgaatgagctattgagaaggctgtgtatcccgatgttgttgaggagtgttctctataccttcattagaaattattgtttttgactgccttttagtcctctgttcccttactaatatcatcttgttgtattcattattacagaaagtggggtattggaaatatcctactataattatattgctctctctgtgtttattcagttttgttagtatttactttatatatctgaaagcctaatttgagacaccacacacaaatacatgcatgtataaacaaatttgtcatacattcacagggaatgaatctatgtattgttaaatgtccttttttgtctgtttgaagttttgacttaaagtacattttataaaatatgacagttttttacttaagatgtagcttgtgtaatattattttgagctcttctgctctaatttggttaatatttacattaaatttctacttccatctcaccactttcagtctttttttgtcattagatctcaactgactcttgtagaaagtcaagttgaatcttgatttcacagaatttttaataaacctttttattgaaag

SEQ ID NO: 462469 - DNA, 1426 bp, Homo sapiens
  misc_feature (545)..(545): n is a, c, g, or t
ggcatcataaacagaattcgaaaacaaaattcccttatgggatatgccagtagaactgcaagtaactatcctaaatcaacatgctaattggagccttaggcagaaacaagatgggaagaggctaccttttgggttttggactcagaaactgccagaggctggaaaaccttatactcctttcaagaagaaattcttagcttgctattgggctttgctggaaacagaacacctctgcttcaaccatgatgtctttatgagacctgaaattcctactatgacttgggtcatgagttccacacaatctcatcagatagggcacgcccaagaaagtagcatcataaaatggaaatggtacatacaagatcagtctaagccaaaaccaaaggggttatcacttttacatgagggtgtaaaaaacttgacagctcatggccttaatgctccacttaaaagatacagaatagcagaatggataagaatttaataaccaaaaatctgctgtcttccagagactcacccaacacacaaagacacacatgaagttnaggtactgagggggcagagccttaagcataatccaatcagggaggctggtctggaaaccctccaatcaggcaggcagctggagcgaagaggacggctttctggtatggcgcggcctttgtctcttgctgccgctggagctccagatctcttgttcactgctctgtgttctctgctcatagaggcccagcctctgaggccctttgacctgcaggtattgggagatccacagccaagagccaggaccccctagaagtctagaaatgagtctcactctgttgctgaggctggggtgcaatggcatgatctcggctcactgcaaccgctgcctcccgggttcaagcgattcttctgcctcagcctcttgagtagctgggattacaggtattgttctctccaagccagaactgatcacctgtctggagcaaggaaaaaaacctctgaccgtgaagagacatgagatgattgccaaacccccagagatggagtctcgctctgtcacctagactgaagtgcagtggtgcgatctcagctcactgcaacctctgccttttgggttcaagaaattctcctgcttcagcctctctagtaactcggattacaggtgcccgccaaaacgctcagctaattttctgtatttttagtaagatagcgtacattatgttggccaagctggtctcaaactcctgacctcaggtgattgccactggctccaagtgtaggttacggttagcatggactggctggttccttttcggtttgtttcgggggcttttcctttctcgggccctttgttcccccccccgggtctttttgcccccggggtttcaaatttggccagggggggaggggggcccccgggaggcggccggccccggggagg

SEQ ID NO: 462470 - DNA, 2205 bp, Homo sapiens
  misc_feature (545)..(545): n is a, c, g, or t
ggcatcataaacagaattcgaaaacaaaattcccttatgggatatgccagtagaactgcaagtaactatcctaaatcaacatgctaattggagccttaggcagaaacaagatgggaagaggctaccttttgggttttggactcagaaactgccagaggctggaaaaccttatactcctttcaagaagaaattcttagcttgctattgggctttgctggaaacagaacacctctgcttcaaccatgatgtctttatgagacctgaaattcctactatgacttgggtcatgagttccacacaatctcatcagatagggcacgcccaagaaagtagcatcataaaatggaaatggtacatacaagatcagtctaagccaaaaccaaaggggttatcacttttacatgagggtgtaaaaaacttgacagctcatggccttaatgctccacttaaaagatacagaatagcagaatggataagaatttaataaccaaaaatctgctgtcttccagagactcacccaacacacaaagacacacatgaagttnaggtactgagggggcagagccttaagcataatccaatcagggaggctggtctggaaaccctccaatcaggcaggcagctggagcgaagaggacggctttctggtatggcgcggcctttgtctcttgctgccgctggagctccagatctcttgttcactgctctgtgttctctgctcatagaggcccagcctctgaggccctttgacctgcaggtattgggagatccacagccaagagccaggaccccctagaagtctagaaatggtattgttctctccaagccagaactgatcacctgtctggagcaaggaaaaaaacctctgaccgtgaagagacatgagatgattgccaaacccccagagatggagtctcgctctgtcacctagactgaagtgcagtggtgcgatctcagctcactgcaacctctgccttttgggttcaagaaattctcctgcttcagcctctctagtaactcggattacaggtgcccgccaaaacgctcagctaattttctgtatttttagtaagatagcgtacattatgttggccaagctggtctcaaactcctgacctcaggtgatttgcccaccttggcctcccaaagtgctaggattacaggcttaagccactgcacctggcctgtgttacatattttgtatatagatatataaatgaggaacattaataacattttaaaataatgactacatctttgttttccaccaacaaccaacatgggtttcatttttattgcatcatcaacagagttggcattttttaaaaaatatatagtggccattctaatgggtgtgagatgatttcgctgtcattgtgtttttttttcatttctctgcaaatgagtaattttgtgcatcctgtcaaatgtttcttcccatttgtgtagttttttgatgaaagttttgtttgttcatttataaatcaagttattgaactttatggtttagtttttagagttgttgatatatttttaatattaacttttttcacatgtaatttgcaaatatattcacccattttctaaatatgttgtcattctcgaattttcttttgatgtacagaaattttgacatctactatagttaatggtttctattcttgtatttgttgctcatgcatttaatgtcatatctaagaaaatggtgccaagacaatgtcatgtctttttcctgtattttttctgaaagatttgttagttttttgtgtctaagtattttatttaaaatatatttttgtatcattcaagaaaataatccaactttattttatcgatgttgatattcagttttcaacaccattttttgaagagatgatttttctctattttgtactcatggcaaccttttggaagatcatttgatcatatacagaagggttcattccggagctctctattctgttctttcatctgtttatctttgtgtcagtatcacattgtttatgttactgtagcttttaactgtaggttgtattaacatctttgaaaaataaagttttttgacccctgagcaagaatatgttgaagaatgtgtcttatattcacatatttttgaatttgcctgtttggcttgtgcttttaattcctagtttcattcagtttttgttagaaaacacaagagtgtgtaattttagtgttttttaa

SEQ ID NO: 462471 - DNA, 1700 bp, Homo sapiens
  misc_feature (545)..(545): n is a, c, g, or t
ggcatcataaacagaattcgaaaacaaaattcccttatgggatatgccagtagaactgcaagtaactatcctaaatcaacatgctaattggagccttaggcagaaacaagatgggaagaggctaccttttgggttttggactcagaaactgccagaggctggaaaaccttatactcctttcaagaagaaattcttagcttgctattgggctttgctggaaacagaacacctctgcttcaaccatgatgtctttatgagacctgaaattcctactatgacttgggtcatgagttccacacaatctcatcagatagggcacgcccaagaaagtagcatcataaaatggaaatggtacatacaagatcagtctaagccaaaaccaaaggggttatcacttttacatgagggtgtaaaaaacttgacagctcatggccttaatgctccacttaaaagatacagaatagcagaatggataagaatttaataaccaaaaatctgctgtcttccagagactcacccaacacacaaagacacacatgaagttnaggtactgagggggcagagccttaagcataatccaatcagggaggctggtctggaaaccctccaatcaggcaggcagctggagcgaagaggacggctttctggtatggcgcggcctttgtctcttgctgccgctggagctccagatctcttgttcactgctctgtgttctctgctcatagaggcccagcctctgaggccctttgacctgcaggtattgggagatccacagccaagagccaggaccccctagaagtctagaaatgcaagccgaggtacttctatagaagggtgcacccttacagatggagcaatgatggaattaaattcacctgtctcggccttccaaaatgctgggataacaggcatgagccaccgcacccagcccagttatttcaacaagtgcatgctcaagagtgtgttgtatcatttctatatagctgtaaatttatcaattatttatattattgttttatactctaattccattttttgtcgtagaaggtaatctatgaaatttcggttttaaaaaatgtgttaagtctttgtttttggcctatcaggtggtttataaagaagaatgttgaatgagctattgagaaggctgtgtatcccgatgttgttgaggagtgttctctataccttcattagaaattattgtttttgactgccttttagtcctctgttcccttactaatatcatcttgttgtattcattattacagaaagtggggtattggaaatatcctactataattatattgctctctctgtgtttattcagttttgttagtatttactttatatatctgaaagcctaatttgagacaccacacacaaatacatgcatgtataaacaaatttgtcatacattcacagggaatgaatctatgtattgttaaatgtccttttttgtctgtttgaagttttgacttaaagtacattttataaaatatgacagttttttacttaagatgtagcttgtgtaatattattttgagctcttctgctctaatttggttaatatttacattaaatttctacttccatctcaccactttcagtctttttttgtcattagatctcaactgactcttgtagaaagtcaagttgaatcttgatttcacagaatttttaataaacctttttattgaaag

SEQ ID NO: 462472 - DNA, 797 bp, Homo sapiens
aaccacagtcatccattctcatgtacttgttatctcatcagagtattgaaagaagtagaaaatcaattgctttcatccatgaacagaataacaactttttagaactgtcttgttggactcaacaacatgaaagggatgaggaagaagcaggactggcagaagaaaagctgagcttcaatgcaggccccaccaccttgtctgtcctttggatgtccatgacaggggcagcatttgtttctatagtaacgatgatgctccttcacggatctccaatacctcgatgttctaacacagccattcaggataccctgcctttcatcatttttagtcagacaggaaaaactgaagggattctttttaacaaaggtgtatctcagaacagaatcaacgttacatgttttcttggccctgttaagtatgctgtacatctggaggcattgcttttaaagtagagcatggctttgcaatacaagattaacattcttcccaaagtctatacggcattgcgaatatcatacattagtaggccccacaaaatctgcatctgttcctgctgctcaagatcaaaaacttttgaatgccagggaaacgtcttattaagtccagactgcttgactcaacactaccacagcacactgccttaaggacaatatccttaaaagagaaattatgctttatggagagcttgttgtatgctggaaactggaccgagctctggccatgccttatactttcttttaacttattgttctgccctttgaattcaataaataaatacctcattcaaaaatgtattt

SEQ ID NO: 462473 - DNA, 1253 bp, Homo sapiens
ggaaacctccacgccattggctgccgaaagaggtccctgtcgcccattgggccggccaggcgaggatctcagccagtgggtgctgaggcacgagaacttcttcgcagccttgggcctgacttggatccactgtctcagatataagaggagcgggtccttctacagggaagagaccacagttctccaggaagccacgatatttcctcggggtgcattgtacgaccctccaacggttgctatggcaggaaaaaacttgagctctggaaaccgtggctgaccccaggcaacagggaccagttcctccttgtgtggttaccaggacacccccaacaccaggtcctaaccccggatttgtagccccacagccagctttgagattctgtgaatccgtgactcttggatccggcatctaagggacaccaatccatgagggatttgacatgactggggactgcacgccagtgctggtgctgatggccgcagtgctgaccgtgactggagcagttcctgtcgccaggctccacggggctctcccggatgcaaggggctgccacatagcccagttcaagtccctgtctccacaggagctgcaggcctttaagagggccaaagatgccttagaagagtcgcttctgctgaaggactgcaggtgccactcccgcctcttccccaggacctgggacctgaggcagctgcaggtgagggagcgccccatggctttggaggctgagctggccctgacgctgaaggttctggaggccaccgctgacactgacccagccctggtggacgtcttggaccagccccttcacaccctgcaccatatcctctcccagttccgggcctgtatccagcctcagcccacggcagggcccaggacccggggccgcctccaccattggctgtaccggctccaggaggccccaaaaaaggagtcccctggctgcctcgaggcctctgtcaccttcaacctcttccgcctcctcacgcgagacctgaattgtgttgccagtggggacctgtgtgtctgaccctcccaccagtcatgcaacctgagattttatttataaattagccacttgtcttaatttattgccacccagtcgctatttatgtatttgtgtgtgtaaatccaactcacctccaggaaaatgtttatttttctactttttataacccttgttgaaataaacaaaggaaaagacactcatgacgttggactgtgtgtctgttggtgtgtatttcctttgtgt

SEQ ID NO: 462474 - DNA, 1328 bp, Homo sapiens
actaaaaagcaaacaaacaaacaaacaaacaaaccctgaagctggaaaccatcattctcagcaaactaacataggaacagaaaactaaacaccacatgttctcactcataagtgggagatgaacaatgagaacacatggacacaaggaggggaacatcacacaccagggcgtgtcggggggacagaaagctccgcaccggagatcctccggtccctgcaccacctgctgtgtgccttcattaggctctgctacctggaaaactgatgggagggaggcattgagtacaagagctctgctcggtgaagcatttcagaactgctgcttgcacactgtccaggcattttacaccatcaattgtgcgagctcccacttattgccactaattgctgcagagagaacgatgctgaccacggcagagcagctactaaaccaaggaagaacattcctgccacttcagttcaacagccatctgaagcccacctgtgagctggtccaggaaatgatggactctgatttccacacccctttcctgtgaacttgtctccaatttagtctgtcaaggtccctttcttgtgagttaatttctccctagtgctacttctcagattggccagtgactcacagagtggcacaagtacaaatccagcctgccttgcatccaacacagattccaggaccactgaaaccagctgaggcatcctgaaagcctaagattgaccacaccagaggaaccagactgcccttcacaaggatggaaattatctggttccacccctggatatgatcaaccttcatagactgtgcattatacatgccatctctgcgacctgcaaagatgaaaagggaaagcaggagatggaaactggtcagcagccttctggtttatcagccacacttacaaaggtcaaatgtgcaaagcgtcagaagacagtggttagagtgagattctacatgctctcaatgaagaataaagcatgcaggaagaacctttcaaaaggttacaaccagagacctgaaggaagcaaggaagaaagccacatggttgtcaaagagaagaggaaaggagatcactaagctggatgacgttttctgtttctttgaaaacagagaagatgacaagttagggagagatcagaggtcatactgtgaagcacctttggataaacggcagggactttggattttctttttgaatataagcataatccattgaaaggtctcatgcagggaagtggcaaaacacttttaaaatttttcatcttttctttctgaagcagagttcactctccatttatttgtcttctttgatatctctcaatagaatgtt

SEQ ID NO: 462475 - DNA, 868 bp, Homo sapiens
actaaaaagcaaacaaacaaacaaacaaacaaaccctgaagctggaaaccatcattctcagcaaactaacataggaacagaaaactaaacaccacatgttctcactcataagtgggagatgaacaatgagaacacatggacacaaggaggggaacatcacacaccagggcgtgtcggggggacagaaagctccgcaccggagatcctccggtccctgcaccacctgctgtgtgccttcattaggctctgctacctggaaaactgatgggagggaggcattgagtacaagagctctgctcggtgaagcatttcagaactgctgcttgcacactgtccaggcattttacaccatcaattgtgcgagctcccacttattgccactaattgctgcagagagaacgatgctgaccacggcagagcagctactaaaccaaggaagaacattcctgccacttcagttcaacagccatctgaagcccacctgtgagctggtccaggaaatgatggactctgatttccacacccctttcctgtgaacttgtctccaatttagtctgtcaaggtccctttcttgtgagttaatttctccctagtgctacttctcagattggccagtgactcacagagtggcacaagtacaaatccagcctgccttgcatccaacacagattccaggaccactgaaaccagctgaggcatcctgaaagcctaagattgaccacaccagaggaaccagactgcccttcacaaggggaagactcctgaacttgcctcacccaaagatatgatgtacgcttcagacaatgctggactgatgtgttcaattaaacaaatgcaccaataaaatgctgcatgtaaaaagagtaaa

SEQ ID NO: 462476 - DNA, 3345 bp, Homo sapiens
gaggagagaaaccaaggagagttggcttaggttgtagcaggacagcgcccagtgagaaagcagaaggaccttggacagggggagctggcaaatgccctgtgggcaggtccccaagtcaactggagcggactcccttattctctgccccaaagatccttggacttttacatctattcgcatgttcattaactcccaagaacgccagttggctgacatgtccctgttcattgcagattcctggctctgttactctgggatcatctgctggaagtctctggagcaccaggcctggattgcagggaggaacaaaaaccaacatcctgcctttgtgaagtcacaagatgatgccttaaaaccaacaaatacttttcaacctgggcgtccccacacacgatcatgtccagaggggtgcaagtctcagctgtgtctacatggaaggaaaagggggaaacatctggatgaaagccagcaacgtcctgccactctgccagatgctgcccacatctggacattcaaaaagtgatctgttcggtggcttagcagtcgagaagcaaatggtcagcccacatcaccctatccatcagaacacagagcccgagtccctatgcacaattacccagattactgaaggactcataagactctcacggggactcagctccggcccagccatggctcagaagccttgagtacccagcccaggccactgactgatgaacgcaggtgagggtaccgcccttcacttctggcctgtctggcagaggaatttacattcttttgaaacccatcatataaacaggtttctcgacaagaaaatatttattgaatgacagtaaccaaaacaatacagggtacttggcaaaatgggggtttttgcttcattcagatcaaaatctgatcccagcttggcctcttctcgctgtgtgaccttgggcaagtctcttcacttctctgaactttgtttttcccacacattaagtgaggatgacaattcatgtgacatgagatggtggcaaggcttaagtgagacagtccatgtaaatgcttagcacctggcacatagtaggtatttaacacatggcagctatgattggttgtattgttattgtcaaccatcactactaccaccccaccattttggggtgcctacttttattgctggcagtgggctgactgatggcccttagggacaccacctccttgctcagcatctcatttggctcatctgtgaaggctatttttgccatccccagctcatagggctatgaaaagaggctgcttagccacatggtggtgatggccatcttccctcttggcatcagagcctggccagcaaccaactgcccatgggcagtctacttgcttgggtccaaggacatgaggctgattgcaaagcccctactcactgggcaggacctctaaagctgctctcagctgttcccttctctgtggccatttacaaccagcccagtgtctgccacttgggaggaaggaccttaactcagacaattccatccaccgcctttgaggactaggggaataggggatggggaggatggggagacgagggaagtatgtctatactagcagagaaaggggcttaaaccatccaaggacctggcgatcatgagatccaggtttaaatcttctattcattcatttgtccattcattcattcattcaccacacatctaccagcagaaccagtggtatatgcagaggatatatagacagtagaagtaatgcctgccccaatgaagattgcacttcagcagtatgacctcaagaaaattacttgacatctctggtcctattaaggaaatcatctaaacatccctcactcagggaacaggatgacttcactagtggtgggtgctctaaggaaggggaaaggtagggtaatctttggggttagaatcacaattttcaatcccacccacactcaagagactcactagagagtcaatgttccagattattagggccagaaagtgaccctacaggtcacctcaggcagtcctttaacagacgggaaacctgaagctcagagaagggaagtagtttgcccaagggcaaactgggagtctgtggttaagctcggactaggatccaggtcccctcacttccagtccagtgctccttccaccacaccatgctgggactactcttctttcaacccagtttctggatttgaaggacaacagcaggagaggtgtcaaagggcaagccaggtcatggctaccagatctcatggctagccagatctcgaggggggttccagaatgcttcacccaaagttcttggccccttggagagatcactggggctctgtggcatctggccctagaaaacttcctggggaggggaacagaagctgctgaggccacggtggagggtcgtcagatttccaaagagagagtaacggggacatggaacctgcagtgaagaaggcaagtctgagagaatggagtcagctccccctaagggtcagctgtgcccacatcccagcaaagactgggtcagacccagcctaaggaaagttggggagagaagtgaagacagtggggaaggatgactggaaagaccaaaaaaagagggtgcatgtgcgtgtgtgtgtgtgtatgtgtgtgagagagagagagagagagagagagaaacctgggggagggaacagagcagggaaacagagggtacaagcaaagaatgcggaccctgattgtacatgtgtgtgtctggactaaggttagagaaagaggagtgagtattgaggtagagagccaagcaaaatggaccctgggctgaaaatggagattctgtaaggcacctgtccaggctgggcttctgcctggagcttccaccgagccacagcctcctccctccctccagaagatcccctggtcccctggcaggtgtagtagtaggaggtggggagggggtgtttgctctaaatccccatgcttcgcccataggagcaggacagtgtgtgtgtgtgtgtgtgtgtgtgtgtgtgtgtgtgcacgcgcgcgctgggggtggaagtgtgtctgtgcttgggagtctgagtggctttgtgagtcactgggcatcggtgagaacaccaggtggtgggctctggaatctggggcttagtcagtgagtccggagacagcaacctcgagtgcagagcgggggcgaagatgctgcccaggtccacgaacgtgtgtgcttgtgagatctgtccgcccacgtgcgtgtgaaccgtgggtctgcgtggattgtgtgcgcctgaggattgtgggtgggtgtgtacttgcgcgagtgtatgtgtgtggactgttttccagtggtctgtagatatgtgtgtgc

SEQ ID NO: 462477 - DNA, 1238 bp, Homo sapiens
ccccctttgccacccacagtcccctcctgtcccctaggggggcaggaatgaggggctcgagggagactgggaggtcgcgatgctgagttccacgagggtggggccgggccggggccggtggggccgggatggccggatgccgaggccacgggtggggcaagcccgtggctccctcctccctcgggagctgttggacctgttgtcccccctccacttccgggctgctggggagggggaccgggcggcctctctcctccctcttcccctgccacctgtctcataggcagaagcggccgtgcccagcgcgcagagcggagcgcgccgaagcctgagctggtgagggggccgaggctgtggggaggtggcagttggacttcggaatctcaaggactccgactcctggcttgttcagagaaggagagccccgactcctggatccctgggagtcccagcggccatggggacgcgaagcagccccgaggaggggaccccgccgccgctggtcccggaatgcgacgtggaggtccagccccagggccatcccgaggagtcccgggaacaggaggcatccgaagtcctggcggaaccttcgagccgcgggggagctgagcagcaggcagaggaagaagaagtgggagaaggcagcagcactgagagcagccgcgacgcgcccgaggctacgcctccgatagctatggcggccacacctcccgcatccacctcttcgcgggaaggggtgcgaggggcggcgcggcgcctgcaaggacagcagctggaggcattgactcgtgtggccctgatggagcagcgagtgaaggagctacagcgccagaggaaggagctgaggatcgagatggaggtggaggtggccttgctgcggggtgagctggctggggagcgagtggccgctcgccgggaggaggagcagctgcgggagctgctggagcagcaggcggcctcggagcagcgcggccgccagcagcgggaacaggtctgtttggctcaccgggtcttcatcagcagtgtccttcctggtccatggatgttggtgtgctcctagccacctgcgccccggggttgtccccattccccaaaggaagacatttgggctcctgagagagtgaggggcagatgcccctcctggttttccttctccctccctgggcgagatttttggggctcttcctttgtcccctgtccgtttgctatttaaatgtgggtgtgtaaaaacttccaaa

SEQ ID NO: 462478 - DNA, 1696 bp, Homo sapiens
ccccctttgccacccacagtcccctcctgtcccctaggggggcaggaatgaggggctcgagggagactgggaggtcgcgatgctgagttccacgagggtggggccgggccggggccggtggggccgggatggccggatgccgaggccacgggtggggcaagcccgtggctccctcctccctcgggagctgttggacctgttgtcccccctccacttccgggctgctggggagggggaccgggcggcctctctcctccctcttcccctgccacctgtctcataggcagaagcggccgtgcccagcgcgcagagcggagcgcgccgaagcctgagctggtgagggggccgaggctgtggggaggtggcagttggacttcggaatctcaaggactccgactcctggcttgttcagagaaggagagccccgactcctggatccctgggtgaggcggcgtgggcacggttgccctgcacagtggggtcgggactaagactacggggctccgggaaggatggggcgggagccgaactgctgagtctcggagggagaagatgggtcgctctaagcgaatccaagagattgtagggggctgctgggagggtacaaggcctgacacctagagatgagggaggggaggcggggtcgaagaggtcagtagggggcgtgctacgacccggactcaaattccggtcccgtctccggtggcgtgtcgccttggagccatcaagccccgcctctggaaacttcaggacacgcctccgtaacgctcagttccatcctttgaactcttaggccccgcctccttggggggggggtctccgcgccccgtagcagacgcgagcggcgctcagccgtccttagggcccggccccggagcttctggtcccgcccaccccgcaggagtcccagcggccatggggacgcgaagcagccccgaggaggggaccccgccgccgctggtcccggaatgcgacgtggaggtccagccccagggccatcccgaggagtcccgggaacaggaggcatccgaagtcctggcggaaccttcgagccgcgggggagctgagcagcaggcagaggaagaagaagtgggagaaggcagcagcactgagagcagccgcgacgcgcccgaggctacgcctccgatagctatggcggccacacctcccgcatccacctcttcgcgggaaggggtgcgaggggcggcgcggcgcctgcaaggacagcagctggaggcattgactcgtgtggccctgatggagcagcgagtgaaggagctacagcgccagaggaaggagctgaggatcgagatggaggtggaggtggccttgctgcggggtgagctggctggggagcgagtggccgctcgccgggaggaggagcagctgcgggagctgctggagcagcaggcggcctcggagcagcgcggccgccagcagcgggaacaggtctgtttggctcaccgggtcttcatcagcagtgtccttcctggtccatggatgttggtgtgctcctagccacctgcgccccggggttgtccccattccccaaaggaagacatttgggctcctgagagagtgaggggcagatgcccctcctggttttccttctccctccctgggcgagatttttggggctcttcctttgtcccctgtccgtttgctatttaaatgtgggtgtgtaaaaacttccaaa

SEQ ID NO: 462479 - DNA, 1128 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
tgntnngnttncaggtggagccaatggagggtcctggtgcgggggagtcggcgttggcgggtgattgatggtttaatatctcgcgctgcgacccgggcccctcctcgcccacgcctctgcgggcggcccccagtgagaggtggtgtgtcgggagtttgttccttctgatgttcggatgtgtttggaatttcttctttctggcgggctggtggtcccgctggcttcggcagtgaagctgcagaccttcacggcgagtgttgcagctcttaaggcagcacacataaaggttctccaagtcccactggactcaggagtccagctggcttcacatagtggatcccgcaccagggcagcaggtggagctgcctgccagtcccgcgctgtgcgcccgcacttctcagctcttgggtggtcggtgggacccggcgccgcggagcagggggcggcgctggtaggggaggctcaggccgcacaagaggccatggccgagaattcgagcacagcgccgggacccggcgaaccctccgcagctgctggcccgggtgccaagcccctcactgcccagggccggcagcgccagcctgctgctccgagtgcggggccacggagcccacacccacctggaactcacgctggcctgcaagtgcagcgggcagccctggtttccaccagtccgcacctccccacaagctgagggagctggctccggcctcagccaacccagagaggggcttcatgtccattttgggtcgttgcaaggaggttctgctcatcatagtctccgatggaacagccacattctggaacattatgaaacattgcttgctgtcacgctggaaggaagaaaggcaagagcaggaaatatctggccaacagaacgaatggcctccaactaacagcatcttgtgaaaataaaatgagttaatgaaagttaactcacttaagacagcacctggtatatagaatgtggcaggcatgtgccacgtatatgccaggtgtgcaccaggtatgtgctgtgtgccaggtatacaccaggtgtgcaccaggaatgtgcaaccactgaggcacaggtcagggcacactggtgcctggttctgaactctgaccacactcatgtctggtcatagc

SEQ ID NO: 462480 - DNA, 796 bp, Homo sapiens
gttgagttgccttttgagtgttaaggatctgtcagagaaccgttgactgtgagggggaagcttgccccagtcctcagaacctgtgaatacaatgctttgcatggcaaaggggactttgcagatgtgattaagttaagggtcttgagatgggaggattagcctggataatccaggtgggccctgtataatcacagcggtccttatttgagggaggcaggagggccggggttagagaagatgggatgagagaagtgatgtgcttgctggccatgggccaaggaattctcgcagcctctggacgctggaaaagatgaggaagtggatttgtccccagagcctccagaaggaaggcatccctgccggcaccatgacttcagcccagccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccagatggagaagtgtaggggagcaagagatgtgggggtggaattgagaactcagaggctaatgtgtgctgagcaccgactctctgccctaccctgggccatggcctgagcatgtgttgtcttcttacaaccctaacaggtcctcgagaggttgcagcaaagaggatttgaaatcgtgggctcctgtgggggaggagtagactcgtcccagttcagc

SEQ ID NO: 462481 - DNA, 2507 bp, Homo sapiens
tagaaaagtttgaaaaaaaagaggctgaacggtcggaattcccgggatgagggagggggcgacgggcggcctctcggggaaaggcgagagcaggctcccgctgacagcagggctcagagatggggtcccctctgataattctgtaatcatcctctgttgaaaataaaggtctacaaagtgtccgttaccctggagctgtacaagtcacacacagctccattggagagaaaactggatggaaccatttgactgaaaatccatgtcaaaaggccaacaagaaagagctgagacactgcagaaagagcaggaataaataagaggtgaagacagacagagaccagacaaggaggactcaattacagactgacagaagactcaaggaagaaaatgaagctggacctgtgaagaactgtcgaaacagctgtagaggaattgtggtggaggcagtaatggctcctttagtagcagagaatagaaagatctcgaaaataaagcctattgtcaggagacttgcacccatcctggcctacttccaagtagaaacaaaaacagaaacgaagatatccatgatacctaatgttacaaggagaagaaagcacttgtaatcacaagggtactgagaaaaggtaacagacacatttatatatgtggaaccaggaatctttctgatgactttcagaaagggtggacatacaaataaaaatcaaccttcttcttggtgaggatttgaccctggttccatattaacccaagagctgataagcacaaacctggagtccagtttttatgcaaatataacaactctgcttataccttgaattacttgtatgaagcggggaaaattttttactctctctgaacccataattaaaaaaaatctgtatgacttggataataaacccacttcctagaatttttatgaatatgaaatattgtgtgaactacctaatttggctcttttctatatatctttcttcgtttcaattcatgatattaatttttggcctagtattgtaattgggaaagcaaatcatagaggaaactctgattatgtttcaccctaaatcacaggtaataataaagaatatcaacaggtacacttcaactatggtagatttaaaaaagcatagaactattattactaatatcagctgtgtctagtgattgatgtcttaataaatatcaaatatccagccttgatccaggatattttatcaaaagcatatttgaattttggcaagtaattaatgcaaataaaaaattaaagggctgattgattcagatttcaaagatatgactctatttgctagtgaagaaatgacccaagttaacagattgttatgataatgctaaatatttattacattttaataaatttaccatacactctgagcacttcaaaaagtgattctttgttagatgaatttgagttgtttacagatataaaaagtagacaaaaaagcctaccttgcatttctataaaatcaaaatccagaattttcataaacttgaattatctttcccaacagttagatggaattaatgaggtttcactgaatttctaaactcttttttacttaccaacagatgtgtacaaatgtctcttttggaggaatgtaaaccatcatggtctcaggaaactgggccatgattgagacatttcaaggaaaacaaagtgttgaagaacagctgactgcataactaagaaatcaatcattgctcaggatgctttattggcataattggcaatgatttatagaatgatggcaagagtccaattgggcatgtgtatccttaatatccttagcactctggcatggaatctttgttaagacaacataattggactggggaagaagtttcagaggtacctatttaaattagttaataaccaagaaaaaaaattcctattaatttgtctaatagtgtgaacatttgtgagattttaatggaatctggaagcaaagttgtgctcaaagcaaatacatctgaaaatatctctcaaacagttgtgtaatatctagtgttttgcatataactagtgtgatattgctttattaatcaatattgttacataaaaaagttgtgtacagaaaatacgtctgttgaatcctgaggacacgaaaaggggaatagaggcagtgagtgtgaaattggccaactgatagattcagttcatttaaaaggagtaatgtaaggtttatctactgcattgcatcttgtaacttacttgttaaatttattcaggaaagatggctttagtgatttttctggaaactaactagtgggttgtgagagataattaacaaaacttcctgtttcttctcttggaacagatggatatttttgaaatgcagcagaacactgagctcagtttgagggcatgcatagttgagttgcttctatttgtataatgaggagctacttgcttgtattccagaggtctacagacttatctgcagagttgtaccactcatttccagggaactaagctgctaaatgcagcc

SEQ ID NO: 462482 - DNA, 3135 bp, Homo sapiens
catctctccttctactctccttatatctcacctcctttgaaactttcaaaaagaggagccaatgttaatagccaagacaatgggaaaaatgtctccagggtatttcagagatcttcacagcagaccctctcatcacaggcctggaggcctgggaaggaaaaatagtttttttgcaccaggaccaagaccctactgctctgtgcaaccttgggacatggtgtcatgtgtcccagcagttccagctccagctgtggataaaagggcccaaggtacagctcaggctgttgcttcagagggtgcaagacccaagcctttgtggcttccaggtggtgttgggcctggcaatgcgagggaaaatgtggggttggagtccccacacagagtccccactggggcactgcctagtggagctatgaaaagagggtcactgcccttcagaccccagaatcatagatcaactgacagcttgcactatgcacctggaaaagctgcaggctttcaatgccagcttgtgaaagcagttgtggggctgtacactgcagaaccacagggactgagctgcctatggccctgggagcccactccttgcatcagtgtgccctgggtcctttctccagatatctatgttgtccatctccctgttcattcaggactctgttcaaatgatactccttcccggcaagcctatcacaaaaggaaccttctgctcataaattgaagtttaacttcattttttctggttttgttctttcaaaaacgaagataattctgtaatcatcctctgttgaaaataaaggtctacaaagtgtccgttaccctggagctgtacaagtcacacacagctccattggagagaaaactggatggaaccatttgactgaaaatccatgtcaaaaggccaacaagaaagagctgagacactgcagaaagagcaggaataaataagaggtgaagacagacagagaccagacaaggaggactcaattacagactgacagaagactcaaggaagaaaatgaagctggacctgtgaagaactgtcgaaacagctgtagaggaattgtggtggaggcagtaatggctcctttagtagcagagaatagaaagatctcgaaaataaagcctattgtcaggagacttgcacccatcctggcctacttccaagtagaaacaaaaacagaaacgaagatatccatgatacctaatgttacaaggagaagaaagcacttgtaatcacaagggtactgagaaaaggtaacagacacatttatatatgtggaaccaggaatctttctgatgactttcagaaagggtggacatacaaataaaaatcaaccttcttcttggtgaggatttgaccctggttccatattaacccaagagctgataagcacaaacctggagtccagtttttatgcaaatataacaactctgcttataccttgaattacttgtatgaagcggggaaaattttttactctctctgaacccataattaaaaaaaatctgtatgacttggataataaacccacttcctagaatttttatgaatatgaaatattgtgtgaactacctaatttggctcttttctatatatctttcttcgtttcaattcatgatattaatttttggcctagtattgtaattgggaaagcaaatcatagaggaaactctgattatgtttcaccctaaatcacaggtaataataaagaatatcaacaggtacacttcaactatggtagatttaaaaaagcatagaactattattactaatatcagctgtgtctagtgattgatgtcttaataaatatcaaatatccagccttgatccaggatattttatcaaaagcatatttgaattttggcaagtaattaatgcaaataaaaaattaaagggctgattgattcagatttcaaagatatgactctatttgctagtgaagaaatgacccaagttaacagattgttatgataatgctaaatatttattacattttaataaatttaccatacactctgagcacttcaaaaagtgattctttgttagatgaatttgagttgtttacagatataaaaagtagacaaaaaagcctaccttgcatttctataaaatcaaaatccagaattttcataaacttgaattatctttcccaacagttagatggaattaatgaggtttcactgaatttctaaactcttttttacttaccaacagatgtgtacaaatgtctcttttggaggaatgtaaaccatcatggtctcaggaaactgggccatgattgagacatttcaaggaaaacaaagtgttgaagaacagctgactgcataactaagaaatcaatcattgctcaggatgctttattggcataattggcaatgatttatagaatgatggcaagagtccaattgggcatgtgtatccttaatatccttagcactctggcatggaatctttgttaagacaacataattggactggggaagaagtttcagaggtacctatttaaattagttaataaccaagaaaaaaaattcctattaatttgtctaatagtgtgaacatttgtgagattttaatggaatctggaagcaaagttgtgctcaaagcaaatacatctgaaaatatctctcaaacagttgtgtaatatctagtgttttgcatataactagtgtgatattgctttattaatcaatattgttacataaaaaagttgtgtacagaaaatacgtctgttgaatcctgaggacacgaaaaggggaatagaggcagtgagtgtgaaattggccaactgatagattcagttcatttaaaaggagtaatgtaaggtttatctactgcattgcatcttgtaacttacttgttaaatttattcaggaaagatggctttagtgatttttctggaaactaactagtgggttgtgagagataattaacaaaacttcctgtttcttctcttggaacagatggatatttttgaaatgcagcagaacactgagctcagtttgagggcatgcatagttgagttgcttctatttgtataatgaggagctacttgcttgtattccagaggtctacagacttatctgcagagttgtaccactcatttccagggaactaagctgctaaatgcagcc

SEQ ID NO: 462483 - DNA, 1546 bp, Homo sapiens
ttcacactttaaagtgaaagcaagtttactaagcaagtaaaggaacaaggcagggtgcagtggctcacgcctgtaatcccagcacattgagagaggctgaggaatacaggcatgagccacagagcccagccaaaactacattttaaaaataattttttatcattacacactccactagaaaccatttaacccaatttatggacttacatttcttccattgaagaacttgaaggatccaaaaatcgaggtgacattctcagatttgtgtggcaaaaaaagaatagaaaaataacagatgcaaagaatgtgttccaccaatatgtggaggatcccttttattttaagttcagggaaagcattggaatgatacaagaaaataaactgaaattgtataatgtggaaacaagagctctgttgctaatatgcaagtttatcactgagattttaacaacacaacatgctaattataccttaaaatatgtttctcccagtctgggcaacatggcgaaaccccatctctacaaaaaaatccaaaaattagctaggtatgctggtgtgcacctgtagtcccagctacttgggaggctgagagaagaggatcacctgagtccaggaggtggaggttgcagtgagctgagatcgcaccactgcactccagcctgggtgactgagcgagaccctgtctcgaaatattacaatatgtgacagcgcagcttccatcagaaataatttgttcctcttttgcccacacaaaatattcacctccacttcctctaacatttttttttaaaaaaaaaagcccaaacataactttcagttgcaagcaaggatctcatgacagtctcatgacacttctgttcactgagagcccaatagagtcctcgtcactcacgacatttcatggtggaacagaaaaataaaacctgaattaaccctcacattcagaaaagggaaacaaagaaggtactacccagtaggtccatagcaaatgtgcaattttgctgagaagatgagttagggcctggttccaggaggtcaggaatgaataacagtacttttcatggctacagttctcctgagaataggtttccagtccactatattttgtcgttcttaacttcacccgatgacatccctcatgcagtatcagaaagtatgccctccttctgcagcaggtggatcacaagatcaggagttcaagaccagcctggccaagatggtgaactctgtctctattaaaaatacaaaaagtagccgggcatggtggcgggcacctgtaatcccagctactcaggaggctgagacagagaattgcttgaacctaggaggccgaggttgcagtgaactgacattgtgccactgcactccagcctgggcaacagagagagactctgtctcaaaaaaaaaaaaaagaatccttcttctagtacacagatgcattttaaaggggtcttctctactgctttttctctcaaaatcaatttcagtttggcctgtctgttcacatttacatgaggatccaaattgttgttttcataggtaaatg

SEQ ID NO: 462484 - DNA, 540 bp, Homo sapiens
ttcacactttaaagtgaaagcaagtttactaagcaagtaaaggaacaaggcagggtgcagtggctcacgcctgtaatcccagcacattgagagaggctgaggtgggcagattgcttgaacccaggagttcaagagcaacctgggcaacattacaaaactctatctctacaaaaaatacaaaaattagccaagggtaatggtgtgcaccagtagtccaagctagttggaaggctgaggttggaaattgcttgagcctgggagaatttttttttttgaggcagtgtctggctccggtcacccaagcagtagtgcagtaatgccatctcggctcagactctaattcaacacggaatgttgagcttctgagcgtgatatagcggaagtgccttctcttccggtctctctggtcttggccgcagaagccagatgacgaagggaacgtcattgtttggaaagcgtcgcaataagacgcacacgttgtgttgccgccgtggctctaaggcctaccaccttcagaagtcgacctgtggcaaatgtggc

SEQ ID NO: 462485 - DNA, 2169 bp, Homo sapiens
tgcctgtgcctgtttattacacgagtatattgcatactggctccaacttgcttctgctttgccatatggtaacacgccgtattatggaagcaccatcattaccgccatttgcaggggaagcctaaagagataaatgccagccagcatccctgtctctggggccctggagaggccttcaacacacctggcctcactgccctgtggcttcaacaaagaggccgagcatctcctataaaccttgaggtccatggatgacatagcggaatgatggatttcagaaaaggcaggtgcttcccactctttaaatttttgtttattctttccaagtttcccatcaacagccctgcagtaaaaattcagggcttcagagacaaatatttcatgagtacagactgtgatgaggaaaagcaagccattccctctctatcaggatccagagcacactgctgttacgactccagaaccgataaggaagctatgtgtggaagtatgagctcaggtcgccttctgaccctctgtgacggtctatttcaggcagttatggatagataacattacagacactggtaattaaaacaacactaattttgtctctgtggtcacgctttgttgttagaagccatctatcatggccttcacgcatcacgcaatgagaagacatttgtctacgtacattgtgcttggtcaacggttttacggatttccccgcgtacctggacacccaggcacttttaaagacgtactgccttcatttctactctattactctgattaataaaacattttgcatgcttcatcaaaacaccctgcaagcttttcaccacatatattcatggggggggaagcaatgttaatttctttcccttttagaaagaaactaacaacaacaacaacaaaagaaattctcttttggattggaagagagaaagaaaaattcaaatatggaaatatttgtcttccctgtaaaacagagtccagcctaatgaaaagcataatattaaaacacacacacaatgccaagcatctcctttaaggctacacgtatttttgactatatctgctgtaagcagtcggctgctgtcattaagcaaaaaggccaagacaatgtgagtttatctggtcctacctgcatttctactcatcgttggactgaaacaaatgggaaagaaaaacttactgacttttggcgaactacaaagactatttggatccagcgtttgcttcgaattccgggcaatacgcttaaaacaaattacctgtttgtcttggatggcctttgcaatgagaaccctaggcctgcaagacctctgagattcattgacctcaccagcccacccacaaagaaagatacgtggatactccctgtattgcccagtcctggctacaatggcagggaggagcaggcaaacagcctccccgtcaaagatgttacaatctggtcaatgtacactggggtaggacacgtggggagtcaaatatacatcaatttctggcaacacacggcaagaaaacacagatgcccaaaaggacatcaactcaagatttccagtaaaaccaaacccagcttgggtcagatgcacctttccagcaaccaccatctcagcaacaacctgccagctgtcaactggaagttcagcttctgggaacttcagcccccttctcagaggagcaaggtcctagcaccaacagcacctgcagtggagcccaagtatggctgcttcatggagaaggcaggtaaagaggggtgtgcacactgtctcagggtggcaactcttattgataacgaaggcattgtggccttctgacgggtactgctgcccactgacaggtgaaagcattttgttgggttttttttttttcaaattgctattgctatatataaatgtaacgtatagcaataaccgtagaaagatactgtgcccttgtgtatggataattaaaataggaacatctctggactaaattaaaatgtgtaaaaaccaaatccttatagcatccatgaaattacagaagctacaagtgaatcactagcccagggacgaagcatttctctcattacttcatgaacctcttccatgatcacagttttacattttcacaaatctacatggttctttttatgtcactaaatatctcagctcacttttactgccctccttatagacatgc

SEQ ID NO: 462486 - DNA, 645 bp, Homo sapiens
cggcacgagggccatttgcaggggaagcctaaagaggctgataaaatgactagctacacaggacccagagggatgtgccgctccacctggttcccgccgcatcttcccccgaggagccactagtcccttcctcctggaacagataaatgccagccagcatccctgtctctggggccctggagaggccttcaacacacctggcctcactgccctgtggcttcaacaaagaggccgagcatctcctataaaccttgaggtccatggatgacatagcggaatgatggatttcagaaaagacacaatgaacaaaaaccagagcttttgaatacagatttccagtaaaaccaaacccagcttgggtcagatgcacctttccagcaaccaccatctcagcaacaacctgccagctgtcaactggaagttcagcttctgggaacttcagcccccttctcagaggagcaaggtcctagcaccaacagcacctgcagtggagcccaagtatggctgcttcatggagaaggcaggtatctgtttgcgtgcaaatccgtgagtgcttgcatctcgtgtatttgaaaatcctgtttaagaatgcagaggtccatatagtgtcattaaaacaaatgagtataaccctttggtcatcta

SEQ ID NO: 462487 - DNA, 434 bp, Homo sapiens
cagtcttcatttctcagcggaaaagccactcccttgagactctccaggcaccccccaaccgcattttttatcaagtgtctaaaagacacaatgaacaaaaaccagagcttttgaatacagatttccagtaaaaccaaacccagcttgggtcagatgcacctttccagcaaccaccatctcagcaacaacctgccagctgtcaactggaagttcagcttctgggaacttcagcccccttctcagaggagcaaggtcctagcaccaacagcacctgcagtggagcccaagtatggctgcttcatggagaaggcaggtatctgtttgcgtgcaaatccgtgagtgcttgcatctcgtgtatttgaaaatcctgtttaagaatgcagaggtccatatagtgtcattaaaacaaatgagtataaccctttggtcatcta

SEQ ID NO: 462488 - DNA, 2013 bp, Homo sapiens
tgcctgtgcctgtttattacacgagtatattgcatactggctccaacttgcttctgctttgccatatggtaacacgccgtattatggaagcaccatcattaccgccatttgcaggggaagcctaaagagataaatgccagccagcatccctgtctctggggccctggagaggccttcaacacacctggcctcactgccctgtggcttcaacaaagaggccgagcatctcctataaaccttgaggtccatggatgacatagcggaatgatggatttcagaaaagcacactgctgttacgactccagaaccgataaggaagctatgtgtggaagtatgagctcaggtcgccttctgaccctctgtgacggtctatttcaggcagttatggatagataacattacagacactggtaattaaaacaacactaattttgtctctgtggtcacgctttgttgttagaagccatctatcatggccttcacgcatcacgcaatgagaagacatttgtctacgtacattgtgcttggtcaacggttttacggatttccccgcgtacctggacacccaggcacttttaaagacgtactgccttcatttctactctattactctgattaataaaacattttgcatgcttcatcaaaacaccctgcaagcttttcaccacatatattcatggggggggaagcaatgttaatttctttcccttttagaaagaaactaacaacaacaacaacaaaagaaattctcttttggattggaagagagaaagaaaaattcaaatatggaaatatttgtcttccctgtaaaacagagtccagcctaatgaaaagcataatattaaaacacacacacaatgccaagcatctcctttaaggctacacgtatttttgactatatctgctgtaagcagtcggctgctgtcattaagcaaaaaggccaagacaatgtgagtttatctggtcctacctgcatttctactcatcgttggactgaaacaaatgggaaagaaaaacttactgacttttggcgaactacaaagactatttggatccagcgtttgcttcgaattccgggcaatacgcttaaaacaaattacctgtttgtcttggatggcctttgcaatgagaaccctaggcctgcaagacctctgagattcattgacctcaccagcccacccacaaagaaagatacgtggatactccctgtattgcccagtcctggctacaatggcagggaggagcaggcaaacagcctccccgtcaaagatgttacaatctggtcaatgtacactggggtaggacacgtggggagtcaaatatacatcaatttctggcaacacacggcaagaaaacacagatgcccaaaaggacatcaactcaagatttccagtaaaaccaaacccagcttgggtcagatgcacctttccagcaaccaccatctcagcaacaacctgccagctgtcaactggaagttcagcttctgggaacttcagcccccttctcagaggagcaaggtcctagcaccaacagcacctgcagtggagcccaagtatggctgcttcatggagaaggcaggtaaagaggggtgtgcacactgtctcagggtggcaactcttattgataacgaaggcattgtggccttctgacgggtactgctgcccactgacaggtgaaagcattttgttgggttttttttttttcaaattgctattgctatatataaatgtaacgtatagcaataaccgtagaaagatactgtgcccttgtgtatggataattaaaataggaacatctctggactaaattaaaatgtgtaaaaaccaaatccttatagcatccatgaaattacagaagctacaagtgaatcactagcccagggacgaagcatttctctcattacttcatgaacctcttccatgatcacagttttacattttcacaaatctacatggttctttttatgtcactaaatatctcagctcacttttactgccctccttatagacatgc

SEQ ID NO: 462489 - DNA, 1073 bp, Homo sapiens
gcgtctcatctgtgtgggcctggtttatgagtacaagttgctcacggcacatgattggccctaactccccagtgctttctggcactcttaaaccagcgaggggctctggaaatagttgtagaatgagacagaaaagacctgccctcatggcagatgagaagacagctgccctgtgctccacttggaagcacctgtggccaaagctcataggcacttgtgtggcaggaagaacagatgtgaagttctgtggaaaagaaatacaacacaaattggcagaacacagtaacttaaaaaataaatctgaaagtcagtcctggagagcccatctttgggtcctggctttgattggaaagagttatggttttgttggggtaatagcagctgatctttcgtcctcccacagaatcctgccagagccaacacttggaagcacacagctaatgagaggatttcttccaaggttcttaaccaaatgctctttgatagtggtggttgtgaggcggaggaagatgcttctgctgaagagggggttcctagaagcagcaaccaaagcccttaaaagaatcaacagcgatcattatatagccaccatttagctgcaccatttaaacaagatttttaacccatggggacgccaagatcaacatggagcttcctgcacataaaagtctggaatttcatagcaatgtgggggcaaaagctatgatagcatttccccctttctaaattatatactgcttagtgttaatgtgagcagagggctggatggcgacgggctcgcagcttacatgctgttctggaaactcggtttagtggcagctatgaatgctcatctgtagcacctcccttttccctcccatttggaaggagcaagagactgtcttctaggatgagagagatgagagagatggcattaaagcttgacatcagatgagcccttcagctctctcaacctgcataattctcttttgggaaggagagactggtctccaagcacttcttacacctcctctgaaccaggaaccatatcagcacattctgactgagttaaccttaattgtaaaagactggga

SEQ ID NO: 462490 - DNA, 1351 bp, Homo sapiens
aagacacaaactgaaggactggcaaaatgttgtgatgactgcaattcactgaaacgaacatggtccagtgttttaaaatccccaaatctcaagggaacatcagggcaactggggctcatctcatatttctctccatcctcctatgtggacttgaagcaagccagcaaacagcctgacatgataccctggatggatgagtgtgccctgttgacacagcttcgaagaacatcaaccatatggaagcaatttcacccatctccctgaagacacctgggaatgatgaaagtgacaagaaatggcaccagggactccttctgtataccacttgccttcacctggtggaaatagtgagattagaatgtaaatgtgttcagaaagaagccagactttcccaaaggtcatcagaagaccacagctcagcagcctgtagacactcttcaatggttctgggctcacctacctgtcttaagtccagagtgattgtgacccagtgatattctctcccattctgaatgctgggactttgccaccagttattggtgccatctatggcatgtgatattggatggcgttctgttgaaagaaaataaaaaacatgaattcctctcggctgttgctttaaatttcttaagttctaaaccgtaatgctagtggaaacaaagagcagtgaaggatcccgtgcatctcaggaacaaggcagccaggaggcccatgacctctcacccacatggattgtgaagcaatgtgctcaaggtgtccttgaaaaagacagaggttttgattgtaagagaaacacatgtggtaactgcaataagaaattgtccttaaaaatgtccagtgaccagtacctccgatcaaatcatttggcacttgagatgtcaaatgcatcaccatctctaacagaacaccagcacgaagaccccaaggtggctggatccacaggattagagctacttttattccagtacatatctaaagggtcatcttacagacaaagaaatcatttgagttacgttttaccttatgcaccaatggcagacaaatatatttaacaacaaaacactctgatcacaggtgcacagagttaaattattttggtgtcattctcactgggattgatacaacactatattttctcagttctagtaccatttttcccctgaaatgaagccacctctttataagcacatatactttgaacctggtagtttttctctttttcaaaaggctattcctagattaaggctgtatataacaagaattgtcttcattgtctccaattctttgcctcacattctctcttcactcagttccaactgagaagctgttccttttaatcactaagaatgcc

SEQ ID NO: 462491 - DNA, 2727 bp, Homo sapiens
agcgggctggggcggggaggtgggaccgggagaggggtggccgcggggcccggccgggctggggcggggggccgcagccatgatccgggccttctcgttcccggtgagccctgagcggggccggctgcggggctggctggagggtagcctggccgggctctgcgagttacattggctccgggagaggcaggagtaccgcgtgcagcaggcgctgcggctggcccagcccggaatggggggcgccgaggccgaggacgaggaggacgccgatgaggatgaagatgcggcggcggcgcgccgggccgcagcggccctggaggagcagctggaggccctgcctggtctcgtctgggacctgggacagcagctgggagacctgagcctggagtctgggggcctggaacaggagagcgggcgtagctcgggcttctatgaagatcccagctctacaggaggtccagattcaccaccctcaaccttctgtggggacagtggcttctctggatccagctcctatggtcgcctgggtccctctgagccccggggcatctatgccagtgagaggcccaagtccctaggagacgccagtcccagcgctccggaggtggtgggcgcgcgggcagcggtgccgcggtccttctcagcgccctacccgacggcaggggggtccgccggcccggaggcctgctcctcggcggagcggcgggcccgcgccgggccctttctgacgcccagccccctgcacgccgtggcgatgcgcagcccgcggccctgcggccgccctcccaccgactcgcccgacgcggggggcgcagggcggcccctggacggctacatctcggcgctcctgcgcaggcgccgccgccggggggcgggccagccccggaccagtcccgggggcgcggacggcggcccgcggcgccagaacagcgtgcgccagcggccgcccgacgcgtctccgtcccccggcagcgcgcgacccgcgcgggagccctcgttggagcgcgtcgggggccaccccaccagccctgccgccttgagccgcgcctgggcgtcgtcgtgggagtcggaggcggcacccgagcccgctgcgccgcccgccgccccctcaccccccgacagcccggctgagggccgcttggtgaaggcgcagtacatcccgggcgcgcaggcggccacccgaggcctccctggccgcgccgcccgccgcaaaccgccgccactgacccgcggccgcagcgtggagcagtcaccaccccgggagcgtccccgggccgccggccgccgtggacgcatggccgaggcttcgggccgccgcggctcgcccagggcccgcaaggcctcgcgctcccagtctgagaccagcctgctgggccgcgcctccgcggtcccttcggggccccctaagtaccccacggcggagcgggaagagcctcggcctccacggccacgccgcggcccagcgcccacgctggcggcccaggccgcagggtcctgccgtcgctggcgctccactgcggagatcgacgctgccgatgggcgccgcgtgcggccccgagcccctgcggcgcgtgttcccggccccggcccgtccccgtcagctccccagcgtcgtctgctttacggctgcgcgggcagcgactccgagtgctcggctgggcgcctggggcccctgggacgccgggggcctgcgggaggcgtcggcgggggttacggggagagcgaatcgagcgccagcgagggagaatcgcctgccttcagctctgcctccagcgactcagacggcagcggtggcctcgtgtggccgcagcagctggtggcggccaccgcggcctctgggggtggagcaggtgcaggggcgcccgcaggccccgccaaagtcttcgtgaaaatcaaagcttcccacgcgctcaagaaaaagatactgcgtttccgttcgggttctctcaaggtcatgactacagtgaatggggaggagccctgtttgacccagttcagcttctagcttggaagcccttgggcaagacagttccccttctctgggcgtcactttcctcatctgtacactatggccccctctcattcacaaagtgccccctccatgtccctggacccttaagatatccccttggcaccctggtcagagactctgtgtctgactcaggtggtccctgcagagtgccctgggaagggaaggagcactgatttgggggttttgagggtcaagtaggggttggtaacacctggaaagaaggactctttcacttcgatccctggacaattatggaggattcggaggtagaagaggggaaggaagatggtttctatctcatgacccccactccctgtgagagggaatgggggaagcctgatgaccctcagctgttccaatctagtattttttttcttttttaaaattactgtatttattatgacgatggtgactccccagtgcaaaggggggccagattctgtgtgtttctctaacctctttgtaaataaatgcacagtgtaacatatgtggtggactctcactgaatgattaaatgggagaaatgctctttttcctttggactaacatttattgagcaacttctgtttgctgtggatatggcagtttccagggaggtcccagggtgaatctcaacatcatcttcctaccattggctattttacatcaaggaatctaacctttgattgggttatgtttggttataaatacgattt

SEQ ID NO: 462492 - DNA, 761 bp, Homo sapiens
agcgggctggggcggggaggtgggaccgggagaggggtggccgcggggcccggccgggctggggcggggggccgcagccatgatccgggccttctcgttcccggtgagccctgagcggggccggctgcggggctggctggagggtagcctggccgggctctgcgagttacattggctccgggagaggcaggagtaccgcgtgcagcaggcgctgcggctggcccagcccggaatggggggcgccgaggccgaggacgaggaggacgccgatgaggatgaagatgcggcggcggcgcgccgggccgcagcggccctggaggagcagctggaggccctgcctggtctcgtctgggacctgggacagcagctgggagacctgagcctggagtctgggggcctggaacaggagagcgggcgtagctcgggcttctatgaagatcccagctctacaggaggtccagattcaccaccctcaaccttctgtggggacagtggcttctctggatccagctcctatggtcgcctgggtccctctgagccccggggcatctatgccagtgagaggcccaagtccctaggtaaggtgggtgagggtggggccctggggccagggaaaggacagtaggaggatggttgtgggcacagacttccgaatcgggcctggattccaattccagctgtgacatttccttttcacatggttatgagcaggtctcttatttctgggtctctgtttttccatctgttaaaatgaaatatgg

SEQ ID NO: 462493 - DNA, 2361 bp, Homo sapiens
tgccctccagtcctctcctcacagtgtggaaacactctttccttcaaaaccttcatttgtaccagcaggaaactctcacccggagtcaatgtaaagtcgtgacctaaataaattgtcatgttcccaaaccttttctccaggggacaatgcaaacaagtttttcactgagtctgaccctcacagattttcttcatgtatacaaattacagcctgactcagcgaccccatgaatgctaaaaccaaaacactgtccaggaaatggccccaggcgccaaaggctccagactggtctcaggctctcctgcccactgcagtttattcacttgcttctcaccaacactgatccacttaggtaagaaaaaagaccttcaatcccctttgctgtttgtttgtttttaagaaactagcagagttcctgctttccttctgtggttatgtataagctggaagacaaaaaattctaaaatactttatatggattttaaaactggcaagtaatgattcctttgagaaaacaaagatatcagctatgctattatgatttatacattggtttccatccatgcttcctgactcataactcccatagtccttgttacagtaaacagaaactctctctctctgaccttctcctgccccccattcacctgtccactgcagaactctaatgtgatcgtgggtcataagactctcactccaaagagtgtcctgtcctgtacgctggggaaaggaatgctacacagaagccaaaaattatctggacaggggttggatgcagtggttcacgcctgtaatcccagcactttgggaggctgcggagggaggattgctcgagcccaggaattcaagaccagcctgggaaagatgtcgagaccccatctctatgaaaaataaataaaaaggccggacgcggtggctcatgcctataatcccagcacttcaggaggctgaggtgggcggatcatgaggtcaagagatcgagaccctcctggccaacatggtgaaacccccgtctctactaaaaatacaaaaattagctgggcgtgtgctggggaggacataagagaaactggattctactcctactcctactcctactttggtggtggaaatgtaaaatggtacagagagcgcggtgagacgcagagtgcggccggcttgccgagtcccaagcaggcaggtgagctggagggcggggatgtcccgggacaggccgcggcccctgccccgcagacaccggggccctcgctgtgccgggcacagacgaagccccagccgagacgcagcgcctccaggtggctgcgggagcggcgggcgggaagcggggcgaccaggaagccgcgcagatccgggacctgggggacctctctgtcccagtggggcgagacctacctagccctgacgatagcggagaatagccttaaccggcctggaagctgtatttccaaaatgtcgctttctaacaagctgatgctggacaagctggacgtgaaagggaagccggtcgttatgagagtcgacttcaattttcctatgaagaacaaccaggtaacaaacaactggaggattaaggctgctgtcccaagcatcaaattctgcttggacaatggatccaagtcagtagtccttataagccacctaggttggcctgatggtgtccctatgcctgacaagtactcctcagagccagttgctgtagaactcaaatctctgctgggcaaggatgttctgttcttgaaggactgtgtaggcccagaagtggagaaagcctgggaagtctatgtcaatgatgcttttggcactgctcacagagcccacagctccatggcagaagtcaatctgccacagaaggctggtggttttttgatgaagaaggagctgaactactttgccgaggccttggagagcccagagcgacccttcctggccatcctgggcagaactaaagttgcagacaagatccagctgatcaagaacatgctgggcaaagtcaatgagatgattattggtagtggaatggcttgtaccttccttaaggtgctcagcaacatggagattggcacttctctgtttgatgaagagggagccaagactgtcaaagacctaatgtccaaagctgagaagaatggtgtgaagattatcttgcctgttgactttgtcactgctggcaagtttgatgagaataccaagactggccaagccactgtggcttctggcatacctgctggctggctgggcttggactgtggccctgaaagcagcaagaaggactaaacgtttctgtctcccacctccaataaattaatataataaatccctactctccagtgtgctggtatttgcagatggggcctctgggag

SEQ ID NO: 462494 - DNA, 1364 bp, Homo sapiens
gagagatgcgcagtgctgcccctttctatgggcagggccgaaggtccgcgtgtaaaagtacccagtccctggtaacctgacacttcccttttaaaagccaccttttgtctatctctggcctgccacgattcttcctgtgctccataggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaagggtgtccatcgcgcttccttcactgccttgatcatgtcggggtcaccacctgcgggggtttgtcctgcagaccctgactcaacgacggatgaataatgtacactgacacagatcttatgcttgtcagtcctgctgagcatccaggccacttacagactccaagaagagtcctgtcagccacggctctgacttgttggccctcccggcatttatttagcacacatttaatgacagaagtctcaggctggaaacactctttttgtagaacatacaaatggacatttctaagcacattgaggcctataatgaaaaatcaaatatcccacaatgaaaactagagggaagctatctgtgataatgctttgtggtgtatggattcatctcactgactgaaacctgagttttgattcaccaggttggaaactctttctgcagaatctgcaaagaaatatttctgagcccattgaggcctacagtggaaaactgaatattctgtgataaaactagaaacaccctatctgtgaaaatgctttgtgatgtgtggatttttctcatcgaatggaacctctgttttgactcacaagggtgaaacactattttagtagaatctaggaagaaacatatctgagcccatttatgcctacagtgagaaactgaataccctgcaataaaaagtagacagaagctatttgtaaaaatgctttgtgatgtgtggattcagtgttaaacttttattttgattccacagttttgacaccctatttgtagaatatatgaatgaacatttctcagcccattgaggcctatcatgtgaaaccaaatattttataataaaaactggaaacaagtgatctgttaaaatgttttttagtgtgtgaatttgtttcacaaagataaatctttgcatggattcaacaggttggaaacattattgtagaacctatgaagggatgtttttagcctattaaggactatatatataaa

SEQ ID NO: 462495 - DNA, 1055 bp, Homo sapiens
taacggctggaaccgcctaagacaccaccccagccagcatggccggcaggagcgcaccgcgctgtctccctccagggatccgcaccgccctacaatcctgctttgtgctgagattgtagtcctgcaggcgtacaactaacaagctgggtgcagataagagactacagctccccgcatcccaagcaaaggtccctcctctacggagcccctccacgcgtccactgcggttccgccgtgccaaggggagcttggctgttcacgggcctcacctgctagcgagaagatagcttggccgggcggctgatctcaccttgtaattctgacactgtgtctcccgggcttgtcggcttcatgacttgtgcccaaagtttgatttctcgcagaccaggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaagggtgtccatcgcgcttccttcactgccttgatcatgtcggggtcaccacctgcgggggtttgtcctgcagaccctgactcaacgacggatgaataatgtacactgacacagatcttatgcttgtcagtcctgctgagcatccaggccacttacagactccaagaagagtcctgtcagccacggctctgacttgttggccctcccggcatttatttagcacacatttaatgacagaagtctcaggttctaggtggaacactcttttgaaaaatcaatgaacttctaagccttgagcctatatggaatcaattccacatgaaactaggggactttctggaagcttgtgggttgatcattactgctgaaccggattggatccagttggaacctttcgggttacttaacgttttggccttcctcctgtgattctgttt

SEQ ID NO: 462496 - DNA, 768 bp, Homo sapiens
taacggctggaaccgcctaagacaccaccccagccagcatggccggcaggagcgcaccgcgctgtctccctccagggatccgcaccgccctacaatcctgctttgtgctgagattgtagtcctgcaggcgtacaactaacaagctgggtgcagataagagactacagctccccgcatcccaagcaaaggtccctcctctacggagcccctccacgcgtccactgcggttccgccgtgccaaggggagcttggctgttcacgggcctcacctgctagcgagaagatagcttggccgggcggctgatctcaccttgtaattctgacactgtgtctcccgggcttgtcggcttcatgacttgtgcccaaagtttgatttctcgcagaccaggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaagggtgaagtgtaaccaaaaaaaaaaaaatccaaaggtcaaactcagtttgcaggaaggagcataggagaataaaggatggaacaaagaagaaaaagaacagcaagttactctgagtattgtggaaacaaactgaaattagagtgagag

SEQ ID NO: 462497 - DNA, 869 bp, Homo sapiens
taacggctggaaccgcctaagacaccaccccagccagcatggccggcaggagcgcaccgcgctgtctccctccagggatccgcaccgccctacaatcctgctttgtgctgagattgtagtcctgcaggcgtacaactaacaagctgggtgcagataagagactacagctccccgcatcccaagcaaaggtccctcctctacggagcccctccacgcgtccactgcggttccgccgtgccaaggggagcttggctgttcacgggcctcacctgctagcgagaagatagcttggccgggcggctgatctcaccttgtaattctgacactgtgtctcccgggcttgtcggcttcatgacttgtgcccaaagtttgatttctcgcagaccaggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaagttatttgagacagagtctcgctctgtcaccaggctgtacagtgccgtggcctgtctcggctcactgcaacctccacctcctgggttcaagcgattcttatgcctcagcctcccaagtatctgggactacaggcatgcgccaccacgcccagctgatttttgtatttttagtagagacggggtttcaccatgttgaccaggatggtctcaatctcttgacctcgttatccggctgcctcctcctcccaa

SEQ ID NO: 462498 - DNA, 739 bp, Homo sapiens
ggctgtaccggcccgggatgtatgggattgaattcatctcactcagttaaaccttcgttttgattcaacaagggtgaaacactcttttggtagaatctacaaagaaacatttatgagccccttgaggactatagtgaaaaaatgaatctcctgcattaatatctagaaacaatctatttgtgaaaatgctgtgtgatgcatggatccatctcacagatttcaaactttattttgattcaacaggctggaaacactcttgttatagaagctacgaagggtcatttctgaacccattgaggccaatagtgaaaaactaaatatcctgcaataaacctagaaaaaatctatctgcgaaaatactttgtgtagtgtggatgagtgtctcagggttaaacatttgtttttattcaccaggttcgaaacactctttttgttgaacagacaaagggacatttcttagcccagttaggcctataaaggtaaaccgaatatcccgtgatacatagtagaaacaagctatctgcaaaaatgctttgtgaattgtagattcatctcacagaattaagcctttgttttaattcaacaggttaaaaacactatttttgtagactctacgaagaaacatttctgaaacccattgaaacctatgggggaaaaaaacccccgaaattcctgtgataagaaatggaaagcagctatctgtgaaaatgctttgtaatgtgtggattcttctcacaga

SEQ ID NO: 462499 - DNA, 494 bp, Homo sapiens
gaaaaaaaaagaaggtccgagcaatctcagatatatgagaggccaagatgggaagatcacttgggtaagactgggaagattgagtctgcagtgagtcacagtcgcatcattctgctggatttgaatggtactgcttctggcccaagttgtctgggcaaccttagacatggctggaaacactctttttgtagaacatacaaatggacatttctaagcacattgaggcctataatgaaaaatcaaatatcccacaatgaaaactagagggaagctatctgtgataatgctttgtggtgtatggattcatctcactgactgaaacctgagttttgattcaccaggttaaaaacactatttttgtagactctacgaagaaacatttctgaaacccattgaaacctatgggggaaaaaaacccccgaaattcctgtgataagaaatggaaagcagctatctgtgaaaatgctttgtaatgtgtggattcttctcacaga

SEQ ID NO: 462500 - DNA, 3550 bp, Homo sapiens
taacggctggaaccgcctaagacaccaccccagccagcatggccggcaggagcgcaccgcgctgtctccctccagggatccgcaccgccctacaatcctgctttgtgctgagattgtagtcctgcaggcgtacaactaacaagctgggtgcagataagagactacagctccccgcatcccaagcaaaggtccctcctctacggagcccctccacgcgtccactgcggttccgccgtgccaaggggagcttggctgttcacgggcctcacctgctagcgagaagatagcttggccgggcggctgatctcaccttgtaattctgacactgtgtctcccgggcttgtcggcttcatgacttgtgcccaaagtttgatttctcgcagaccaggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaagggagatcgaggccacagtgaatcacgatcacatgtctctgttggacctgagcagtactgccggtggtgagaaccgtctggtcgaccttagatgtagcaagctagcagctaggtccaggacacgggaggccagttgggaagaccgcccgggcgagaccaggaagatcaaggccacagtgaatcacgatcccatccctctgctcaacctgaattgtactgctgctggcgagagagatctggtcgaccttagacatggcaaggcgagaggtgaggtccatcaggtcgaccttagtccaacgctcacagccgacatctctctcaaaataaataaacaaatccaacagtacacggggggccccccaagatgggaagaccacccgggtaaaacctgggagtctgagttctcagtgaatcgggaatgcatccctctgctggacctgaatggtactgtcaccagcaagaggcatctggtcaaccttagacgtggcaagctgatggctaagtccaacacttgcagccgaaattggctagagtgtgacagaaatctaaaagatcaacttcatcgtgcaggaaggagcatagaaaaatagagaaaagaagaaaacagcaaaccattctgagtaccgtggaaacaaactaaaagtgggcttagaaggaaaacagaggaagaaggtctgagtagtcccagggacgccagaggccaagatgggaaagccacccaggcgagacaggggagatggaagccacagggaatcactatcacatacctctgctggacctgaatggtcctggcgccagctagagccatctggtcgaccttagacatgtcaaggcaggagccatctgatcgaccttagacttggcaagctggtggctaagtccagtgctcactgccgacatctgtctcaaaataaacaaaaagtccaacagtgaatatttaacaataacaaaaatataataccaaacaatattaaagaccaataaataagtgggagtgaacaaaggtaaaaggtaactaatatcacaattaaaatattctgctatctctcactctctctcttcccctttccatttgtcacacccaggctggaatgtgacaaaaaaatataaaaggtcaatttcatcatgcaggaatgagtgtagaaaaagggagaaaagaacaaagaagaaaaacaacagcaagtctctctaaaacttcagttagtttcactgtagaaaaaaaaattgaaagtggggttaggaaaaaaaggaaggaggaggataagttcaggtagcctgagggactagggaagccaagatgggaagaccacctgggtgacactgggaagatcgagaccacagtgaatcatgatcacatccctctgctgtacctgaatagtacttccaaaggcaggagccatctggtcatccttagtcatggcaaggcgagagccatctggttgaccttagataaggtgagagccatctggttgaccttagacttggcaagctggcagctaagtccaatcctctcagctgacatcttggagagagagacagacagacagacacaaacagcgagacaggagaaaatcttaattgtgttattaattacttttcacctttgttcactccaaacagaaaaaaatccaacagtgaatatttaacaataacaaagatataactacaaacaatattaaagacaaataaatgggagtgaacaaaggtaacaggtaattaatatcacaattaaattcttctaatctctttctatctctcactctcgatttctctctgtcaacttcatcaagcaggaaggagcacaggaaaatataaagagaaaacaagaaaaaaatagaaagtcactctaaggactgtggaaacaaactgaaagtaaggttaggaaaaacaaaggaaggatgtcgaaatagtctgagggaatcaggaggccgagatcatcagaaggccaccctgtagagacctggaagacgcccagggcacagtgaatcacgatccgatccctctgctggacctgaatggtactgctgctgatgagagccatcctctcgaccctagacttaccaagctggtggctaaatacaaccctcgtgggaagatctgtctcaaaagaaaaaaatccaacagggaatatttaacagtaacaaagaactaaccataacaatattaaagacaaataaataagtgggagtgaacaaaggtgaaaggtcaattatatcacaattaagatcttctctctctttctccatttgtcacaaccaggctggattgttccaaaaaaaaaaaatctagaaggtcaaattcatcatgcaggaaggagggtaagaatatatatagagagaaaagaacagagaagaaatacaacagcaactcactgtaagtactgtagaaacaaactgaaagttgggttagaaaaaaaaaaagaagaaggtccaagtagtctgaaggactcgggaggccaagatgggaagtccacccagatgacaccggggagatcgaggctgcagagaataaggatcacatccctctgctggacctgaatggtactgatgctgttgagagccatctggtcctcagacatgggaaggcaagagccatctgttcgaccttagacatggcaagatgaaagctaagtccagtgctcgctgccaacacgtttctcaaaataaataaacaaaaatttcaacagtaaatattcaacaataacaaagaaataataacaactttaaagaccaataagtaaataagtgaaagtgaacaaaggtaataggtgattaatatcacaattaagatcttctatctctctacttctctgttactctctagctgtctctgtttgtcaaacccatgctagagtgtgattaaaagaaatataaaagtcaactgcttcctgcaggaaggagcatagggacataacgagagaaaagaacaaa

SEQ ID NO: 462501 - DNA, 1605 bp, Homo sapiens
taacggctggaaccgcctaagacaccaccccagccagcatggccggcaggagcgcaccgcgctgtctccctccagggatccgcaccgccctacaatcctgctttgtgctgagattgtagtcctgcaggcgtacaactaacaagctgggtgcagataagagactacagctccccgcatcccaagcaaaggtccctcctctacggagcccctccacgcgtccactgcggttccgccgtgccaaggggagcttggctgttcacgggcctcacctgctagcgagaagatagcttggccgggcggctgatctcaccttgtaattctgacactgtgtctcccgggcttgtcggcttcatgacttgtgcccaaagtttgatttctcgcagaccaggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaagggtgtccatcgcgcttccttcactgccttgatcatgtcggggtcaccacctgcgggggtttgtcctgcagaccctgactcaacgacggatgaataatgtacactgacacagatcttatgcttgtcagtcctgctgagcatccaggccacttacagactccaagaagagtcctgtcagccacggctctgacttgttggccctcccggcatttatttagcacacatttaatgacagaagtctcaggctggaaacactctttttgtagaacatacaaatggacatttctaagcacattgaggcctataatgaaaaatcaaatatcccacaatgaaaactagagggaagctatctgtgataatgctttgtggtgtatggattcatctcactgactgaaacctgagttttgattcaccaggttggaaactctttctgcagaatctgcaaagaaatatttctgagcccattgaggcctacagtggaaaactgaatattctgtgataaaactagaaacaccctatctgtgaaaatgctttgtgatgtgtggatttttctcatcgaatggaacctctgttttgactcacaagggtgaaacactattttagtagaatctaggaagaaacatatctgagcccatttatgcctacagtgagaaactgaataccctgcaataaaaagtagacagaagctatttgtaaaaatgctttgtgatgtgtggattcagtgttaaacttttattttgattccacagttttgacaccctatttgtagaatatatgaatgaacatttctcagcccattgaggcctatcatgtgaaaccaaatattttataataaaaactggaaacaagtgatctgttaaaatgttttttagtgtgtgaatttgtttcacaaagataaatctttgcatggattcaacaggttggaaacattattgtagaacctatgaagggatgtttttagcctattaaggactatatatataaa

SEQ ID NO: 462502 - DNA, 3453 bp, Homo sapiens
taacggctggaaccgcctaagacaccaccccagccagcatggccggcaggagcgcaccgcgctgtctccctccagggatccgcaccgccctacaatcctgctttgtgctgagattgtagtcctgcaggcgtacaactaacaagctgggtgcagataagagactacagctccccgcatcccaagcaaaggtccctcctctacggagcccctccacgcgtccactgcggttccgccgtgccaaggggagcttggctgttcacgggcctcacctgctagcgagaagatagcttggccgggcggctgatctcaccttgtaattctgacactgtgtctcccgggcttgtcggcttcatgacttgtgcccaaagtttgatttctcgcagaccaggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaagggtgtccatcgcgcttccttcactgccttgatcatgtcggggtcaccacctgcgggggtttgtcctgcagaccctgactcaacgacggatgaataatgtacactgacacagatcttatgcttgtcagtcctgctgagcatccaggccacttacagactccaagaagagtcctgtcagccacggctctgacttgttggccctcccggcatttatttagcacacatttaatgacagaagtctcaggctggaaacactctttttgtagaacatacaaatggacatttctaagcacattgaggcctataatgaaaaatcaaatatcccacaatgaaaactagagggaagctatctgtgataatgctttgtggtgtatggattcatctcactgactgaaacctgagttttgattcaccaggttggaaacacttttttagtagaatctatgagaaaatctttgtgaacccaatgaggactctgtgtgtgtgtttgtgtgtgggggggggtgggggggcaggaaacaacgaggatttcatgatggaaactggaaagaaccatctgtgaaaatggtttgtgatgtgtggattcacctcacagaattaaacctttggtttgatagaacagattgaaaacactgtttttgtacaatctaaaaagagacatttctgagcccattgaagcctgacgtgaaaaaccaagggtctcacaataaaaacgaattacaagctatctgtgaaaatgcttagcaatgtccggattcatctcactgaatagaccctgtgttttgattcaccaggttggaaactctttctgcagaatctgcaaagaaatatttctgagcccattgaggcctacagtggaaaactgaatattctgtgataaaactagaaacaccctatctgtgaaaatgctttgtgatgtgtggatttttctcatcgattaaacctttgttttgattcaactgattggaaacactctttttgtaaaatctatgaagggaaatttctgagcccatttaggcctatagtgagaaacagaatatcccactgtaataagtagaaacaagctatctgtgaaaatcatttatggtggctggattcatctcaccaaatgaaacctgtgctttgattcaccagtttggaaacactatttttatagaatctatgcaggaatatttctgatcccattgaggcatatgctgaaaattcgaatatcccatgataaaaactacaaacaagctatctatgaaaatgttttgtcatgtgtggattcatctcacagagttaaacctttgttttgattcatctgtttgaaaacacgcttttttgtagaatctaagaatcaacatttctgagtgcattgaagcctatagtgaaaaacaaaatatctgatgataaaaactagaaacaagctatctgtgaaaatgctttgtgatatgtggattcatctcaaagaattaaactttattttgattcaacaggctggaaacactgttttcgtagaacctacaaaaagacattggggagcccactgagtcttacagtgataaaccaaggatcctgtgataaaactagaaacaagctatctgtgaaaatgctttgcagttggtgaatttctttcatagttaaacctttttttattcaatacgttggaaacaccattttttagtgtctctaaagggactttttcagccctttgaaacctatagtgaaaaaccaaatatcttgcaataaaaacaaataaacaaaaaagaactacttatgaaaatgccttgtgatgtgtggattcatctcacagagttaaaccattgttgtgattcaacaggttggaaacatgctttttgtagaatctacgagttgacatttctgagccctctctgggttatggtgaaaacgaaatatcccatgataaaaactagaaacaacctatctgtgaaaatgctttgcaatgtgtggattcatttcacagaattaaaccattgttttgatttaacaggttggaaccactctattttaagaatctatgaagaaatatctttgtccctattgtacactatagtggacaactgaatacttcatgacaaaaactagaaacaagctagctgtgaaaatgctttgcaatgggtgaattcatctcactcagttaaaccttcgttttgattcaacaagggtgaaacactcttttggtagaatctacaaagaaacatttatgagccccttgaggactatagtgaaaaaatgaatctcctgcattaatatctagaaacaatctatttgtgaaaatgctgtgtgatgcatggatccatctcacagatttcaaactttattttgattcaacaggctggaaacactcttgttatagaagctacgaagggtcatttctgaacccattgaggccaatagtgaaaaactaaatatcctgcaataaacctagaaaaaatctatctgcgaaaatactttgtgtagtgtggatgagtgtctcagggttaaacatttgtttttattcaccaggttcgaaacactctttttgttgaacagacaaagggacatttcttagcccagttaggcctataaaggtaaaccgaatatcccgtgatacatagtagaaacaagctatctgcaaaaatgctttgtgaattgtagattcatctcacagaattaagcctttgttttaattcaacaggttaaaaacactatttttgtagactctacgaagaaacatttctgaaacccattgaaacctatgggggaaaaaaacccccgaaattcctgtgataagaaatggaaagcagctatctgtgaaaatgctttgtaatgtgtggattcttctcacaga

SEQ ID NO: 462503 - DNA, 1983 bp, Homo sapiens
taacggctggaaccgcctaagacaccaccccagccagcatggccggcaggagcgcaccgcgctgtctccctccagggatccgcaccgccctacaatcctgctttgtgctgagattgtagtcctgcaggcgtacaactaacaagctgggtgcagataagagactacagctccccgcatcccaagcaaaggtccctcctctacggagcccctccacgcgtccactgcggttccgccgtgccaaggggagcttggctgttcacgggcctcacctgctagcgagaagatagcttggccgggcggctgatctcaccttgtaattctgacactgtgtctcccgggcttgtcggcttcatgacttgtgcccaaagtttgatttctcgcagaccaggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaagggtgtccatcgcgcttccttcactgccttgatcatgtcggggtcaccacctgcgggggtttgtcctgcagaccctgactcaacgacggatgaataatgtacactgacacagatcttatgcttgtcagtcctgctgagcatccaggccacttacagactccaagaagagtcctgtcagccacggctctgacttgttggccctcccggcatttatttagcacacatttaatgacagaagtctcaggctggaaacactctttttgtagaacatacaaatggacatttctaagcacattgaggcctataatgaaaaatcaaatatcccacaatgaaaactagagggaagctatctgtgataatgctttgtggtgtatggattcatctcactgactgaaacctgagttttgattcaccaggttggaaacacttttttagtagaatctatgagaaaatctttgtgaacccaatgaggactctgtgtgtgtgtttgtgtgtgggggggggtgggggggcaggaaacaacgaggatttcatgatggaaactggaaagaaccatctgtgaaaatggtttgtgatgtgtggattcacctcacagaattaaacctttggtttgatagaacagattgaaaacactgtttttgtacaatctaaaaagagacatttctgagcccattgaagcctgacgtgaaaaaccaagggtctcacaataaaaacgaattacaagctatctgtgaaaatgcttagcaatgtccggattcatctcactgaatagaccctgtgttttgattcaccaggttggaaactctttctgcagaatctgcaaagaaatatttctgagcccattgaggcctacagtggaaaactgaatattctgtgataaaactagaaacaccctatctgtgaaaatgctttgtgatgtgtggatttttctcatcgaatggaacctctgttttgactcacaagggtgaaacactattttagtagaatctaggaagaaacatatctgagcccatttatgcctacagtgagaaactgaataccctgcaataaaaagtagacagaagctatttgtaaaaatgctttgtgatgtgtggattcagtgttaaacttttattttgattccacagttttgacaccctatttgtagaatatatgaatgaacatttctcagcccattgaggcctatcatgtgaaaccaaatattttataataaaaactggaaacaagtgatctgttaaaatgttttttagtgtgtgaatttgtttcacaaagataaatctttgcatggattcaacaggttggaaacattattgtagaacctatgaagggatgtttttagcctattaaggactatatatataaa

SEQ ID NO: 462504 - DNA, 1963 bp, Homo sapiens
taacggctggaaccgcctaagacaccaccccagccagcatggccggcaggagcgcaccgcgctgtctccctccagggatccgcaccgccctacaatcctgctttgtgctgagattgtagtcctgcaggcgtacaactaacaagctgggtgcagataagagactacagctccccgcatcccaagcaaaggtccctcctctacggagcccctccacgcgtccactgcggttccgccgtgccaaggggagcttggctgttcacgggcctcacctgctagcgagaagatagcttggccgggcggctgatctcaccttgtaattctgacactgtgtctcccgggcttgtcggcttcatgacttgtgcccaaagtttgatttctcgcagaccaggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaagggagatcgaggccacagtgaatcacgatcacatgtctctgttggacctgagcagtactgccggtggtgagaaccgtctggtcgaccttagatgtagcaagctagcagctaggtccaggacacgggaggccagttgggaagaccgcccgggcgagaccaggaagatcaaggccacagtgaatcacgatcccatccctctgctcaacctgaattgtactgctgctggcgagagagatctggtcgaccttagacatggcaaggcgagaggtgaggtccatcaggtcgaccttagtccaacgctcacagccgacatctctctcaaaataaataaacaaatccaacagtacacggggggccccccaagatgggaagaccacccgggtaaaacctgggagtctgagttctcagtgaatcgggaatgcatccctctgctggacctgaatggtactgtcaccagcaagaggcatctggtcaaccttagacgtggcaagctgatggctaagtccaacacttgcagccgaaattggctagagtgtgacagaaatctaaaagatcaacttcatcgtgcaggaaggagcatagaaaaatagagaaaagaagaaaacagcaaaccattctgagtaccgtggaaacaaactaaaagtgggcttagaaggaaaacagaggaagaaggctggattgttccaaaaaaaaaaaatctagaaggtcaaattcatcatgcaggaaggagggtaagaatatatatagagagaaaagaacagagaagaaatacaacagcaactcactgtaagtactgtagaaacaaactgaaagttgggttagaaaaaaaaaaagaagaaggtccaagtagtctgaaggactcgggaggccaagatgggaagtccacccagatgacaccggggagatcgaggctgcagagaataaggatcacatccctctgctggacctgaatggtactgatgctgttgagagccatctggtcctcagacatgggaaggcaagagccatctgttcgaccttagacatggcaagatgaaagctaagtccagtgctcgctgccaacacgtttctcaaaataaataaacaaaaatttcaacagtaaatattcaacaataacaaagaaataataacaactttaaagaccaataagtaaataagtgaaagtgaacaaaggtaataggtgattaatatcacaattaagatcttctatctctctacttctctgttactctctagctgtctctgtttgtcaaacccatgctagagtgtgattaaaagaaatataaaagtcaactgcttcctgcaggaaggagcatagggacataacgagagaaaagaacaaa

SEQ ID NO: 462505 - DNA, 1176 bp, Homo sapiens
taacggctggaaccgcctaagacaccaccccagccagcatggccggcaggagcgcaccgcgctgtctccctccagggatccgcaccgccctacaatcctgctttgtgctgagattgtagtcctgcaggcgtacaactaacaagctgggtgcagataagagactacagctccccgcatcccaagcaaaggtccctcctctacggagcccctccacgcgtccactgcggttccgccgtgccaaggggagcttggctgttcacgggcctcacctgctagcgagaagatagcttggccgggcggctgatctcaccttgtaattctgacactgtgtctcccgggcttgtcggcttcatgacttgtgcccaaagtttgatttctcgcagaccaggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaagggtgtccatcgcgcttccttcactgccttgatcatgtcggggtcaccacctgcgggggtttgtcctgcagaccctgactcaacgacggatgaataatgtacactgacacagatcttatgcttgtcagtcctgctgagcatccaggccacttacagactccaagaagagtcctgtcagccacggctctgacttgttggccctcccggcatttatttagcacacatttaatgacagaagtctcaggctggaaacactctttttgtagaacatacaaatggacatttctaagcacattgaggcctataatgaaaaatcaaatatcccacaatgaaaactagagggaagctatctgtgataatgctttgtggtgtatggattcatctcactgactgaaacctgagttttgattcaccagatgtattatctatgaagaacgttttgagggcattagtctacactgaaaatgatatatgttaaatttaagagtatggaaatgttgcaggtgttttttccgattactggttgttccagtgacatttggattgagggttaagc

SEQ ID NO: 462506 - DNA, 1545 bp, Homo sapiens
taacggctggaaccgcctaagacaccaccccagccagcatggccggcaggagcgcaccgcgctgtctccctccagggatccgcaccgccctacaatcctgctttgtgctgagattgtagtcctgcaggcgtacaactaacaagctgggtgcagataagagactacagctccccgcatcccaagcaaaggtccctcctctacggagcccctccacgcgtccactgcggttccgccgtgccaaggggagcttggctgttcacgggcctcacctgctagcgagaagatagcttggccgggcggctgatctcaccttgtaattctgacactgtgtctcccgggcttgtcggcttcatgacttgtgcccaaagtttgatttctcgcagaccaggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaagggtgtccatcgcgcttccttcactgccttgatcatgtcggggtcaccacctgcgggggtttgtcctgcagaccctgactcaacgacggatgaataatgtacactgacacagatcttatgcttgtcagtcctgctgagcatccaggccacttacagactccaagaagagtcctgtcagccacggctctgacttgttggccctcccggcatttatttagcacacatttaatgacagaagtctcaggctggaaacactctttttgtagaacatacaaatggacatttctaagcacattgaggcctataatgaaaaatcaaatatcccacaatgaaaactagagggaagctatctgtgataatgctttgtggtgtatggattcatctcactgactgaaacctgagttttgattcaccagaatctatgcagggacatttttgtgctcattgaggcctactgtgaaaaaccaaacatcaggggtggagccaaaaaagccaaataggaacagctccagtctacagctcccagcatgagccacacagaagatggatgatttctgcatttccaactgagaatctatgaaaggatatttctgagcccattgaggatctatagtaaaaaaatctattatcctgtgataaacactagaagtaagctatctgtgaaaatgctttgccttgtgtggattcatcttacagagaatctatgaagggacatcatttctgagcccattgagacttgtagtgaaaaaccaagcatcccctgataaataggtagtagaaacaaactacctatgaaaatgctttttgatttgtggatttatctcacagtgttaaatttttgatttgattcaactggttgaaaacattctttatgtagaatctatgaagagacgtttttgagcttatcgagatgtaaggtgagaaa

SEQ ID NO: 462507 - DNA, 366 bp, Homo sapiens
gaataaaggatggaacaaagaagaaaaagaacagcaagttactctgagtattgtggaaacaaactgaaattagagtgagagagagagagaaaaaaaaagaaggtccgagcaatctcagatatatgagaggccaagatgggaagatcacttgggtaagactgggaagattgagtctgcagtgagtcacagtcgcatcattctgctggatttgaatggtactgcttctggcccaagttgtctgggcaaccttagacatggtaaggcaagagccatctgatcaacattagacatggcaaggtgaaagccatctggtcgacagggattctaatagaagacactctgggccgatggcagacgtctaataat

SEQ ID NO: 462508 - DNA, 809 bp, Homo sapiens
gagagatgcgcagtgctgcccctttctatgggcagggccgaaggtccgcgtgtaaaagtacccagtccctggtaacctgacacttcccttttaaaagccaccttttgtctatctctggcctgccacgattcttcctgtgctccataggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaaggtgaagtgtaacccaaaaaaaaaaaaaaaaaaaaaaaaaaaactttgggggcccctcgggccccgggaaaatctttcaaaaccattcgggggggggcgcgggcccccgtggtgtaggcaccatgggccaacgggtcccaaagagaaacccgggggcaggacaaggggtcggggttttctcccccacaataaaaaaaaccgccgggggggaccccgacgggttgctgacacacccaaaggggggtcgaggaggacatacaggggatcacaacaccaggggatcacaaggaaccggaattaatcccggcggcgaggtaaacacaacaacacgaaagcaaacaccacgacaagtcgagagacacagagcagtcagcaagataaagaaagagacaacaggagcgaccaacaaagacaacacacacggccacaa

SEQ ID NO: 462509 - DNA, 1459 bp, Homo sapiens
taacggctggaaccgcctaagacaccaccccagccagcatggccggcaggagcgcaccgcgctgtctccctccagggatccgcaccgccctacaatcctgctttgtgctgagattgtagtcctgcaggcgtacaactaacaagctgggtgcagataagagactacagctccccgcatcccaagcaaaggtccctcctctacggagcccctccacgcgtccactgcggttccgccgtgccaaggggagcttggctgttcacgggcctcacctgctagcgagaagatagcttggccgggcggctgatctcaccttgtaattctgacactgtgtctcccgggcttgtcggcttcatgacttgtgcccaaagtttgatttctcgcagaccaggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaagggagatcgaggccacagtgaatcacgatcacatgtctctgttggacctgagcagtactgccggtggtgagaaccgtctggtcgaccttagatgtagcaagctagcagctaggtccaggacacgggaggccagttgggaagaccgcccgggcgagaccaggaagatcaaggccacagtgaatcacgatcccatccctctgctcaacctgaattgtactgctgctggcgagagagatctggtcgaccttagacatggcaaggcgagaggtgaggtccatcaggtcgaccttagtccaacgctcacagccgacatctctctcaaaataaataaacaaatccaacagtacacggggggccccccaagatgggaagaccacccgggtaaaacctgggagtctgagttctcagtgaatcgggaatgcatccctctgctggacctgaatggtactgtcaccagcaagaggcatctggtcaaccttagacgtggcaagctgatggctaagtccaacacttgcagccgaaattggctagagtgtgacagaaatctaaaagatcaacttcatcgtgcaggaaggagcatagaaaaatagagaaaagaagaaaacagcaaaccattctgagtaccgtggaaacaaactaaaagtgggcttagaaggaaaacagaggaagaaggctggattgttccaaaaaaaaaaaatctagaaggtcaaattcatcatgcaggaaggagggtaagaatatatatagagagaaaagaacagagaagaaatacaacagcaactcactactggagtgggttcatatttatcatgtaggaagttgtaggggggatcctctat

SEQ ID NO: 462510 - DNA, 3314 bp, Homo sapiens
  misc_feature (3)..(3): n is a, c, g, or t
  misc_feature (7)..(7): n is a, c, g, or t
  misc_feature (9)..(9): n is a, c, g, or t
  misc_feature (12)..(13): n is a, c, g, or t
  misc_feature (15)..(15): n is a, c, g, or t
gtncacntncanntnttctgctctgtggctgcagctcgggtcacagtggccgctatccgtatccttcagaaaaatgatcccattttccaaaggctcacttgaagagcagtctccacctcaccagccatgggaggaatgcagacttttcaaaggcagctcctgggcagctgggctcagaagaggcacctgcccgtctcagcggcagtgcacgtgcaccgagaacctctttgctgggctgtgggtggtctttggtttcatgtttctgcggaaaccagctacagtgggatatgaaggctctgacattctagatcctggcccaccgtgttggagagggttgccagataaaacacagaacccagggaaatctgaatttcagataaacaccacagacatgtttttagccaataaaggtgaaataaagacattctcacaagaaagacaacaaaaagaagtcattaccaggtcctactcttgggcccatggaaagaactctcataactcagcatgagatgaacaacccaattataaatgatcaaaagatttgaatagatattttacaaatatgaatggccaacaaacataagaaaacaggctcagcactatcagtccttagggaaatgcaaattaaaaccacagggagatctaactacataccttccaggatagctaaaactgttggaaggatgtggagcaactagaattcttgtacattgttgaggggtgggaatgtaaaatgctacaaccactttggaaaaagtttagtaatttctttagaacttaaatatacttaccatatgtcccaggtaagctattcttggcaaagatttatggataaatgtcagagctttatttatactagctaaactctggaactatcccaggtatccatcagtagaatagatgaactgtagcatatgcatacaagggaatactatgtagcaataagaaggactaaaccatgatacatacaacaatgtgaatgaatctcagaaatatgatgaattttaaaatgccttacaccaaaatacatacttcatcatatttgcataaaatttttagaaaatgccaggggttaaatggagggaggaataggttacaaaattgcatgaggaaacttgttgggcaatggaactgtttactatctcgattatgatgacctcaggggtgtaaacaaatatcaaaacccatcattttgaacagtgctgttcaatactacttaataatacctcacctgcggtggaggggaagggccctagagccgtggggagaggcagcccgtggcctggagcagtgggtggatcgggcggaggccgtcaagctagccggaaggggctgtgctgtcaaccagcgagcgcaggaggtgttaaccaccgaagggaggtagaatgtttttccccaccagaggaggcagcgaccacgtctcctctatggaggcattcaagagccgtccagctgaagcagcatcactgtctgagagagaggcatccaaaagggaaaaagccggcctgaggtggaccacagcagacttgataggcaggcttgaggaggcggcgtctgatttacacagggcccacagattggtctgatcaggtgtgacgtttacatagcgctcggggaaggctggtcgtcccaccctaatcttattaaacaaatgggctttctacttggccagtaccatcttgtctgctccttactatacacgcgggtggcaaagacaggagaagatggagccaccgttttgaacgtgtctattcccaggtaacctttctctgttggcacaaccaccagtattagcctatgcaagcttccagcttgcttgtctgtgcctgcagcttgattttacaggttgttctttgttagaaaagaaaatgatttggggcattccttttaatgcttttcattaaaaggaaaaccttaccaaggacttccttattctgtctgcctaaataatttatttttaactcttctatcacagctcggaaggcacaatccacataggtctgcatggtccaccgagctgcatacccacggggccagcgggaggtgggcagctgctgggctctcttctgaagcagacaggatctcactctgttgctgaggctggatcacagctccctgcaaccttgaactctccctcaagcaattctccccactctgccttccaaagcactagcattataggcctaagccaccactcccatccactgtagtgtaaactgtctccttcaatgtttccaatagttgcggagcagatcagataagggttcttcctgtctgttgcttcaagtttcattctctctttaaacaatacaaggttggcttccatggttccttcttaaagaatgttgaaggtgtgtcttcagattcatttagtgttcgtggaaccccagggaaagctgatgtaaaaacctcttttttctcccatatgtctcaaaaagttgtattttctgggtccaagggatctgcaagcctcctaaaggcatttccattgtcactaccaccaggtgtgaactgtaatctggcacgtatagttccaagaactgtcataatagatgctgaagaaacattgtgaagttaactcgctgttaccaactgtgaagtcattagctagaggaatcttgggcggtctgaaatctgagatactgtggaaagaacagaaagatcctgtatctttcctataattgttctactggaagttgtcattttacacaggagacattctgttttatttattttcttttgagacagggtctcactctgtcgcccaggctggagtgcagtgttgttaccacaggtcactggtgcctccactgcctgaggactgctcaagcaatcctcctgcctcagtcccctgaggagctggggccacaggcctgcaccaccatgcctggctaattatttttatttgtagagacaaagtctatcttgcctaggctgatctcgaactcctgggctcaagtaatcctcccgcggtggcttctcaaagtgcttgggattacagatgtaagctaccatgcccggcctcacaggagacatttttgatgtccctcttgacagtctacaaaagtctacaaatctttttttttttttttttgagacagggtcttgctctgtcacccagtctggaatgcagtggtgccatcatagctcactacagcctgagctgtactgagctcgagggatcttcccgtctccgcctcctaagcagctgggactacaggtgtcagaaacgaagagactcaagaaaagactgcctgccctactcaccttgactgagcgctgacgaagaccacggggccctctgcgctgcaagg

SEQ ID NO: 462511 - DNA, 1833 bp, Homo sapiens
ccaggacatcatgctcagggaaagcagccaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagcctcgccccccacccctctcccccctggggggccccgtaccctcggcattgcctaacggacccccgtccccccgctccggccgtgaccccttggccatactgagcgagatcagtaagtcggtcaaaccgaggctagcatccttccgcagccttcgaggcagccgtggggtaagtgaggcctcggggcaggaggaggtggtggccctagcctgcccagcggcgggtggcgggaccctgggctcgcttcctgccgctggctgggcccctcttccctggttgcccaacccagacctgctttgctctgtgcatggcctcgctgtcaagaaccatggctggggaagggagtgaaatatctcagacgggtgcagagtctggcaggctagactccttgatcccaaattcagccctctacccaccttgcagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagaggtgaggggtgacgtcagagtgggtctgttcccagggtcccaggagggcctgtctttatctgccgaattatccccaaacagctctgaagagcctccctcagaagagagccaggacacccccatttacacggagtttgatgaggatttcgaggaggaacccacatcccccataggtcactgtgtggccatctaccactttgaaggtgagaac

SEQ ID NO: 462512 - DNA, 2053 bp, Homo sapiens
aaaatctactcaagggttggggttaaggaatatggaccagaatttgtcatcgcttcaaggattacattcttggggcttaacccttttccacctggaggtgcgtcctggggcatcagcctgctcgggaggaggggcctgactccctgttccccgattctcatccaaccccagattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatggtgaggagccccccgattcaggttttacaaagggcttctgctggaaccctggcgagccttatcactcttctttctgtagcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagcctcgccccccacccctctcccccctggggggccccgtaccctcggcattgcctaacggacccccgtccccccgctccggccgtgaccccttggccatactgagcgagatcagtaagtcggtcaaaccgaggctagcatccttccgcagccttcgaggcagccgtggggtaagtgaggcctcggggcaggaggaggtggtggccctagcctgcccagcggcgggtggcgggaccctgggctcgcttcctgccgctggctgggcccctcttccctggttgcccaacccagacctgctttgctctgtgcatggcctcgctgtcaagaaccatggctggggaagggagtgaaatatctcagacgggtgcagagtctggcaggctagactccttgatcccaaattcagccctctacccaccttgcagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagaggtgaggggtgacgtcagagtgggtctgttcccagggtcccaggagggcctgtctttatctgccgaattatccccaaacagctctgaagagcctccctcagaagagagccaggacacccccatttacacggagtttgatgaggatttcgaggaggaacccacatcccccataggtcactgtgtggccatctaccactttgaaggtgagaac

SEQ ID NO: 462513 - DNA, 516 bp, Homo sapiens
tcgcttcaaggattacattcttggggcttaacccttttccacctggaggtgcgtcctggggcatcagcctgctcgggaggaggggcctgactccctgttccccgattctcatccaaccccagattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatggtgaggagccccccgattcaggttttacaaagggcttctgctggaaccctggcgagccttatcactcttctttctgtagcacttccaagaagggcggcgggcccagcagcagctggaaaatggctttaaacagctggagaatgtgagtttgcagaggtagcagtgactgtggcccggaggcatgggggcagggttgcggatccggagtcagggagctgccctctttgtcagacctggaccttccct

SEQ ID NO: 462514 - DNA, 2028 bp, Homo sapiens
  misc_feature (91)..(91): n is a, c, g, or t
  misc_feature (185)..(185): n is a, c, g, or t
  misc_feature (187)..(187): n is a, c, g, or t
  misc_feature (214)..(214): n is a, c, g, or t
ggggcggcggcggcggcggcgggagcagcagggaggggggcacggagcggggggagcagggcgaggggcgcgagcgccacacgcagggggngcgggaccggggggacagagagggaaagggcgggaaagaacgcaccgaaggggaacaggcggacgccaaacaacggcggaccgggggaaaaaanancggcccaagagaccggccaaggagganccggaggccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagcctcgccccccacccctctcccccctggggggccccgtaccctcggcattgcctaacggacccccgtccccccgctccggccgtgaccccttggccatactgagcgagatcagtaagtcggtcaaaccgaggctagcatccttccgcagccttcgaggcagccgtggggtaagtgaggcctcggggcaggaggaggtggtggccctagcctgcccagcggcgggtggcgggaccctgggctcgcttcctgccgctggctgggcccctcttccctggttgcccaacccagacctgctttgctctgtgcatggcctcgctgtcaagaaccatggctggggaagggagtgaaatatctcagacgggtgcagagtctggcaggctagactccttgatcccaaattcagccctctacccaccttgcagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagaggtgaggggtgacgtcagagtgggtctgttcccagggtcccaggagggcctgtctttatctgccgaattatccccaaacagctctgaagagcctccctcagaagagagccaggacacccccatttacacggagtttgatgaggatttcgaggaggaacccacatcccccataggtcactgtgtggccatctaccactttgaaggtgagaac

SEQ ID NO: 462515 - DNA, 1629 bp, Homo sapiens
tgtggttctctgtcttgatggcgggatggtgctcatgaggaagcaagtgccatcaaggttcatgtaccccaaagagtggcagcacctcaccatgttcatcctcctcactcttaatggctgtgtggacttcatgagcaagaatgtgctgcctcagaggtgtgtgggcctagaaaaaggtaccctggtcctgatcatctacgagctcctgctgctgatggtgtcacatgttaaagattcagaaggggtggagctgcacgtttattctctgctcatcttggtggtgttcctgctgttgctggtgttgactgcagagctgtgggctcccaacatgtgtcatctccagctgatggagacctttctgattctgatgatgggctcctggctgatgcaggcaggctttattctatacagacccgtctctggctacccatggcaggacgatgacatcagtgacatcatgtttgtcaccaccttcttctgctggcatgtgatgatcaatgcctcattcctgttgggaatctatggcttctcttccttttggtatcattgtttcagacccagcttgaagctgactgggcccaaagaagctccatattatgcaagcactccaggacccctctacaagttgctacaggaagtggagcagtcagagaaagaggaccaggctctcctccttccaaagagctccccctgagacagggcctacagtggctggcacatcgtccacctcatcttcctcctgttggctcctcagccacgagcatggtaccctccttggtaaagctttcaagaattggcttcatttcaaactttacatataaagtgagactttttaaatacttaataacatttcaaatttccataatttaaatttgtatagaattcaactgctatagcatttttatagcattcaaatgcttggtacttccctgacttctcattttattactcttattctagcccaaactttccttttcaccatgaccacccttgcacatgcaatttagcagataccattcttgggtctttgcaaatttcttttccttgcaaatcacagccagtcatcctacagtcacatatttaccatgttattcgattcccagaataaacctacatccacccccacaccgcaccaagtatccccaaggtggccttctccagaactcttactgattcccttgttttggaactcttgggcacttacattaaatctgctttgttagtttgctcatacaggtgacccactttcttttatactgctgctgaaatcattttctttcagaaggttcttcctcacccactaaagtacaggctcctaaagggaaaagactttgccttatccaagttaccaaatttcctatgtatactccagctatggatcatggttatgtttaataaagccttctttgcttccagagtcttccctaatcctgtttcttctaaatgtattgctggacaggttggaggttttgtgaatctctctgggtgacaacaacagtcctgaacactgagtcactgccttagtaatgcacccactctcttccttgttttggggtataataaaatccagtaacttgtttctgaagttgactctgttattgtttttaatcctcacaaatgtttctataa

SEQ ID NO: 462516 - DNA, 640 bp, Homo sapiens
gaaggtgtagatggggaatgcttgccaggatcccctttgataactgagttggctttcaacatgcagagagccaagcagataaaaggcttcaatggaaaagaatcttctccaggtggcaagaacaagagcagagaccaacagatccactgggaagctaccatggaggcccacgcaggaggtgatggaagattcacgagggtgttagccatggaggtctggtgaaccgtgtgctttcttgggacatctggagtttcctgtccagcatcagttatgctcgctacttggtgcatccgattctgatcatcctttacaatggccttcaggaaacacttattcaccacactgacaccaacatgttctatcttttctctggacaccgtgtgctgaccttcgtcactgggctggccctgacgctgttcattgagaaaccatgtcaggaactgaagcagcacctgctgggccatgaatgttctggttaaaacacaaaagaatggatgggccttgttggtaatgacgagcaaagatgaggtggccttatctaggtgatgaatgcttgtattcccgagaaggggtgtgaatctcattttgtgaaagtttaatatatacattttctttgcatttaatatgtgaaagagttctt

SEQ ID NO: 462517 - DNA, 755 bp, Homo sapiens
gaaggtgtagatggggaatgcttgccaggatcccctttgataactgagttggctttcaacatgcagagagccaagcagataaaaggcttcaatggaaaagaatcttctccaggtggcaagaacaagagcagagaccaacagatccactgggaagctaccatggaggcccacgcaggaggtgatggaagattcacgagggtgttagccatggaggaaaagttcacagacttaggcacagaatgcaatgggagcatcgatgggatgatgggcatcttcactggcccagagacaggctgtggcttcatgcatcagtgcttgttccctccaggtctggtgaaccgtgtgctttcttgggacatctggagtttcctgtccagcatcagttatgctcgctacttggtgcatccgattctgatcatcctttacaatggccttcaggaaacacttattcaccacactgacaccaacatgttctatcttttctctggacaccgtgtgctgaccttcgtcactgggctggccctgacgctgttcattgagaaaccatgtcaggaactgaagcagcacctgctgggccatgaatgttctggttaaaacacaaaagaatggatgggccttgttggtaatgacgagcaaagatgaggtggccttatctaggtgatgaatgcttgtattcccgagaaggggtgtgaatctcattttgtgaaagtttaatatatacattttctttgcatttaatatgtgaaagagttctt

SEQ ID NO: 462518 - DNA, 787 bp, Homo sapiens
ggcatttttttgtgtgtgcttttaataagagctattcatgagctcttcaagattgggccttgccctttgtattttcatttctggagcctggaatatcactcagcacaaagtatatactcaataaaggttttcctggccagatcagcctccccaactagactgtgagcgccttaaagcaggaattgttataattattttcactgccaaactcggcatctggcatatcgtatgcactcagggaatgtctacggaatgaatgaacttaaggataatacacgtgacggaatgttaaaatggaagttttggctgagatctaaagatgacagatataagataccaaagtgaactggaaacagaccaccctgaagaatgtgcaagaagggtgcctgaggacccattaatcaactcttaaacctttcattgatgtggaaggtcagacagagatggatttttaggaaagagctgttggtttactgcacatcaggcctccttccagggtgaagtatgaagagatcctctcccttcaggagtcaggaagacacagaccagcagagaatctgctgcatgtccctgaggttgtggcacatggtggcttgtatgtgactcctgtctggaagagacaggctggctgacagctgcagtgtaaaagtgaagtagaggttaccctgggatcaaccagcactgccagagtctgtccagatccaaaagacaaaggtttcccatagaccccaagtggcccatgtatgagagagctgccaggggttctcagatcctgtccaacatggcc

SEQ ID NO: 462519 - DNA, 2173 bp, Homo sapiens
ggcatttttttgtgtgtgcttttaataagagctattcatgagctcttcaagattgggccttgccctttgtattttcatttctggagcctggaatatcactcagcacaaagtatatactcaataaaggttttcctggccaggctcataggtggaaaggacttgccttgtcccagatgagactttggaccatggacttatgagttgatgctgaaattagttaagactttgggggactattgggaaggtgtgattggttttgaaatgtgaggacatgagatttggcagcagccaggtgtggaatgatatggtttggctctgtgtccccacccaaatctcatcttgaattgtattcccataattcccacgtgttgggggagggacgcagtgggagataattaaatcattggggcagtctaccccatactgttttcatggcaatgaataaatctcacgagatctgatggttttatcaagggtttccgcttttggaacttcctcattctctctttgcctgctgctattcttgtaaggtgggacttgacttgctcctctttgccttccgccatgattatgaggctccccaggccacatggaactaaggaggaggtgctgatgagagcccatttaggcgtatatcatgcaccactgccttatggagagtcctggacagaactggacctgatggaagggaaagatctgatgggaggagaaggtcctggaatctcagtgatgcaacagccagacccagtgtcacatccattgggggttatgtgggttgaagagctccttctgcctaagtgtgccaagtattggagtcaggggtatccacattactccagcccctttaagtacacctggcatactcgctggacttcatacaaaaagacactactatcatcagcattttgtctggaagatgatagagaccaaatgaaagatgggattggcgagtctaagatgagactggaagcaatagtcaggcagagggatggaggcaaaaaggctagccaagaagctgttagatgtggtaagaacctagactccaagagtggaagaggtgaaggtgtatgggaagatgccaccctagatttagatgcagggtggaaggatttggctgaatatatttgcagaatatatgatttgatgactagtatcttgcagagttatctaatggatggttacataaacatctttgcctgtctgagggacagtagcagtgacaagaagaagattaagggtggaggctttagttcctccacaatttctgctgactttacctctcaattctctgatctaaacagttcacatttcctatgcaaagggcttcggtgagggtgtgcacaaggaggggaagtaagttggagaggcgtgatattcttggcctgatatacattactagggagtttcctacatggaatacaggatagagaaggaagacttcaaagttagaatggatggaaatactaaatttaaaaatataacaaagaaatgcatgattgtattattagttaataattaattattagttaataattagttaatgtgacacttgctatcccgttagtttgacccatggtctggagctacaatttaatttaactgaagggacaactttcagttgaaatttcttatatttccaagtagaggtctttttgagcctatttctaatgactagtttaaacattgataattagcaacattcattcgtaaggcaataatttctatagcagtgaatatcattttaattctgtaattagataaccaaaattttaataataggagctatcaatttgctgaataaaccttccaacagataatatgaaagaaaaacatctatacaactcaggtgaaaacatgatgatttggttaattaaccttcgaaatactgtggttgttccattatgtgcaataaaatgctttgtaaaaaacttgtctaaaggagtaagtctgggaaatgcttcacaggtaatttttctctaggaagctcacaatgcacatgagtatattacaagattagtataagatattctgtagtaacaagacatatttaactcagtgtttcccaaacttagttggccatggctcttttttaaaaatgaaatctagtgttattttggtaaatagtgttggctgattatacaaaagccattccctccctccctttttaacagaa

SEQ ID NO: 462520 - DNA, 2793 bp, Homo sapiens
gtccccgcggccgctggatgtgggtgggccggcagccgggactccgggcgtcctgtcccgtccctgcccgtcgactgcggccttggccccgaagcccttttgtgcagctccgcgcccgcagcccgacgccccagcttgtgcgggggccacgggagggtcatgcgcggatttcgactcgggtgtggatttcgtccgtaggaggagcagcggtctgtggggcccacagcctccactttctcctgttaaaaattatactgagatgtttcaggacccagtggcttttaaggatgtggctgtgaacttcacccaggaggagtgggctttgctggatatttcccagaagaatctctacagggaagtgatgctggaaactttctggaacctgacctctataggaaaaaagtggaaagaccagaacattgaatatgagtaccaaaaccccaggagaaacttcaggagtgtcacagaagagaaagtcaatgaaattaaagaagacagtcattgtggagaaacttttaccccagttccagatgacaggctgaacttccagaagaagaaagcttctcctgaagtaaaatcatgtgacagctttgtgtgtgaagttggcctaggtaactcatcttctaatatgaacatcagaggtgacactggacacaaggcatgtgaatgtcaggaatatggaccaaagccatggaagagtcaacaacctaaaaaagccttcagatatcacccctccttgagaacacaagaaagggatcacactggaaagaaaccctatgcttgtaaagaatgtggaaaaaacattatttaccattcaagcattcaaagacacatggtagtgcacagtggggatggaccttataaatgtaagttttgtgggaaagcattccattgtctcagtttatatcttatccatgaaagaactcacactggagagaaaccgtatgaatgtaaacaatgtggtaaatcttttagttattctgctacccatcgaatacatgaaagaactcacattggagaaaagccttatgaatgtcaggaatgtgggaaagcattccatagtcccagatcctgtcacagacatgaaaggagtcacatgggagagaaggcttatcaatgtaaggaatgtggaaaagcattcatgtgtccccgttatgttcgtagacatgaaaggacccactctaggaaaaaactttatgaatgtaagcagtgtgggaaagcattatcctctcttacaagttttcaaacacacataagaatgcactctggagaaagaccttatgaatgtaagacatgtgggaaaggcttttattctgccaagtcatttcaaagacatgaaaaaactcacagtggagagaaaccgtataaatgcaagcaatgtggtaaagccttcactcgttccggttcctttcgatatcatgaaaggactcacactggagagaaaccctatgagtgtaagcaatgtgggaaagccttcagatctgccccaaatcttcaattgcatggtaggactcacactggagagaaaccgtatcaatgtaaggaatgtgggaaagctttcagatctgcctcacaacttcgaatccatcgtaggattcacactggagagaaaccctatgaatgtaagaaatgtgggaaagccttcagatatgtccagaactttcgatttcatgaaaggacacaaacacataagaatgcactctggagaaagaccttataaatataagatatatgggaaacacttttattctgccaagttatttcaaacacatgaaaaaattcacactggagagaaaccctataaatgcaagcaatgtggtaaagccttaattgttccagttcctttcgatatctaaaaggactcacagtggagaaaaactctatgagtgtaagcaatgtgggaaagtcttcagatctgtcaagaacctttcaatttatgaaaggacacacactggagagaaaccctatgaatgtaagaaatgtggaaaagcgttccataatttctcttcttttcaaatacatgaaagttgcacagaggagaggcgccctaagaatgtaagcattgtgggaaagcattcatatctgccaagatcgtttgaatacatgcaaaacacacactggagagaaacctatgaatgtaaggaatgcaaacaagcattcaattatttttcttccttgcatatacatgaaaggactcatacgagagagaatccgtatgaatgtaaggattgtgggaaagcattcagcttgcttaattgctttcatagacatgtaaagacacaccagaaggaaaccctatgaatgtaagcaatgtggcaaaagctttcacttcttccagttcttttcaatatcatgaaaggactcacactggggagaaaccgtatcaatgtaagcaatgtgggaaagccgtcagatcagcctcaagacttcaaatgcatggaagcactcacacttggcagaaactctatgaatgtaagcagtatgggaaagccttcagatcggctaggattctttgaatacaaataatgaatgtaaacaattaactgtttataataactgtatactaacaaatgttattctttttaaataattaagaagctataataaaatatccattggtgtcatgtattagatcaagcttataatgttacattgttattatttggatattgtgaatcagcattacctggattaaatgccaggcatatttttcctcatgtaaactttacttttcatgcttatgtactttaatttttatttcaactgtaatttttctttttttttccttttgct

SEQ ID NO: 462521 - DNA, 529 bp, Homo sapiens
gtccccgcggccgctggatgtgggtgggccggcagccgggactccgggcgtcctgtcccgtccctgcccgtcgactgcggccttggccccgaagcccttttgtgcagctccgcgcccgcagcccgacgccccagcttgtgcgggggccacgggagggtcatgcgcggatttcgactcgggtgtggatttcgtccgtaggaggagcagcggtctgtggggcccacagcctccactttctcctgttaaaaattatactgaggtacgttaacaaaaagttcatttgaggaaacagccattcacgaatgagaaacacccggtcctggcttgtggtttgtcaacggaaaaaaaacagactatgtaaaatacagaagtgtattcagagccgagtaggagagaccttggccgagggaaacacaaccccaagcagcctggagtaagtggtccggagcggctcaggacagtttggttttattcatttcagagagacaggaattgcagggaaaatgatggatcaaggctggaaggtgta

SEQ ID NO: 462522 - DNA, 434 bp, Homo sapiens
gtccccgcggccgctggatgtgggtgggccggcagccgggactccgggcgtcctgtcccgtccctgcccgtcgactgcggccttggccccgaagcccttttgtgcagctccgcgcccgcagcccgacgccccagcttgtgcgggggccacgggagggtcatgcgcggatttcgactcgggtgtggatttcgtccgtaggaggagcagcggtctgtggggcccacagcctccactttctcctgttaaaaattatactgaggtacgttaacaaaaagttcatttgaggaaacagccattcacgaatgagaaacacccggtcctggcttgtggtttgtcaacggaaaaaaaacagactatgtaaaatacagaagttgcagcccagccgaggatgcgccactgcactccagcctgggtaacagagtgagaccccatct

SEQ ID NO: 462523 - DNA, 379 bp, Homo sapiens
attcctgccgtcacctttgtcgctgcgagggcggcggttgggatctggcctttccagccccgagagggacctagtgcctctacccagatttctgtcgctctgtcacctgcgctatgccctgctttactcacaggagctgtagagaggaccccggtacatctgaaagccgggaaatggtgcggctcctggagttcccagtgcgtcaacaccggcctgaggagctggcctagtacttcccaccattgaaactgcagtctggacagcagagaaaggatagacccatcacacccgagtcaagaaagcaccgccacccccaaagtcgtaggccattattccaggggaaaaccccctcaaactaaagctaagaaaaatttaacct

SEQ ID NO: 462524 - DNA, 2417 bp, Homo sapiens
attcctgccgtcacctttgtcgctgcgagggcggcggttgggatctggcctttccagccccgagagggacctagtgcctctacccagatttctgtcgctctgtcacctgcgctatgccctgctttactcacaggagctgtagagaggaccccggtacatctgaaagccgggaaatggaaaaaagtggaaagaccagaacattgaatatgagtaccaaaaccccaggagaaacttcaggagtgtcacagaagagaaagtcaatgaaattaaagaagacagtcattgtggagaaacttttaccccagttccagatgacaggctgaacttccagaagaagaaagcttctcctgaagtaaaatcatgtgacagctttgtgtgtgaagttggcctaggtaactcatcttctaatatgaacatcagaggtgacactggacacaaggcatgtgaatgtcaggaatatggaccaaagccatggaagagtcaacaacctaaaaaagccttcagatatcacccctccttgagaacacaagaaagggatcacactggaaagaaaccctatgcttgtaaagaatgtggaaaaaacattatttaccattcaagcattcaaagacacatggtagtgcacagtggggatggaccttataaatgtaagttttgtgggaaagcattccattgtctcagtttatatcttatccatgaaagaactcacactggagagaaaccgtatgaatgtaaacaatgtggtaaatcttttagttattctgctacccatcgaatacatgaaagaactcacattggagaaaagccttatgaatgtcaggaatgtgggaaagcattccatagtcccagatcctgtcacagacatgaaaggagtcacatgggagagaaggcttatcaatgtaaggaatgtggaaaagcattcatgtgtccccgttatgttcgtagacatgaaaggacccactctaggaaaaaactttatgaatgtaagcagtgtgggaaagcattatcctctcttacaagttttcaaacacacataagaatgcactctggagaaagaccttatgaatgtaagacatgtgggaaaggcttttattctgccaagtcatttcaaagacatgaaaaaactcacagtggagagaaaccgtataaatgcaagcaatgtggtaaagccttcactcgttccggttcctttcgatatcatgaaaggactcacactggagagaaaccctatgagtgtaagcaatgtgggaaagccttcagatctgccccaaatcttcaattgcatggtaggactcacactggagagaaaccgtatcaatgtaaggaatgtgggaaagctttcagatctgcctcacaacttcgaatccatcgtaggattcacactggagagaaaccctatgaatgtaagaaatgtgggaaagccttcagatatgtccagaactttcgatttcatgaaaggacacaaacacataagaatgcactctggagaaagaccttataaatataagatatatgggaaacacttttattctgccaagttatttcaaacacatgaaaaaattcacactggagagaaaccctataaatgcaagcaatgtggtaaagccttaattgttccagttcctttcgatatctaaaaggactcacagtggagaaaaactctatgagtgtaagcaatgtgggaaagtcttcagatctgtcaagaacctttcaatttatgaaaggacacacactggagagaaaccctatgaatgtaagaaatgtggaaaagcgttccataatttctcttcttttcaaatacatgaaagttgcacagaggagaggcgccctaagaatgtaagcattgtgggaaagcattcatatctgccaagatcgtttgaatacatgcaaaacacacactggagagaaacctatgaatgtaaggaatgcaaacaagcattcaattatttttcttccttgcatatacatgaaaggactcatacgagagagaatccgtatgaatgtaaggattgtgggaaagcattcagcttgcttaattgctttcatagacatgtaaagacacaccagaaggaaaccctatgaatgtaagcaatgtggcaaaagctttcacttcttccagttcttttcaatatcatgaaaggactcacactggggagaaaccgtatcaatgtaagcaatgtgggaaagccgtcagatcagcctcaagacttcaaatgcatggaagcactcacacttggcagaaactctatgaatgtaagcagtatgggaaagccttcagatcggctaggattctttgaatacaaataatgaatgtaaacaattaactgtttataataactgtatactaacaaatgttattctttttaaataattaagaagctataataaaatatccattggtgtcatgtattagatca

SEQ ID NO: 462525 - DNA, 2636 bp, Homo sapiens
gtccccgcggccgctggatgtgggtgggccggcagccgggactccgggcgtcctgtcccgtccctgcccgtcgactgcggccttggccccgaagcccttttgtgcagctccgcgcccgcagcccgacgccccagcttgtgcgggggccacgggagggtcatgcgcggatttcgactcgggtgtggatttcgtccgtaggaggagcagcggtctgtggggcccacagcctccactttctcctgttaaaaattatactgagatgtttcaggacccagtggcttttaaggatgtggctgtgaacttcacccaggaggagtgggctttgctggatatttcccagaagaatctctacagggaagtgatgctggaaactttctggaacctgacctctataggaaaaaagtggaaagaccagaacattgaatatgagtaccaaaaccccaggagaaacttcaggagtgtcacagaagagaaagtcaatgaaattaaagaagacagtcattgtggagaaacttttaccccagttccagatgacaggctgaacttccagaagaagaaagcttctcctgaagtaaaatcatgtgacagctttgtgtgtgaagttggcctaggtaactcatcttctaatatgaacatcagaggtgacactggacacaaggcatgtgaatgtcaggaatatggaccaaagccatggaagagtcaacaacctaaaaaagccttcagatatcacccctccttgagaacacaagaaagggatcacactggaaagaaaccctatgcttgtaaagaatgtggaaaaaacattatttaccattcaagcattcaaagacacatggtagtgcacagtggggatggaccttataaatgtaagttttgtgggaaagcattccattgtctcagtttatatcttatccatgaaagaactcacactggagagaaaccgtatgaatgtaaacaatgtggtaaatcttttagttattctgctacccatcgaatacatgaaagaactcacattggagaaaagccttatgaatgtcaggaatgtgggaaagcattccatagtcccagatcctgtcacagacatgaaaggagtcacatgggagagaaggcttatcaatgtaaggaatgtggaaaagcattcatgtgtccccgttatgttcgtagacatgaaaggacccactctaggaaaaaactttatgaatgtaagcagtgtgggaaagcattatcctctcttacaagttttcaaacacacataagaatgcactctggagaaagaccttatgaatgtaagacatgtgggaaaggcttttattctgccaagtcatttcaaagacatgaaaaaactcacagtggagagaaaccgtataaatgcaagcaatgtggtaaagccttcactcgttccggttcctttcgatatcatgaaaggactcacactggagagaaaccctatgagtgtaagcaatgtgggaaagccttcagatctgccccaaatcttcaattgcatggtaggactcacactggagagaaaccgtatcaatgtaaggaatgtgggaaagctttcagatctgcctcacaacttcgaatccatcgtaggattcacactggagagaaaccctatgaatgtaagaaatgtgggaaagccttcagatatgtccagaactttcgatttcatgaaaggacacaaacacataagaatgcactctggagaaagaccttataaatataagatatatgggaaacacttttattctgccaagttatttcaaacacatgaaaaaattcacactggagagaaaccctataaatgcaagcaatgtggtaaagccttaattgttccagttcctttcgatatctaaaaggactcacagtggagaaaaactctatgagtgtaagcaatgtgggaaagtcttcagatctgtcaagaacctttcaatttatgaaaggacacacactggagagaaaccctatgaatgtaagaaatgtggaaaagcgttccataatttctcttcttttcaaatacatgaaagttgcacagaggagaggcgccctaagaatgtaagcattgtgggaaagcattcatatctgccaagatcgtttgaatacatgcaaaacacacactggagagaaacctatgaatgtaaggaatgcaaacaagcattcaattatttttcttccttgcatatacatgaaaggactcatacgagagagaatccgtatgaatgtaaggattgtgggaaagcattcagcttgcttaattgctttcatagacatgtaaagacacaccagaaggaaaccctatgaatgtaagcaatgtggcaaaagctttcacttcttccagttcttttcaatatcatgaaaggactcacactggggagaaaccgtatcaatgtaagcaatgtgggaaagccgtcagatcagcctcaagacttcaaatgcatggaagcactcacacttggcagaaactctatgaatgtaagcagtatgggaaagccttcagatcggctaggattctttgaatacaaataatgaatgtaaacaattaactgtttataataactgtatactaacaaatgttattctttttaaataattaagaagctataataaaatatccattggtgtcatgtattagatca

SEQ ID NO: 462526 - DNA, 2575 bp, Homo sapiens
cactgagatgccctatttaaatgacagaaactaagaaaccatctctacatctgctcaaagcttcgtgcaggtgctcacgcggatgcgtccaggctccaaattatcaacaccatgtaatggattctctacctgtcggaggaggccagcggtctgtggggcccacagcctccactttctcctgttaaaaattatactgagatgtttcaggacccagtggcttttaaggatgtggctgtgaacttcacccaggaggagtgggctttgctggatatttcccagaagaatctctacagggaagtgatgctggaaactttctggaacctgacctctataggaaaaaagtggaaagaccagaacattgaatatgagtaccaaaaccccaggagaaacttcaggagtgtcacagaagagaaagtcaatgaaattaaagaagacagtcattgtggagaaacttttaccccagttccagatgacaggctgaacttccagaagaagaaagcttctcctgaagtaaaatcatgtgacagctttgtgtgtgaagttggcctaggtaactcatcttctaatatgaacatcagaggtgacactggacacaaggcatgtgaatgtcaggaatatggaccaaagccatggaagagtcaacaacctaaaaaagccttcagatatcacccctccttgagaacacaagaaagggatcacactggaaagaaaccctatgcttgtaaagaatgtggaaaaaacattatttaccattcaagcattcaaagacacatggtagtgcacagtggggatggaccttataaatgtaagttttgtgggaaagcattccattgtctcagtttatatcttatccatgaaagaactcacactggagagaaaccgtatgaatgtaaacaatgtggtaaatcttttagttattctgctacccatcgaatacatgaaagaactcacattggagaaaagccttatgaatgtcaggaatgtgggaaagcattccatagtcccagatcctgtcacagacatgaaaggagtcacatgggagagaaggcttatcaatgtaaggaatgtggaaaagcattcatgtgtccccgttatgttcgtagacatgaaaggacccactctaggaaaaaactttatgaatgtaagcagtgtgggaaagcattatcctctcttacaagttttcaaacacacataagaatgcactctggagaaagaccttatgaatgtaagacatgtgggaaaggcttttattctgccaagtcatttcaaagacatgaaaaaactcacagtggagagaaaccgtataaatgcaagcaatgtggtaaagccttcactcgttccggttcctttcgatatcatgaaaggactcacactggagagaaaccctatgagtgtaagcaatgtgggaaagccttcagatctgccccaaatcttcaattgcatggtaggactcacactggagagaaaccgtatcaatgtaaggaatgtgggaaagctttcagatctgcctcacaacttcgaatccatcgtaggattcacactggagagaaaccctatgaatgtaagaaatgtgggaaagccttcagatatgtccagaactttcgatttcatgaaaggacacaaacacataagaatgcactctggagaaagaccttataaatataagatatatgggaaacacttttattctgccaagttatttcaaacacatgaaaaaattcacactggagagaaaccctataaatgcaagcaatgtggtaaagccttaattgttccagttcctttcgatatctaaaaggactcacagtggagaaaaactctatgagtgtaagcaatgtgggaaagtcttcagatctgtcaagaacctttcaatttatgaaaggacacacactggagagaaaccctatgaatgtaagaaatgtggaaaagcgttccataatttctcttcttttcaaatacatgaaagttgcacagaggagaggcgccctaagaatgtaagcattgtgggaaagcattcatatctgccaagatcgtttgaatacatgcaaaacacacactggagagaaacctatgaatgtaaggaatgcaaacaagcattcaattatttttcttccttgcatatacatgaaaggactcatacgagagagaatccgtatgaatgtaaggattgtgggaaagcattcagcttgcttaattgctttcatagacatgtaaagacacaccagaaggaaaccctatgaatgtaagcaatgtggcaaaagctttcacttcttccagttcttttcaatatcatgaaaggactcacactggggagaaaccgtatcaatgtaagcaatgtgggaaagccgtcagatcagcctcaagacttcaaatgcatggaagcactcacacttggcagaaactctatgaatgtaagcagtatgggaaagccttcagatcggctaggattctttgaatacaaataatgaatgtaaacaattaactgtttataataactgtatactaacaaatgttattctttttaaataattaagaagctataataaaatatccattggtgtcatgtattagatca

SEQ ID NO: 462527 - DNA, 3406 bp, Homo sapiens
acctggctttgctgtgactgcttccccgagtgtccatcaggacagcttcacctccttgaggattaaagcctaacagtactgagctatttgtctgtcaaaatgtctgcaaaattgggaaagtcatcatcactcctaacacaaacttcagaggagtgtaatgggattctgacagagaagatggaagaggaagagcagacctgtgatccagactctagcctccactggagcagcagctacagcccagagaccttccgccagcaattcaggcagtttggctaccaggattcacctgggccccatgaggctctgagccggctctgggaactttgtcatctctggctgaggccggaagtgcacaccaaggagcagatcctggagctgctggtgctggagcagttcctggccatcctcccaaaagagcttcaggcctgggtgcagaagcatcatccagagaatggagaggaaactgtgactatgctggaggatgtggagagagagcttgatggaccaaagcagatcttttttggacgaaggaaggacatgattgcagagaagctagcaccttcagaaatcactgaggaattgccaagtagccagctcatgcccgtgaagaagcagctccagggagcatcatgggagcttcagtccttaagaccacatgatgaagacatcaaaactacaaatgtgaaatctgcttcaaggcaaaagacttctttaggcatagaactgcattgcaatgtttccaatatccttcatatgaatggctcccagagttccacatatagaggaacctatgaacaagatggtaggtttgaaaagagacaaggaaacccttcttggaaaaaacaacagaaatgtgatgaatgtggcaaaatctttagtcagagctcagcccttattttacatcagagaatccacagtggaaagaaaccttatgcatgtgacgagtgtgcaaaggcattcagccgaagcgcaattctgattcagcatcgacgaacccatactggtgagaagccctacaagtgtcatgactgtggcaaagcctttagtcagagctcaaatctttttagacataggaaaagacacattagaaaaaaagtcccataagtatcatgagggaatcaaagcatttactcagagctatttcagcacaagggaagacaccagatgcaaacgctccttagtacaaatcagtggtcttagtaagcaccagtctcctttcaagactcatgaaagccacaggagagaaggttgaagatctcaggaggcagataaataaaggccttatcttatgaaagcacacaagagcctccatactattaatatcaagttaatttcccgtgttggaaaaaaataatctcctttgcaatgtaatttggaaataagtcaatggaaacatgaaaatgactgcttgtctacaaggagtcagctaaacataaggaatgttttcataacaatattaatctatgggtgcttctgtaagatggatgatcatcttaatataaagaaaaaagggagatgaacaaaattgtcaaacaagactgatgtaccacaagtgttgtcaagtacagtgtgtgtcggagagatgtaccacagcttaattggaagaggaagcccgtaactgctgatgacaatactttcagtgtccccttttctggcataaatcaactatgaatatgtttcaagcatcacaagacaaccttttcagagtcttctgtattcttagtaagatgagtttctagacacgctgtcatgaaatgagaccctggattttgatgctcttgtacatatggacaaatcactgaagttcaatttaaagggtccactgcagtcccttataaacaattgttgaacctaaccattatagtttataagttttaagacatttatgggatatcttatttggcttatctatgggatatgagtaactatgttttacctgcatttaattcagccagattccctgtttaaaaataaaattactgaatcgtacattattaaaattattctgacagtatacaaacaacaaaattatctattttccagagattcttgataaaactctgtaatgttactacaataatacatgtattgtgttttccatggtgctacagttacacaatatggaggcaaacatcagaaatcaaagtccttggaataagggaagagactcatagtaaacttctttgtctggttgggttcctcataaagtataaaacatttcattctcagaaaatccaaccatatcttagagtatctccagaaactggcttagaggagctccaaatatgtggaattaccacactctgcttagttagtatgctgataaatgtaagattagtaggaggagaagtgaatgtaaattttattatagaattttctgatagtgattatgatttgtagctctagtgaatatgaattttatattgagttgtgtgtatcttgagtcactaaaaatgtaggatactttttatttggggctcattgtctttgtaattacggagaggaacaaaccatctattgaaacaacaagtgcctcagagatgtatatattgtgaattactgcttaattacggaaagagtttcttaggttctatgtgaataagatggcagaatctaaatcaagtattttgaaggaagcacccatcttcacttggtgctgccatcaactttgtaagattgcattctatttattgtgaataatttgagtgtttccacaggaaagtggtatgaatcatatcgtctaagtatatgatgaatctttaaagggtgtctctgtgtactttgaattattttgcagttatgtaggtatcctaatgagtgaatggtactagtttatataaaaggagaattcattgagctaaccttggttttaaaaattagcattagcacccccattatattaattttcagggatagtaaatactccaaaatgaaattggtattgttttctggctttcacttcatctgggccttcaagattaccaataatcctatatggtttgtttgtttttgtttgtttttgtttaccactcccattctcttcagagaccaagtcaaatgttcatcactgtccttacaacagtggcttaaaacagcaagcctttgtgttaggaatgcttctggatgcaaaatccatctttggtggtttaaacaaataggaattttcaacctgaaatctggaaggtgggttgctggctctcaatctgcagctggaatgacgactggtctaactttacctcatgctattttgtccgattttcgagagagctgtcacagctctaggaactaggattaagtcaggaagaaaggagaaagacagccatgctaagcaaaaagctttccaaaaaccttagcaaaatctggcttatgtttccctgttgcaactgtgtctgttagggcaagc

SEQ ID NO: 462528 - DNA, 2388 bp, Homo sapiens
tgagtcttttgtgggcagcatacagtatgctttttaagaaaccactgaggcattctatggatttttctttagaatgtggcaaagcctttaagtactcctgtacccttactacacataagataattcatactggagagaaatcccacaaatgtgaggagtgtggcaaagcctttaactggtcctcacagcttgctattcataagataactcatactggagagcaaccctacaaacgtaaagaatgcagcaaagcttttaaccatcccacaaccccttcttcacataagaaaactcatactggagagaaaccatgcaagtgtgataaatgtggcaaagcctttattttttcctcaacccttagtaaacatgagaagattcatactggagagaaaccctacaaatgtgaagaatgtggcaaagccttcagatggtcctcacacctaactacacataagataactcatactggagagaaaccctacaaatgtgaagaatgtggcaatggctttaagtattcctctacgcttactgaacataagataatccatactggagagaaatcctacaaatgtgaagagtgtggcaaagcctttaactggccctcacagcttgctattcataagataactcatactggagagcaaccctacaaatgtaaagaatgtggcaaagcttttaaacatcctgcaaccctttcttcacataacaaaactcatactggagagaaaccatacaagtgtgataaatgtggcaaagcctttatttcatcctcaacccttagtaaacatgagaagattcatactggagagaaaccctacaaatgtgaagaatatggcaaagctttcacccattcctcacaccttactaggcataagaaaattcatgctggagagaaaccatacaagtgtgataaatgtggcacagcctttattttatcctcaacccttagtgaacatgagaagattcatactggagagaaactctacaaatgtgaagaatgtggcaaagccttcaaccatttttcacaccttactatacataagacaattcatactggagagaaatgctataaatggagaactcatactggagagaaaccttacaaatgtgaagaatgtggcaaagcctttactgcatcctcaactctaagtgaatataagacaattcatactggagagaaaccttgcaaatgtgaagaatgtggcaaagcttttaactggtcctcagacttcaataaacataagagaattcatagtggacagaaaccaatactagacatggcaataattcatgctgaagaggaactctacaaacctgaaagatgtgacagtgctgttcccaacacctccaacgtttctatacataaaaaaattatactagtgtgaaactgtagaaaagtataaaatgtgacaaagcctttatttggttgccacacttgataaatataaaaataaaaaattgtttaaaattatttgtatatagctttaaaaggagatttttggaagcattgtaattacattaaaagtatacttgttttcttgaaaaaaagtttttcaaaagtgaataatgatgtcatacagctttcaaattactttatgctgttattttattcctattcacatgtgaaaacatatgagcaatttttgctgcatcagagataccagagattctttttttattgggcattatttataaccttttctataaaagtaaggacactaaaatgtaagatgcatgatgaaaagataagtggagaggctcattgtagttaacctatattaagtaatgtataagctaggtgttcagactattttctacattatggtggaattgttaattatagttaaaagtatattaaaataagtatattattaattgtacttttatgtaataaaatgcagtatatttaaaaatcattagattatgtgcaaacttaattttatttttttaacatgttaagactattgtgcatttaatgaagcattattccactaactttaacctatcccaccttactcaagggtgtaggtaaaagatggtagcaacatactatttggtacatagtgaaataacatctctagtaatcactttgcgagtggctttaaacagcaaatgaatttaagaatattgtttccataggttagatttttattcttttttcttattgaaatttattattggtatttgtgggtatatagtatgtgtatatatttatgccttatatggcatattttcattcaggcctacaatgtgtagtaattacattagggtaaataaggtatccatcacctctaacatttatactttttattacaaacagtgtaattatatactttaattattttaaaatgtacaattaaattgttattaactacattgttattttta

SEQ ID NO: 462529 - DNA, 783 bp, Homo sapiens
cctccactgggggttccctcctatgaccagaagccattcttcccacaggttttgtttctggaaggcaacccgctcttacttacagtatagggggaagaagttcaaggacagaaaaagccctcctaaatctacggacaagtatcctttctcgagtggaggccaaggtggtagacagcagcctctgaatgacaggcttggtgtccttgccagccaagtcacttctcaggcctgtttccagacttgtccttccaacagggacttgaagctgcccaggaattatttgcccgtcccagtgcccagaagacaaaccagatactttgaagctctttacactggaaaagcaatgcatggcttcagagtttataaggccttggggaagaaggtcctggtaccatcttccccagaaacgatcaagaagggcaatgggttgacagcccagatatggcaggaccagactgcaatgggaatctcatacagcccattcagactaaagggtgatggaaagaagcagaggaaagcagaaacagcaagagtgactgagacctgctgtcatctatatagaagcctttctgatacatgtcagagagtgacatgaagtctcccctctttatacacacgtatgaaaatacatctatccctcattttgagagcctccaactgatccaagtgtcatccggaggaggaggtggcccgtatgtgcaggacctcagggtgccagccctcacccatacacctccagggctgcaggtcattagccagaataaaggatgtccacattcacaa

SEQ ID NO: 462530 - DNA, 1433 bp, Homo sapiens
ctctggaagccgcctcgagtctccaggtgattctgatgatccctgggtcagttctggaatgcgagtgatcgcctctttgcaggtacaaaaatcacggcacagagtaagcaggtcacaggcttgcccagagtctacggctgcaggtgctcaagctaggcctggaaaccaggacctctgtgtcctgtgtccatgtggagtgttcctttgctcacccctcccccacctgtcctcaagggaggagcagtcattgcctaactcggggacagctgactctctcccccagggcacagtgtgctcttcttttcccgtgcaggctgttctcagacgcacaggtactggcccacaggacagagcttccagggtctttcaagttgcatatgtcatcattaaagctgccaatgcccctcgacctggaaactggattttggagcgttctctggatggcaccacgttcagcccctggcagtattatgcagtcagcgactcagagtgtttgtctcgttacaatataactccaagacgagggccacccacctacagggctgatgatgaagtgatctgcacctcctattattccagattggtgccacttgagcatggagagattcatacatcactcatcaatggcagaccaagcgctgacgatctttcacccaagttgttggaattcacttctgcacgatatattcgccttcgcttgcaacgcattagaacgctcaatgcagatctcatgacccttagccaccgggaacctaaagaactggatcctattgttaccagacgcgtgtctccttatgaggatgagccttgccgcccctgtaattgtgaccctgtggggtccctcagttctgtctgtattaaggatgacctccattctgacttacacaatgggaagcagccaggtcagtgcccatgtaaggaaggttatacaggagaaaaatgtgatcgctgccaacttggctataaggattacccgacctgtgtctcctgtgggtgcaacccagtgggcagtgccagtgatgagccctgcacagggccctgtgtttgtaaggaaaacgttgaggggaaggcctgtgatcgctgcaagccaggattctataacttgaaggaaaaaaacccccggggctgctccgagtgcttctgctttggcgtttctgatgtctgcagcagcctctcttggcctgttggtcaggtgggaggcgccatctgcgcggcgggatttaatgagcaggtcgtattgcacaagcttggcacgagctgtgtgaggaggaaatgaggatgacttcccgtgacaccactctcatcgctatgcaatgatactgacgtgggtcaaaggcagccgtctgcctctcaagattctttataggtcatgtgcttactcccacacacatttctctatggaaaaaacaggatgatgtggcactagagaacac

SEQ ID NO: 462531 - DNA, 844 bp, Homo sapiens
cctctatcaggggagccctgaggacccacgcttttgtctaaggggaaccccaaagactcgacctcttctgtgaagaaaggatccaccattttcagtgaggggaaccctggagaccagccctcttctaaatgaatagctgcaaacagagctcaagttgtcatccctgtgggagtgggattatgtctcctggaactctatggagaaaacctctcaaactcactggagcaaacagcacctgtagactcagcgcgggagcgcctcttccctctacagctccacagacatcactgcactcccagcagcacaggcaggagcctgcaccaggaaaagctcagggatgtgctggcccactcctctcctctgacccttgaggacccaggtctaggggggattaagaaatatgccataggaaaaataaatgcaagagctgaatggaactagaatctcttgacaaatcagctcagttcaatacatgtgggtgggatcctgctgttctgctgccctgcccctgtggctgcaacctcagaaggcaaatacccacagggaacagacgcgcccagaacagtgtgaggcaggggttcccctttgggacacatggcctccttccctctccatcccttcctcctggggtttcatggagccccgactgtgtgctgggccctgcggcagctaaggtcaccaggctccaggccctgctcttgcaagagatccagacaagctgcctgggaagtgaacagtgggaagccacacaccaggagaactggagcaggcaggcgtcacggtgcggtgtggggaggggtggacatctgtatgacaacaaaatcctccctctgttttgaatctc

SEQ ID NO: 462532 - DNA, 1166 bp, Homo sapiens
ccttgggcggtcgatgggactgggcgcctcggagcagagggcggcacctgtcagggaggctgggccccacgggagcccacagtgggaggggggctcaggcatggcaggctgcaggtcccaagccctgccccatggggaggcggctgaggcctgtttcctatcaaagctgcaacaaaaacaacagaaatttactaccgttctggagttggcagcacagctgaccctagcctccaccttcactgtcacgctgctctttggctccgaccctcctgccaccccttgtgaatattcagcctggggcctggaatgcaaaggccactggggccaaatcagctgcacggagctgagccagcagagccgcaggcagcagccgccctgtgagcagctgggaaccactgagaagtggagatgtttgtcatagcagcagcagctggcagatacttgctatccacacaccctgggcacacatgggcaccaaggctgggggcgacagaactttacactgtgggattctctcctgacagccaagaagggggttttcccttctaccatgaagaacttccccggaggtctccccacatctaataattaggaagataacgtggtcatcaacaataaaagctgcccaggcaggcgcctgcacaagcctcagatcagaaggtcattcaggcacagcaaatgggccggccctccccatggatgacagcttcttcagtgcctcagagccagtcaagcccccaggcccagaagacaatcgcaggagaccgtagctcctccctgtccccaaggcgctgccggccgggctgccttcagcagccacacagccaaacctgtctcctctcagttcctatttcagcctgagcctgaaactgccaccacacagccccctctgtggatggccccccacacacctcacaccccactacagacctcacaccccactatggcttcagcccctggggatcccctgtgccgctctcagggggctcctcctctctcttccctggctcagacacaggccttagagctggagccggccatgtgctagctgctggggctggcctggaggcccctgtgacaaggaccttaatcccccaggagggccagtgacgctcagccagagctgcccccatggctgtttccccactggcctgtgacccctgggg

SEQ ID NO: 462533 - DNA, 585 bp, Homo sapiens
gcaaggaattctgagggaaggactcataaacataatggcagtctacttctgtggaagaaggaaaaaagtgagagagaaaggcttagatggatggaggatggaggttaaagcaaatatcacagaaataacatgttcaatcttggtagtagggacatggaagtctatttttatttcttctattctgaatgcatatgaaccagtaagattaacattaataattctaactgatggaggaagaccagaaattgtaaaaggatgtggggtccaagatccagaagcaggtaattcctcaaatgacaaaatgaatttatctacatttctaataatgaaatcagcttcatcactggaatgggatcctggtagcagacttctcagtcatcttgcagcaatgtggaatttgtttagctaaagtgacttatgattcattcaacaaatatttacaaagccctaatccacttgcctggaaaatgcccttctctgaaagtcaacctggccccactggattcgaacagacattaacaaccttctgaaagaaaaattaaatgggaagttatcctcagagaagcgttactccctctcacatcc

SEQ ID NO: 462534 - DNA, 4705 bp, Homo sapiens
gcagctctgcgcatgtgcaggaggcgccggagtttcactttgtaacttttaagtggtcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggacttgctgggtaatgaccctcctcacccttgtctatgttgtaatggggcagagtggcagtcctagggaaagggctcactgtggtagaccagaaccccaggagtcatgccccacttcagatgtaagatggtctcagggtgactctgaacatttctatctgattaaagatctggagcaaacctaggctaaaactggggccccaatatcaatgtctggttctatttaaatagggaaaaaagccccccaagatttacagaatcaggggctatcagagagtcttttatactttcctgccctcacccaaattaggaggtcacaattaatggacccagaagatatccatgatacttaattaaaatcagggtgtggcattatatctaagggcaactgcaagaatccaccttccaaaatgccaccatgaatccacttaggatacccagtggttcccaacgttggttttgtaacaacataggatgtttttagttttctcaaaacaaaatgaattcacattatgcctttacctgcaatggaaggttgagaagttatcagggagcattttggtttcaagcagaggccttgatggtgtagctctggaaagaccagtcagacgttgtcttcctgctggtccagacatgctcctcctccccagagctccacaaaccaaggctgattggttacgccccctcctgcttccccacatgaccctggaactaagtatctgtgcttctctgcagacaaagacccgtatagttttgggaggacaacaatagcaaacctacagactgagtgagtatggagcccgtggggataggtgctgatgggtgagatcaaggagaaggcaggtcaggagcccggggcaggccagaggtactccaaagggggccggctggtatctgaaggccccttgcagctagtgagttgttgagctgtgggcatgaacacgccacaggcagacactgttttgccagggttttaagaaacacggagggtcctgtggatctggagttcatttgtcaggacagggatggggacccctctgaagtattcactgtgggctgaggggtgctggccacacaacctctgtgggaggcatctcttgcagtgaagctgttggtcctcagttcagtgcccactgagggtaaccaggccccagctctgcacccccagctccctgcctgggatcccagccctgatggcaggtggtttccctctcagcaatgacctcctttggctgcacaccatctttgctgtcatttacctcttcctcactgtgggtttcatgcggcaccacactcagtccattaagtacaaagaggagaacctgcttcacaggggaggggagcttctgtggcttggttccaggcctgggtcctcctctgatctgctgtgtgaccgcatttgagtcacttcccctctttctcagtctcctgccatgcaaagaaggctcatagagttgctttggaagtggattctttgtacagcctggaagaagacgctgtgtaaatgacatgctttgggggctcccccggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaatcacatggcaggcaagtttgtgaattaatggcagagaaggaatcctggtccccctgggtattttaacctgcatatttgaaactgttgaggagatagagtcttgtctcgattcatggccatcccccttggtttcagttccctgctctctttccttctctgcatatttaatgcctgccctacgtgcctcggattctgaacggcttggcctcggagaggacagcactgtctccgcagcagcagcagcagcagacctatggtgccatccacaacatcagcgggactatccctggacagtgcttgagcgcacacgggcagtgtggctgctgccccccaggaggcctgaggctgggtctcactgctctgaaaagacacaaccagaatggcctgggctcaggcccttggctgagtgggaatgcgttgggactgcccagctgagctatcaggtgcccatcttttctggtcccagcagtggtgaggagagcacaggcagcctcgcccctcccttgctcacccagtttccctccggcacaagcttccagctctgcagctggggtgacatccccagtggtttgtcgccaagaccatgtggtggacttttcgccccccaaactgatgagtccgggagaatatatggagagagagatgtaac

SEQ ID NO: 462535 - DNA, 4461 bp, Homo sapiens
agatggtacacgtccaaaaaaaaaagaaaaaaggctgggacagtgggattacaggtgtgagccactgcgcccagccctaactttattctgaatgtgatttcttagaagcaggacagggctgtgagatgactgtatttacgtacctttcccacacacgtaacttgggcacaaatgtttctagcaacatcagatggagtgctggtattcctttacctcgagtatggtacaggggctaagacgggctctggaatttatatcatgtgagatcctgaaagttatgcaaatttcctgtgcctttatttcctcatatgtgaacaaaaatgtggggatagcgatcgaaccatctcataagagtgtggtgaggatgatatgagacacttcatgcagagccccgaggcctgttccactgctcattaagattcctctgtgtcttggccagtgatgaccagatcctggaatggtgtggggaggacgccatccactacctgtccttccagaggcacatcatcttcctgttggtggtggtcagctttttgtccctgtgtgtcatcctgcctgtcaacctctcaggggacttgctgggtaatgaccctcctcacccttgtctatgttgtaatggggcagagtggcagtcctagggaaagggctcactgtggtagaccagaaccccaggagtcatgccccacttcagatgtaagatggtctcagggtgactctgaacatttctatctgattaaagatctggagcaaacctaggctaaaactggggccccaatatcaatgtctggttctatttaaatagggaaaaaagccccccaagatttacagaatcaggggctatcagagagtcttttatactttcctgccctcacccaaattaggaggtcacaattaatggacccagaagatatccatgatacttaattaaaatcagggtgtggcattatatctaagggcaactgcaagaatccaccttccaaaatgccaccatgaatccacttaggatacccagtggttcccaacgttggttttgtaacaacataggatgtttttagttttctcaaaacaaaatgaattcacattatgcctttacctgcaatggaaggttgagaagttatcagggagcattttggtttcaagcagaggccttgatggtgtagctctggaaagaccagtcagacgttgtcttcctgctggtccagacatgctcctcctccccagagctccacaaaccaaggctgattggttacgccccctcctgcttccccacatgaccctggaactaagtatctgtgcttctctgcagacaaagacccgtatagttttgggaggacaacaatagcaaacctacagactgagtgagtatggagcccgtggggataggtgctgatgggtgagatcaaggagaaggcaggtcaggagcccggggcaggccagaggtactccaaagggggccggctggtatctgaaggccccttgcagctagtgagttgttgagctgtgggcatgaacacgccacaggcagacactgttttgccagggttttaagaaacacggagggtcctgtggatctggagttcatttgtcaggacagggatggggacccctctgaagtattcactgtgggctgaggggtgctggccacacaacctctgtgggaggcatctcttgcagtgaagctgttggtcctcagttcagtgcccactgagggtaaccaggccccagctctgcacccccagctccctgcctgggatcccagccctgatggcaggtggtttccctctcagcaatgacctcctttggctgcacaccatctttgctgtcatttacctcttcctcactgtgggtttcatgcggcaccacactcagtccattaagtacaaagaggagaacctgcttcacaggggaggggagcttctgtggcttggttccaggcctgggtcctcctctgatctgctgtgtgaccgcatttgagtcacttcccctctttctcagtctcctgccatgcaaagaaggctcatagagttgctttggaagtggattctttgtacagcctggaagaagacgctgtgtaaatgacatgctttgggggctcccccggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaatcacatggcaggcaagtttgtgaattaatggcagagaaggaatcctggtccccctgggtattttaacctgcatatttgaaactgttgaggagatagagtcttgtctcgattcatggccatcccccttggtttcagttccctgctctctttccttctctgcatatttaatgcctgccctacgtgcctcggattctgaacggcttggcctcggagaggacagcactgtctccgcagcagcagcagcagcagacctatggtgccatccacaacatcagcgggactatccctggacagtgcttgagcgcacacgggcagtgtggctgctgccccccaggaggcctgaggctgggtctcactgctctgaaaagacacaaccagaatggcctgggctcaggcccttggctgagtgggaatgcgttgggactgcccagctgagctatcaggtgcccatcttttctggtcccagcagtggtgaggagagcacaggcagcctcgcccctcccttgctcacccagtttccctccggcacaagcttccagctctgcagctggggtgacatccccagtggtttgtcgccaagaccatgtggtggacttttcgccccccaaactgatgagtccgggagaatatatggagagagagatgtaac

SEQ ID NO: 462536 - DNA, 3402 bp, Homo sapiens
cacaggagggatggcagctggatgacccgggaccttgagactggatgaatttgcaggcaggaagggggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggacttgctggacaaagacccgtatagttttgggaggacaacaatagcaaacctacagactgagtgagtatggagcccgtggggataggtgctgatgggtgagatcaaggagaaggcaggtcaggagcccggggcaggccagaggtactccaaagggggccggctggtatctgaaggccccttgcagctagtgagttgttgagctgtgggcatgaacacgccacaggcagacactgttttgccagggttttaagaaacacggagggtcctgtggatctggagttcatttgtcaggacagggatggggacccctctgaagtattcactgtgggctgaggggtgctggccacacaacctctgtgggaggcatctcttgcagtgaagctgttggtcctcagttcagtgcccactgagggtaaccaggccccagctctgcacccccagctccctgcctgggatcccagccctgatggcaggtggtttccctctcagcaatgacctcctttggctgcacaccatctttgctgtcatttacctcttcctcactgtgggtttcatgcggcaccacactcagtccattaagtacaaagaggagaacctgcttcacaggggaggggagcttctgtggcttggttccaggcctgggtcctcctctgatctgctgtgtgaccgcatttgagtcacttcccctctttctcagtctcctgccatgcaaagaaggctcatagagttgctttggaagtggattctttgtacagcctggaagaagacgctgtgtaaatgacatgctttgggggctcccccggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaatcacatggcaggcaagtttgtgaattaatggcagagaaggaatcctggtccccctgggtattttaacctgcatatttgaaactgttgaggagatagagtcttgtctcgattcatggccatcccccttggtttcagttccctgctctctttccttctctgcatatttaatgcctgccctacgtgcctcggattctgaacggcttggcctcggagaggacagcactgtctccgcagcagcagcagcagcagacctatggtgccatccacaacatcagcgggactatccctggacagtgcttgagcgcacacgggcagtgtggctgctgccccccaggaggcctgaggctgggtctcactgctctgaaaagacacaaccagaatggcctgggctcaggcccttggctgagtgggaatgcgttgggactgcccagctgagctatcaggtgcccatcttttctggtcccagcagtggtgaggagagcacaggcagcctcgcccctcccttgctcacccagtttccctccggcacaagcttccagctctgcagctggggtgacatccccagtggtttgtcgccaagaccatgtggtggacttttcgccccccaaactgatgagtccgggagaatatatggagagagagatgtaac

SEQ ID NO: 462537 - DNA, 4493 bp, Homo sapiens
tgcctttggctctgccagcactggtgggaacctgcaagaaatttgagccctgaacgtctgccttgtcctgttgtcctgtgctccagggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggacttgctgggtaatgaccctcctcacccttgtctatgttgtaatggggcagagtggcagtcctagggaaagggctcactgtggtagaccagaaccccaggagtcatgccccacttcagatgtaagatggtctcagggtgactctgaacatttctatctgattaaagatctggagcaaacctaggctaaaactggggccccaatatcaatgtctggttctatttaaatagggaaaaaagccccccaagatttacagaatcaggggctatcagagagtcttttatactttcctgccctcacccaaattaggaggtcacaattaatggacccagaagatatccatgatacttaattaaaatcagggtgtggcattatatctaagggcaactgcaagaatccaccttccaaaatgccaccatgaatccacttaggatacccagtggttcccaacgttggttttgtaacaacataggatgtttttagttttctcaaaacaaaatgaattcacattatgcctttacctgcaatggaaggttgagaagttatcagggagcattttggtttcaagcagaggccttgatggtgtagctctggaaagaccagtcagacgttgtcttcctgctggtccagacatgctcctcctccccagagctccacaaaccaaggctgattggttacgccccctcctgcttccccacatgaccctggaactaagtatctgtgcttctctgcagacaaagacccgtatagttttgggaggacaacaatagcaaacctacagactgagtgagtatggagcccgtggggataggtgctgatgggtgagatcaaggagaaggcaggtcaggagcccggggcaggccagaggtactccaaagggggccggctggtatctgaaggccccttgcagctagtgagttgttgagctgtgggcatgaacacgccacaggcagacactgttttgccagggttttaagaaacacggagggtcctgtggatctggagttcatttgtcaggacagggatggggacccctctgaagtattcactgtgggctgaggggtgctggccacacaacctctgtgggaggcatctcttgcagtgaagctgttggtcctcagttcagtgcccactgagggtaaccaggccccagctctgcacccccagctccctgcctgggatcccagccctgatggcaggtggtttccctctcagcaatgacctcctttggctgcacaccatctttgctgtcatttacctcttcctcactgtgggtttcatgcggcaccacactcagtccattaagtacaaagaggagaacctgcttcacaggggaggggagcttctgtggcttggttccaggcctgggtcctcctctgatctgctgtgtgaccgcatttgagtcacttcccctctttctcagtctcctgccatgcaaagaaggctcatagagttgctttggaagtggattctttgtacagcctggaagaagacgctgtgtaaatgacatgctttgggggctcccccggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaatcacatggcaggcaagtttgtgaattaatggcagagaaggaatcctggtccccctgggtattttaacctgcatatttgaaactgttgaggagatagagtcttgtctcgattcatggccatcccccttggtttcagttccctgctctctttccttctctgcatatttaatgcctgccctacgtgcctcggattctgaacggcttggcctcggagaggacagcactgtctccgcagcagcagcagcagcagacctatggtgccatccacaacatcagcgggactatccctggacagtgcttgagcgcacacgggcagtgtggctgctgccccccaggaggcctgaggctgggtctcactgctctgaaaagacacaaccagaatggcctgggctcaggcccttggctgagtgggaatgcgttgggactgcccagctgagctatcaggtgcccatcttttctggtcccagcagtggtgaggagagcacaggcagcctcgcccctcccttgctcacccagtttccctccggcacaagcttccagctctgcagctggggtgacatccccagtggtttgtcgccaagaccatgtggtggacttttcgccccccaaactgatgagtccgggagaatatatggagagagagatgtaac

SEQ ID NO: 462538 - DNA, 677 bp, Homo sapiens
gcagctctgcgcatgtgcaggaggcgccggagtttcactttgtaacttttaagtggtcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctggttggtatctaaggcccagttgtggtcatggc

SEQ ID NO: 462539 - DNA, 673 bp, Homo sapiens
tccagttatttgtggtaactctcttcttcccaatgatggagtagagcataaaggaggggagaaatggggcaagaaatgactgactgtcactacaagatatgtctttggtgttttttttggctttgttctgttttgttttggggggggacatggtctctctctgccgcctaggctggagagcagtggcatgatctcggctcactgcagcttctacttcctggcctcaagcagtctttccacctcagcctctcaacgcactggaattacagatgtgagccaccacactaggcctacaagtggtccttacaccagattaatttatcttgaaatggcgggcaactgaatcgcacacctcaatctatgatttgacttttaaagaattaattatattgactgagagagaggcccaggagagaaagaagaaagaaaaggagccagggatggctcttcctcagggatctttgacattcagggatgtggctgtagaattctctcaggaggagtggaaatgcctggaccctgttcagaaagctttgtacagggacgtgatgttggagaactacaggaacctcggcttcctgggtgaggatagttttcctccagaagttaggatcttcccttgtgcatttttgtactttccttattgtgtttcttgtgaggccctacattattt

SEQ ID NO: 462540 - DNA, 2996 bp, Homo sapiens
gcttgagccagtatgcttggcctatccctgtgtttttgattcagtatttcttgggagagagctagatatcttcatcttacagtgttcactaagcattcagaaggaggcaatcaatggatgagtttgtgaaatattttgtagattcaactgcagtgttttctcttctacctagacattaggctgggttctggaaaaaccgtgggacatcttctttctttttttataagcaggactctgtcttcctgacctgaatattatctccatgttggagcaagggaaagagccctggactgtggtgagccaagtgaaaatagcgaggaacccaaactgtggggaatgcatgaaaggcgtgatcaccggtatctctcctaaatgtgtgatcaaggaattaccaccaatacagaacagtaacacaggagaaaaattccaagcagtgatgttggaaggacatgaaagctatgacactgaaaatttttacttcagggaaatccggaaaaatctacaggaagttgactttcaatggaaagatggtgaaataaattataaagaagggccgatgacccataaaaacaatcttactggtcaaagagttcgacatagtcaaggggacgtagaaaacaagcatatggaaaatcagcttatattaaggtttcagtccggtctgggtgaattgcagaaatttcaaactgcagagaaaatttatggatgtaatcaaattgagaggacagttaataattgttttttagcttcaccacttcaaagaatttttcctggtgtccaaaccaacatttctaggaaatatgggaatgattttttgcaactttcgtgacctacacaagacgagaaaacacatattagggaaaaaccttacataggtaatgagtgtggcaaagccttcagagtgtcttcaagtcttattaatcatcagatgatacatactacagagaaaccttacagatgcaatgagtctggtaaagcctttcatcggggctcactactaacagtacatcagatagtccatacaagagggaaaccataccaatgtgatgtatgtggcaggatcttcagacaaaattcagatcttgtaaatcaccggagaagtcacactggagacaaaccctaataatgtaatgaatgtggcaagtcctttagtaaaagttcccaccttgcagttcatcagagaattcatactggagagaaaccttacaaatgtaatcgatgtgggaagtgctttagtcaaagttcctctcttgcaactcatcagacagttcatactggagacaaaccctacaaatgtaatgaatgtggcaaaacctttaaacggaactcaagcctcactgcacatcatataatccatgcaggaaagaaaccatatacatgtgatgtatgtggcaaggtcttttatcagaattcacaacttgtaaggcaccagataattcatactggagagacaccttacaaatgtaatgaatgtggcaaggtcttctttcaacgttcacgtcttgcagggcaccggagaattcatactggagagaaaccctacaaatgtaatgaatgtggcaaggtcttcagtcaacattcacatcttgcagtgcatcagagagttcatactggagagaaaccttacaaatgtaatgaatgtggcaaagcctttaattggggctcattactaactgtacatcagagaattcataccggagagaaaccttacaaatgtaatgtgtgtggcaaggtctttaattacggtggatacctttcggttcatatgagatgtcatactggagagaaacctctccattgtaataaatgtggcatggtcttcacttactattcatgcctagcacgtcatcaaagaatgcataccggagagaaaccttacaaatgtaatgtgtgtggcaaggtcttcattgacagtggaaacctttcaattcataggcgaagtcataccggagagaaacctttccagtgtaacgaatgcggcaaggtcttcagttactactcatgcctagcacgtcatcggaaaattcataccggagagaaaccttataaatgtaatgattgtggcaaagcctatactcagcgttcaagcctcactaaacatctggtaattcatactggagagaacccttaccactgtaatgaatttggtgaggcttttatccaaagttcaaaacttgcaagatatcacagaaatcctactggggagaaaccacacaaatgtagtgaatgtggtagaacttttagtcataaaacaagtctggtgtaccatcagagaagacatactggagagatgccatacaaatgtattgaatgtgggaaagtctttaactccactacaaccctggcaaggcatcggagaattcatactggagagaaaccttacaaatgtaatgaatgtggcaaggtcttccgttatcgctcaggcctcgcacgtcattggagtattcatactggagagaaaccttacaaatgtaatgagtgtggcaaagcctttagagtacgttcaattctgcttaatcatcagatgatgcatactggagagaaaccttataaatgtaatgaatgtggtaaagcttttatcgaaaggtcaaacttggtttaccatcagagaaaccatactggagagaagccatacaaatgtatggaatgtggcaaggcgtttgggcggcggtcttgcctcactaaacaccaacgaattcattctagtgaaaaaccttataaatgtaatgagtgtggcaaatcttacattagtcgctcaggcctcactaaacatcagataaaacatgctggagagaaccttacaactaaactcaatgtggaaaggccgttagatgttgtgggacgagagaccaggaaaagaaataagagacagagacaaagtatagagaaagaaaagggggccccagggactggcgctctgcatatggaggacctgcgcagctggccctggtctctgagttccctcagtatttattgatcattatctctaccatctc

SEQ ID NO: 462541 - DNA, 3348 bp, Homo sapiens
tccagttatttgtggtaactctcttcttcccaatgatggagtagagcataaaggaggggagaaatggggcaagaaatgactgactgtcactacaagatatgtctttggtgttttttttggctttgttctgttttgttttggggggggacatggtctctctctgccgcctaggctggagagcagtggcatgatctcggctcactgcagcttctacttcctggcctcaagcagtctttccacctcagcctctcaacgcactggaattacagatgtgagccaccacactaggcctacaagtggtccttacaccagattaatttatcttgaaatggcgggcaactgaatcgcacacctcaatctatgatttgacttttaaagaattaattatattgactgagagagaggcccaggagagaaagaagaaagaaaaggagccagggatggctcttcctcagggatctttgacattcagggatgtggctgtagaattctctcaggaggagtggaaatgcctggaccctgttcagaaagctttgtacagggacgtgatgttggagaactacaggaacctcggcttcctgggactctgtcttcctgacctgaatattatctccatgttggagcaagggaaagagccctggactgtggtgagccaagtgaaaatagcgaggaacccaaactgtggggaatgcatgaaaggcgtgatcaccggtatctctcctaaatgtgtgatcaaggaattaccaccaatacagaacagtaacacaggagaaaaattccaagcagtgatgttggaaggacatgaaagctatgacactgaaaatttttacttcagggaaatccggaaaaatctacaggaagttgactttcaatggaaagatggtgaaataaattataaagaagggccgatgacccataaaaacaatcttactggtcaaagagttcgacatagtcaaggggacgtagaaaacaagcatatggaaaatcagcttatattaaggtttcagtccggtctgggtgaattgcagaaatttcaaactgcagagaaaatttatggatgtaatcaaattgagaggacagttaataattgttttttagcttcaccacttcaaagaatttttcctggtgtccaaaccaacatttctaggaaatatgggaatgattttttgcaactttcgtgacctacacaagacgagaaaacacatattagggaaaaaccttacataggtaatgagtgtggcaaagccttcagagtgtcttcaagtcttattaatcatcagatgatacatactacagagaaaccttacagatgcaatgagtctggtaaagcctttcatcggggctcactactaacagtacatcagatagtccatacaagagggaaaccataccaatgtgatgtatgtggcaggatcttcagacaaaattcagatcttgtaaatcaccggagaagtcacactggagacaaaccctaataatgtaatgaatgtggcaagtcctttagtaaaagttcccaccttgcagttcatcagagaattcatactggagagaaaccttacaaatgtaatcgatgtgggaagtgctttagtcaaagttcctctcttgcaactcatcagacagttcatactggagacaaaccctacaaatgtaatgaatgtggcaaaacctttaaacggaactcaagcctcactgcacatcatataatccatgcaggaaagaaaccatatacatgtgatgtatgtggcaaggtcttttatcagaattcacaacttgtaaggcaccagataattcatactggagagacaccttacaaatgtaatgaatgtggcaaggtcttctttcaacgttcacgtcttgcagggcaccggagaattcatactggagagaaaccctacaaatgtaatgaatgtggcaaggtcttcagtcaacattcacatcttgcagtgcatcagagagttcatactggagagaaaccttacaaatgtaatgaatgtggcaaagcctttaattggggctcattactaactgtacatcagagaattcataccggagagaaaccttacaaatgtaatgtgtgtggcaaggtctttaattacggtggatacctttcggttcatatgagatgtcatactggagagaaacctctccattgtaataaatgtggcatggtcttcacttactattcatgcctagcacgtcatcaaagaatgcataccggagagaaaccttacaaatgtaatgtgtgtggcaaggtcttcattgacagtggaaacctttcaattcataggcgaagtcataccggagagaaacctttccagtgtaacgaatgcggcaaggtcttcagttactactcatgcctagcacgtcatcggaaaattcataccggagagaaaccttataaatgtaatgattgtggcaaagcctatactcagcgttcaagcctcactaaacatctggtaattcatactggagagaacccttaccactgtaatgaatttggtgaggcttttatccaaagttcaaaacttgcaagatatcacagaaatcctactggggagaaaccacacaaatgtagtgaatgtggtagaacttttagtcataaaacaagtctggtgtaccatcagagaagacatactggagagatgccatacaaatgtattgaatgtgggaaagtctttaactccactacaaccctggcaaggcatcggagaattcatactggagagaaaccttacaaatgtaatgaatgtggcaaggtcttccgttatcgctcaggcctcgcacgtcattggagtattcatactggagagaaaccttacaaatgtaatgagtgtggcaaagcctttagagtacgttcaattctgcttaatcatcagatgatgcatactggagagaaaccttataaatgtaatgaatgtggtaaagcttttatcgaaaggtcaaacttggtttaccatcagagaaaccatactggagagaagccatacaaatgtatggaatgtggcaaggcgtttgggcggcggtcttgcctcactaaacaccaacgaattcattctagtgaaaaaccttataaatgtaatgagtgtggcaaatcttacattagtcgctcaggcctcactaaacatcagataaaacatgctggagagaaccttacaactaaactcaatgtggaaaggccgttagatgttgtgggacgagagaccaggaaaagaaataagagacagagacaaagtatagagaaagaaaagggggccccagggactggcgctctgcatatggaggacctgcgcagctggccctggtctctgagttccctcagtatttattgatcattatctctaccatctc

SEQ ID NO: 462542 - DNA, 2857 bp, Homo sapiens
  misc_feature (1)..(2): n is a, c, g, or t
nnctccaggggtcctagcagctctgctcccaggcaggtgcaggtagaagagccttgctcagctggggctgtgcagcctggtggctatggggactgccactgagaacagccctgcaagcagctgtggtcgatgcaagagctgtcagagggtcaaagacactccactgatcaggatccagtctgaggagttcctcatggttcccatgactttcataatatccatgtgtaccggccaggtagttagaatgtccttcccacttctcatagaagtaggagggcctcttgggaaacatggaacagtcggaagaatgatgggcaaagatggagctggcattaaattttcaatggaagcagtattggctttgacttttcagaaggcttatctgttagatggtgtttgtcactgggccgcggagctgtggatgttcgtcagttggaagttgcaggcagttgaacgatatggacagctagcgtgggtcatgagggtgcttgaggatgttcaactggactcagccattggacacaagggctcgctgggtttttctcggacaggacattgcaagagaggcacaaaagatattcgggagaagggatatgagtactcaatgaccacaaactgggggtcaagaatttctgagcccctgaaggatctggcacctggaggcctggagaagactcccataggaatgctaggtagagcatcctgcaagcacttgtgatggagtgaggttgatatggcttggatgttttttcccccctccaaatctcatgtcagaatgtgatctccaatgttggagctccccgcttgctttctgccactaggaaaacttcctgaggcctccccagaagaagccgagcagacgctggtgctgtgcttgagtagcctgcagaaccataagccaaataaacctcttttctttatagattacccagcctcagttgacagagcgccatttcgtgggtgtggaggtaaaaagacgtcaccagccctgctgtccctctaggtcacagctcaggcctgacatcagcagagagaacagaagggtcacctccccagagaaggaaggagctttgcctttgaacgatgcatttaaaacatttataaaacatccttcaacttcttccaggaacaaaagttttaaatgaaggaaagagcctcagctatttcaaggtcttggattctttccctttctggcatttgtgagcagccgtgcagattttttcctccagaaatggaggaagactgatttagcaagtttgcaaagagcccacttgtgtgaaacaccttccctcctgctttaaggtgaaactcctctttctaggaggaaagcagatagaggtctaggtctggattgcgttggtcctagcatttgtcacagcgttctactgaattagtgactcagtgcagcagtcacttaaaaaagagacccagttaaaatagaggggccaaaatctttgctgcttttcctcgagattctcatggggtccttgtcaatttctattaagctgtggcaggttcaggaggagcactcaattaatggtttgtttaggtggctctctattggtcacatggagaactccttgagagtgggacaggatcttattttagcatttccagccaatagctagagtgctgggcaacaaaaggtgcccagtcaatggtgattgattatttgatccacatttaattgactgccttgcccccactcctccactcacacaataagaccacgcaaaggtgtgataggaaatatttggatggtcaagttttaacagcatgaagtgtggtctccacgagaacatccgtggattttttatggtttctgaacaaggttcccatgactgtgctgctgtacatgccttaattcagattttgaacttaaggaccacctgctcaacaaagtcctctctgtgtcccgcaagttagacctgtattcacaggacacacagaccttaaaggtgtgacagtcatggtggcatctgtaggaaggaggctgggaggaagggctggcaggaacagctgtgcacctctaactggggtcatgagggctggtctgaaaacagaggtgccgatggctggaggaagtgggtgagagcagcttgtgtcttttgcagagggaaggaaagggacacttccttttggaaagacaactggtgtgatacagggagaggcgaagtcaacagaagaacaatgccaaaaaactacttgatgactgaattccaggatcacagccccagctttccatgacagggccaaccaaggctgtggtcttgtgtgcatccgtcaattaaagcaggagggaagtttcaaagcaaagtcattccagtaaaaacttaacaagccctgggctgactttaaggatgcatgtgaaatcatgacaaaacaaggattttattttgttttccatgggctaaattatttcagttcttggtgtataagtgttttgaggtagcatcatttttttcagcccaaagataaatcctagagttacagagggcttctcttgaggagggatgctcagatcaatcaggagaagccaggcaggaaggagaacccgagacaaagggccttgcctggaactctgcagcagggttagggggcgtgtgagccacccattgcatttctgtctggggttttcatcaaggttcccttttctgtgacaggtaatgtcattgcatgtacacagtttaagacagagcatctggtgattctcggaccttcaagcaagtgtcacatctcaggtgaaccttggcagttttaagatgaacaaagtaatcaaagcaaaaatgtcaaataataataataataatgatatcagaagaatgtccagtgccatggttggattcccagaaggcag

SEQ ID NO: 462543 - DNA, 1104 bp, Homo sapiens
aacaaagacctgggcaaggatgaaaccatggggcaggacttctgtctcctacaaatatgcccagttatctttgagaaccccacttacgatgaacctgagcttggaagctgtcccagtcctcactctggggtgatcattttgtcctggtttgggcaggacttcctggttttagcactgaaaggaaatgatcactggatggatccaggaacccactggacccatcgggaggttggagctgggtcatcgttagccttcacctcaccctattatgatgggaagcacaatggagctttgtgtccctggatatcacagtcaattcagaccctgggtccaataattcttctggtaaacaaacaccctgctggcccacaaaggccattttctttctggccattcagggagaggggtgttccagtttcaggaatagaattaggggagcaagctggtgttcaccgcaccctccagtgatctctgatgatatgcggggataatgggttacaaagacagacattaataagctacttgtgcaagaagctacaatgagaaaaaaaatagcaagaaatagatgagggaaggaggttctgtagagggaaaaacaaagagagaaaaggagaatgaattgtgctgagaaagagatgcctggatgaagaagctggccctagcacccataaagctggaaagaaagtggggccttggaaacttctggaaggatgcgaggaaagaaaaatgcaaggaaatgagatggagaggagaaagagaaaccaggaagcacttcggaagcatgtaaattacaaggaaatgaggaacagcctttattgaaacagtctgtgaagtctgtgctagcgctgagagcttcattttactgtcctggcaaggaggtgtggcccctctccagtgcccagcacctcatcgctgtggtaacagaagacacgcttatcttccggattttgcctcagagacttgggctgtacaagctgctttcctggggtggcttgtccttttgcagttaaccgagatgcctggggagaagagcttcccccaacaggatggcaggcgatgcttccagatgcggtcacttggcacgtctgagccgaatgtctccat

SEQ ID NO: 462544 - DNA, 1707 bp, Homo sapiens
ctcagtaaatggcatacagtaacaacagccatcaacagttccataaggggaatcccttcattttaaccaggggacccgtggcccttgtgaaaggtctgagaacatctgaagctaacttctacaccaacgtggatgtggccggtccccgtgcggatgcccgtttcccctcctgcctgcattcatctgaccggttcagtgggatctggtacttttcctccctcctcctcgtgctgggcttccacatcatccagacagctgctgccacattccaccgctccagcagcggaagtaaggcacatttaggccctttctggggatgtgtgcctgtcgccctgggccgctgtcccctgacggcagatgagatattcttccagctcaacactgatgttgcagggtttttcctcacctaccgcatgacgactgaatgaaagcattccaggaaaccaaaagggctgggcaggcctctggaatttcaaagccgacagcctggccctgctggcagctcatttctgccgcgtcattttctctgaactgtaggagtagttttgtagcaaacttatcaccaaaatcccacaaatgttaagcattacccttcttagaaaggaaaagcctacttacttttccccattggaagacttcaattttttaagattcaagaaatccccaaaagtcatgataaagaagagggaaaacagactgagcatacccatccccttttaaattcaaatttattttgtttttttctgcttagctacagggaaggtttgatcatatcacatctgagttaggccatatgcacccagggggaatctcaagagcaaactaatctaaactccaagaaatagaccactaagacccacccaggtagtactcactgaacgctcttcctgcctctcataagaaccaaaaatagcggtttcccgcagatgctcccagaagcaaagtctacctaccacacacacaatatgcagaagggaaaaacccaagccacaagtccctaaacgcctgagtcgtgactcatggaggctgtcctccacccctgccaagtataagaaatgatttctacccacccacttctctaaggagatggtccctcattcctctctcccgagcaggcttcacagcccccttcatagagatgaagccctagtcattaaatgcccagtgatgttacgactgccaaattctatgactatttggaaagttttatcagccttcagacttggcctgaaacattggtcctccttgggttgtgagcctgcaggtcctcagactgaaactatccatcagctctcctggttctcaggctcctggattcaagctggaagtacacatcaggtctcctgggtcctcagcttgatgactcgagatcttgggaattctcggcctctataactgtgtgccccaattccctataataaatctttgtctttctctctctcctgttgtctctgtgtctctgaagaaccctggctaatacaaaggtatagtccaattttattttattttttttccaaataaatactcctcagtgacagcaccatctactgaatattgtcccttccccactgaattgcaaagatgcctctcaagcttccatatgagcacgggactatttctgtaatttgtagtctgttctgttgggctactgccctgtccttgtgctaacaccatgtcttattactataggctaattatgaatcttga

SEQ ID NO: 462545 - DNA, 1063 bp, Homo sapiens
gagaggacctggatacctcaggttatggtgcaggattcacatactattatggttcttttctatgggatgctgcttctagtgccactgggagaacttcagcccggaggggagatcagctgtcttttcacccagtgccccctacccagcagtgcaatagaacctaaagaggagctacaggacaatttcagaaacagcgtgcttcaggaagcacgctgggaagtggggagtcacagatctctcagcgtggactgtgtgctccaagaaagtgtggggtcgactaagactagtggcaatctacatacagctaatagaaactgccctacagctcagagttgtagcgggaataaggacttctccaaagccaagcagcatctgaaaactcctgtagtaagagacaacaaaaccagcatagatccagccctgtttaatggcttattgcaaaaaaagccaaaagtgaaagtaagagcagcttcactggcagatacagagttaaacggggagtcccagagaaagcaagagaagccagttttgcaggagctgccagaggaaacagaagttcttcctccatatgtcccagcctacccccctttaccgaggccaacagcccccccaggaacaagattcaggagctaacacgccccaggtctttcctcgaaggggaggatcaggcccttgagaggctagggaaggaagtcaagacagtcaagtgggccatttcagatctggccatgctcaagctgtgcaaatgcctctcagggagaagataggacctatctattatgatgaccagggccacatccagaggggggcaatggacttatatctatcagcccttttcaattactgatctactaaactgaaaacaccatacactgtccaacatggagaagcctcaagttcttatagatctgatgcaattcctctttctgacacacaatacgacctggccagattgcaggcagcttttcctaatgttgtttaacattaaagagtgccagaggatgacacaggtggctctccgctggctagaagcccatgcaccaacagacatagtgaatgctca

SEQ ID NO: 462546 - DNA, 7028 bp, Homo sapiens
aacggttcagtcaccttaaccgttattattcacttgcgggcgagaagtccgagctagggatcctgaaaaggagggaacaattgttgtagcaggtctaaaagttcaggtccaggaaatggaaacattgctttgcttttcctgaattgtccagtgacctatcccaggccttcctttccagtgaacaatggaccatgcaggtggaccctcctcttcacgggcctccaaatgactttctcatttttcaaatcattcctctgcactcactttctataatgccccggtttctctggattctgtgcttctccatggaggaaactcaaggagaactgacaagttcttgtggttctaaaaccatggccaatgtatctttggcatttagggatgtgtccatagacctctcccaagaggagtgggagtgcctggacgctgtgcagagggacttgtacaaggatgtgatgttggagaactacagcaacctggtctcactggatttggaatacaagtatattaccaagaatttgctttcagaaaagaatgtttgcaaaatctatttatctcaattgcagacaggggaaaaaagtaaaaacaccatccatgaggacaccattttcagaaatggtttgcagtgtaaacatgaatttgagagacaagagagacatcagatgggatgcgttagtcaaatgctaatccaaaaacaaatatctcatcctctacatccaaaaattcatgctagagagaaatcatatgaatgtaaggaatgtagaaaggcctttagacaacagtcataccttattcaacatctgagaattcacactggtgagagaccctataaatgtatggaatgtggaaaggccttttgtcgagtgggagaccttagagtacatcacacaatccatgctggggagagaccctatgaatgtaaagaatgtgggaaggcctttagacttcattatcaccttactgaacatcagagaatacattctggtgtgaaaccctacgagtgtaaggaatgtgggaaagcctttagtcgtgttagagaccttagagtacatcagacaattcatgctggagagagaccttatgaatgtaaagaatgtgggaaggcctttagacttcattatcaactaactgaacatcaaagaattcatactggtgagaggccttatgaatgtaaggtttgtggcaagacctttagggtacaacgacatattagtcaacatcagaaaattcatactggtgtcaaaccctataaatgtaatgaatgtgggaaggcctttagtcatggctcataccttgttcaacatcagaaaattcatactggtgaaaaaccctacgaatgtaaagaatgtggtaagtcctttagttttcatgcagaacttgctcgacatcgtagaattcatactggtgagaaaccctatgaatgtagagaatgtggaaaagcctttcgtcttcaaacggaacttactcggcatcatagaactcatactggtgagaaaccctatgaatgtaaggaatgtgggaaggcctttatttgtggttatcaacttactttacatctgagaactcacaccggtgagattccctatgaatgtaaggaatgtggaaaaaccttcagtagtcgctatcatctcactcaacactacagaattcatactggtgagaaaccctacatatgtaacgaatgtggaaaagcctttcgtcttcaaggagaacttacccgacatcacagaattcatacatgtgagaaaccctatgaatgtaaggaatgtgggaaggcttttattcatagcaatcaatttatttcacaccagcgaattcacaccagtgagagcacctacatatgtaaagaatgtgggaagatttttagtcgtcgctataatcttactcaacattttaaaattcatactggtgaaaaaccctacatatgtaatgaatgtgggaaagcctttcgatttcaaacagaacttactcagcatcacagaattcatactggtgaaaaaccctataaatgtacagaatgtgggaaggcctttattcgtagcactcatctcacgcaacatcacagaattcatactggtgagaaaccctacgaatgtacggaatgtgggaagacgtttagtcggcactatcatcttactcaacatcacagaggccatactggtgagaagccctacatatgtaatgaatgtgggaatgcttttatttgcagttatcgacttacattacatcaaagaattcacactggtgagcttccatatgaatgtaaggaatgtggaaagacctttagtcgtcggtatcatcttactcaacattttagacttcatactggtgagaaaccttatagctgtaaagaatgtgggaatgcctttcgtcttcaagcagaacttactcgacatcacatagttcacacgggtgagaaaccctataaatgtaaagaatgtgggaaagccttcagtgttaattcagaacttactcgacatcacagaattcatactggtgaaaaaccctatcaatgtaaagaatgtggaaaagcctttattcgtagtgatcaacttactttacatcagagaaatcatattagtgaggaagtggcagtcatcaagcagttttgtgaaaagccttcccgactaccatactaccactttcctcaacttggactaatgtccattgtcaaccaaaatgtctgtgatctcatggatccattatgatttgcaactccaggtccattttatgcaaataagacagccataatatatcattgtacaagtcatttactatctaattatatcattgctcaacatttgcaaattatttttacaaataacaataattggatgtaacaaaaagcagagtattttgagacgtatattaatgcaaaatattgttaatgtatcagtggattgttcctccaaagtaccagtgccttaacacaacatatctaaaagaacatctctgggaacagtagtacttaatggcaacttgagaattggtttgtgggcacacagccttgtgaagttttgaatactaaatcccttttttaaaaaagtgcttattatcaggctatcaatcaaaagatttgagtctttcagtaaagaaaatttgcttaattttatctagtgcatgataaactttactaaggaagtctcattcagaatatctaatattttggatgtgagcccacactggaaatgccataaccaaaaaagagtgaccctaaagatagaatattcagatctaatggcagatgcttagctatgctgggaaaggaagtgaattgtatattgctctgctgctcacatattcctctgcaataaattgctggcccagtttagtttttatatactcactactatactaatgaggatggctcaattttttatttgaacgtactataatgaatttaaactttcattggtatttatgttttaacaggttttcactatttcaaatatacttcaataaatatccttgtctgtgatcattggtttatgtgaattggaatttcagtagctgtatatacatggaagtacaattgctcatacatcatacactctttcagttatgttagataatactaaatcaaccatgggttctgtataccctactagatatttccaaattgttctcttagactcctgagaactggtaaattgagtgctatagcttcagtttagtccctgaaattcatcttcatcttcatccagaagacaatcctcccaagactcatagtggaacattcttggggaggtgggggggagtggggaggggagtgggggagggagggaagaagcactgactccctgggctcctccatgggcaggtcctccaccagcttgcgacccctggccacctatttctgtttctttttttgttcctatgaattctagttactatcatgtatcatttccttactccaatacaactctgctgtcatttacttcctttatgctgttattgtcaaatatattacatttccatgttataggcccaacaatataattatgtacatactgtattatacaactgccttttaaatttattaagagaagtaaaaagaaatgtgcatttgtgctgctttttgtaattttaattatattaattttgttctttttaaaaatgtggttttgaatttccatgtagatttacttgctttgtttgaataacctttacaatttcttatgtggtaggtctgggaagggctttatttcaccttcatttttgaaagacagtgtgttactgcttgacagagcttttgtcgtttgagtactttgaatatatcatcccactaccttcatcccctccattgctttggataagaagtcagctgtcaatcgattggtgttccattgtaagcgacacatcatttttctcttatatttttcaacattttctttcacttttagcatttctactatgatagctggatgatcacaataccctgtaaaaggatgacagaaatcttgtgtctactttttcttcttttctggggagtctatgaacattcaagataacatccatgactgaatattctaaaacaagtttctttacaacgctgctcagaaacaccatgacaaatttaaatcagagcaatatctccaaaaatgggaggcagattaatgtatcatttcagccaggccttaaaaggagataaacttctcagctatcaccatacataaaacataattcaataaaataccaaatgcaaacaagagcagatcatagaaatgtaagttgagaaaattcagagggaacttctgaccttaggatgacattttcaactctgaaactattaaaagaattctaacaaaagcagcatctttttttccatacctgtaactgccatgtgcactcacagcagccagattttttggtctctaattcttttttcctctaaaaggaaccaggactccctaagataagagggtattaaatcatgagttgattccatgactcaggacaagaggcatgggggacatgaaccaacaaacagggtcagtcttaaacatcctcttacggcctgaaaacaatattcctttaaaacatcaaaagaaaaaaataagtagtaaaaaaaaaatgtaaatggattcctactggccacattatgtcaatttgagcataaataataataattactacaggtgcttctcaacttacggggagttatgtccaaataaacccatcataaattgaaaacatcatacaccatatgtgcatttatggtctacaatattttcaatttaacaatgggtttatctagatatagccccattttaagtcaaggagcatactctgactgagtatgtcttagttttgtgttgctataaaggaatgtctgaggttgggttattaataaagaaagaggtttatttggctcagtgttctgtaggatttacaagaatcatggtgcaacatctgcttctggtaagggcctcaggctgcttccactcatggcagatgaaagggggcagtgtatgcagacatcacatggcaagagaggaagcaagagggtgaggaaggaggtgccaggctcttttgtacaaccagctctcataggaactaacagagtgataattcaccccccaatccagagaggacattaatttattcatgagggatcttctcccatgacccacacacctcccattaggccccacctccaacattgggatcaaacttcaatatgagatttggaggggataaatatccaaactatagcagcatatcacttttgtactattataaagctgaaaattataagtcaaaccattttaagttggggattacaggcgtgagccaccgtgcctggccgtgatttttaaatttgtacatacttggtttgtaactttaacaaatatattaaagtgttttattatgtttgcaaagggactctgacttccaacatagtactgccatgattgcatgatgatagagtttcaccgaaaggctgccagggatctttctgacaactcttaatgatactaccgggatgtgcaatgacccagaaaggagttgtgctaggttaatacccagggactctgctgatttcaaagaagaaagttcaagagaatggatagaaaaaagatgaaactggaaataaaaaataggaacataagatttgaaagccaagttttatataatcttgttttataagttgtataacatcattgcaatatcaatacctgaaaaatacttggaaaattataactttacttatgattatagatgcaattaaatggtaaaagatagaattaagtagtctattgaaagaataatcatctgaccagggtatattcataaaaagaagaaagctatcaatataaattatcactttatagatttttcaacacaatggaataaaatcacaaaggattattcttaatcttaaaaaaaatttaatctaattcatgatgccacatcggtatcatgttttgttttggggtttttttgagatgaagtctcactttgtcgcccaggctggagctaaaaaaagatctcacagaggtaaagaatagaatgatagaaaccagaggctgggaagggtgtgtgggtgaggggtgggggatgaagaggagttggttaatgttacaaacatacagttaaatatgaggaatgacttctaatgttcataagcagagtagagtgactctaattaacaacaatgtattgtatatttcaaaatagctagaagacttgaaatgttcctatcagaaagaaatgataaaccctcctctggtggatctgatggatacctcaaataccctgacacttgttcattacaccttctatgcatggaacaaaacataacatgtatcccataaatatgtacaaatattgggtatcaattaaaaatgaataaataactcttgaagaacttcccacattcctcacaacgacagtcaaaaccctgtatgatacgactccgacgtaactctcagacctttcttcccgctgttccattacttactccacctttgtgtttcctgctcagtctgactagagtacttgaacacttacttcacatctctatg

SEQ ID NO: 462547 - DNA, 1215 bp, Homo sapiens
agtaacaaagggatgtcgggtaaacaaagtaatagcataatcggttttaatatccgtaagcatctggggagtcacctgggcttttagtgacaaaagtctgtgggcgaagcccctctgagaagagaactctgctctctaggcctttcagaggtaggcagagctcggcaaccggtttctacggaccgaggacgcgttgctaagggactgaagggtgggggcggggcgagtaacccgcggagccagaagagggaggaaaggagatgagatttcatcatgttggccagcctggtctcaaactcctgacctcaagtgacccgcctgcctcagcctcccaaagtgctgggattacaggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatgcatgtctctttcaaatgtgagcctgaacctagaaagagtaattttgaaaagtcaaatttaagaccattctttattcaaacaaatgtaaaaaataaagaaagtgagtcaacagagccagtagaagaacatctaaaatcaagatctattagaccctatctttatcttaaggatacaactgagatggaaaatgcagggcctttgaatgttctatattcacagcatagacaagcatgtagaagatcactgggttctacagacttttctcctatgttcaacattcagtctaatgctcataaaaaggaaaaagactctactttatttacagctcaaattgaaaaaaaacctaggaaaccattggattctgttggtctcttagaaggtgatagaaataaaaggtaatttattttaaaatgcttaatactttgttctgtttaatgatgtttctagtaggacacattttataattgacaggaataaatttattctgccttattatttagttccacagcacaatccaatgaatggtccaagactgcttagccactagatatcacatccagaccttgagtattgttaaatggagagaaaggcatggaaaaatgaatagagggaa

SEQ ID NO: 462548 - DNA, 889 bp, Homo sapiens
agtaacaaagggatgtcgggtaaacaaagtaatagcataatcggttttaatatccgtaagcatctggggagtcacctgggcttttagtgacaaaagtctgtgggcgaagcccctctgagaagagaactctgctctctaggcctttcagaggtaggcagagctcggcaaccggtttctacggaccgaggacgcgttgctaagggactgaagggtgggggcggggcgagtaacccgcggagccagaagagggaggaaaggagatgagatttcatcatgttggccagcctggtctcaaactcctgacctcaagtgacccgcctgcctcagcctcccaaagtgctgggattacaggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatctcaaattgaaaaaaaacctaggaaaccattggattctgttggtctcttagaaggtgatagaaataaaaggtaatttattttaaaatgcttaatactttgttctgtttaatgatgtttctagtaggacacattttataattgacaggaataaatttattctgccttattatttagttccacagcacaatccaatgaatggtccaagactgcttagccactagatatcacatccagaccttgagtattgttaaatggagagaaaggcatggaaaaatgaatagagggaa

SEQ ID NO: 462549 - DNA, 406 bp, Homo sapiens
ccagcatatttttctgaaagggttaatcagcttgtgaataagtttcttggagtgccctcaatgctatcacagcagcaagtagttttctgtccccctccactttaaacgactaaaactaatattttcagctcctatttaatcagtccaatgtttcacacttggtactgtgacaacattaacataacatccaagtctgtataactaggacttcacattcctccaaatttattttttagatttattttgtaatttttctcattattttaatttaaattaatttttatttcttccaggcatgtctctttcaaatgtgagcctgaacctagaaagagtaattttgaaaagtcaaatttaagaccattctttattcaaacaaatgtaaaaaataaagaaagtgagtcaacag

SEQ ID NO: 462550 - DNA, 759 bp, Homo sapiens
gctgattcaacctccaggtttatgcacagatcagatgggtcagattttggaagcagaactgtagttcatgcagaaatcaggtcaacaattagcaactgcagcccttcattaagcgcttctccaagcctgtgttcagccgtgaattcatccttggatgcgctggagctgcttagtggaataccaagggaaaacaagtctgtgtctttgaatcctatccagctgcagccacaagttcctgaagagtacatgcaagatgacatgcaaacaatccacatgctatttttggccaaaatgatcctttcctttggtcctaatatcagcgccaacgtggattcacagccaaaaggagttcatgatgcatctcccatggaaagagcttatacctcaaacccacaaggctcccctctacattcaccacatggagaacagaccagccaaaacctctcaggagggtggagtatttgccagtaactctctggagatctgtcttatgtgtgaccaagacaacaaaacttaaaaaaaggcaataatgttggaaaaagacatgaatatggtctgtattaaattgattctactttttatttagtcatgactctggactaactttcaaaaagtaaaatgttatgccagcctagcaaatgttcatatcaaattcctcattgttttctctactctcctttgtcctgccctccacttttgtttgcttggtgaggctcaccctaaaatatgtaaaaatatgtaaaatatgtaaaaaaaaaa

SEQ ID NO: 462551 - DNA, 805 bp, Homo sapiens
  misc_feature (3)..(3): n is a, c, g, or t
  misc_feature (5)..(5): n is a, c, g, or t
cangnagtacggacatgcagtattgcatgcacacacaccatggacgactactcagccataaagaagaatgaaatcatgactgttccagcaacatggatggaactgaagaccactatcttaggtgaaataactcagaaacaaagtcaaatactgcatgctctcccttatatgtgggagctaaataacgtgtacagacagacagagaggggaataacagacattggagactggaagggtgggagggtggcagggagggatgagaaattacttcatgggcagaatgtacactactcagtaatggtaacactaaagcccagactcttccaccatatgctatgtccatgtaacaaaactgcatgtgtaccctgtaattttataaatgttgttaagctgaaaaggtgtgtgtatgtgaacacagtaaacatgtaagtataaacacagatgtaccgtgtgtgtgcaagcttattcaggttaccattgctatgtcttacttgcttaaactattggtttttgtaaagtgcacgttcaaatcacccatgacagctatttctacctgctctatccatcactgctggatgaatgttcgagcctcattgttgggtgcgtgtatgtgtatgtatatttacagactgttacgatgcttcttaccctgaaatattcaaacgcctgccctaattctcctttggtttactctgcatgtctgtgtttctaccctttgaagcatgtcttttatagtaaaaatactatttagtatatttttaatgcagtctagtctgtttttaatgatgtttttaattgacaataa

SEQ ID NO: 462552 - DNA, 1097 bp, Homo sapiens
  misc_feature (1)..(2): n is a, c, g, or t
  misc_feature (4)..(4): n is a, c, g, or t
  misc_feature (10)..(11): n is a, c, g, or t
nntnctgccnncagggcactgtctgtttgcaaatccagatggaaaggaacaccttcacgccaggagagaaggtcgtcttcacaacagagatcaacaaccagaccagcaaatgcatcaagacggtcgtattcgccctgtatgcccacatacagtacgagggcttcacgcccagtgcagagcggcggtctcggctggacagcagcgagcttctgaggcaggaggccaacacccccgtgacccgcttcaacaccaccaaggttgtcagcaccttcaacctgccgttgctgctgtccgtgagcagcagcacgcaggacggtgagatcatgcacactcgctacgagctggtcaccaccgtgcacctgccctggtccctgaccagcctcaaggccaaagttcccatcatcatcaccagcgcctcagtggactctgccatctgccagctgtcagaggacggagtgttacccgtgaacccagatcaccagaattaagtgcccgaacttttaaatattaaaagctttattagtctctaccaggaggaagccctctctcttgcacaggtgactctcagaggagtcgaggagtgggcaacaggttgtctgcaacctccccaagctctagcggtttaggtatctgtgtctcccctccctagaactatcactgaatgcctggaatggacaaaggaaaccgggaaggtctcccaggacccaaacccggcataacctgccttttccaccctgagtctgccccagcctactggggtctcacagtgccaagaccaggggtcctacttggggagaattctcccctctgctaatgtctggttgtattggctgtcacaactgcaggggatcgggggagaagagtcttattggcgtggagagggtggaggccagggacgctgttcagcaccctgcagtgtccaggacggcccccacaatcaggaattgtttatcctgaatgtcaacagtaccaagggggctgagcatggtggctcattcctgtaatcccaggactttaggaggccatggctggaggatcacttgagaccaggagtttgagacaagcctgggcaacactgtgagacccccatctctaca

SEQ ID NO: 462553 - DNA, 2160 bp, Homo sapiens
accgcctcctcggcacgctgagcaagagctaaggggtaggtttatatcgaagtgcgttctgtgcggcgcgctccgagctccgttggtcgcgcgcgtgctgtggcgctgagtacggctgttgggtagtcgcgtggctcgccagtgatcgactgtatatcggatgggtggttcatccctggtcactgtggcgccgtccgtcgcttgcgtgttcgtgctgcggtccgccactccgaggcgtcgcggggttctggtgggctgcgggcgcgtgcggttgccggttctgatggtcgtcgcgcgcgcaatggagaagctgcagttcctttacctgtcagacaacctgctggattctatcccggggcctttgcccctgagcctgcgctctgtacacctgcagtccttccctccttcctctctccccttctcttcctcttcatctgtgccctctctctccatccatcccccctggggctcctcttctcacccttgttgtgtggctttggccctagatgcttcagtttctccagttgcaccagagcaggcagagctgaataacctgatagagaccatgcagagagacgtcttctgtgaccccgaggagcacaaacacacccgcaggcagctggaagacatccgcctggatggcaaccccatcaacctcagcctcttccccagcgcctacttctgcctgcctcggctccccatcggccgcttcacgtagctcggagcccttccactcctcccaggtcatctcttggaccagcgggcatcacattctccagcagccgccatctcacacgcctccctcctgtggccgccggcagcatggacaaaggtctccatgcagggggaggaggcctgcttctttccccacagctctcacgtctcccttctccctgcgggtgacaaagaagcccaaggaccacctccttcctgcctcattgtaataaaattccccacactgaggccttcttgtcttcaacctggcctgtccagcccttccagatatggccaaacccatggcctggatgggcttgtgtacttcctttcaaatgagcccacacagaacgccctgctctccccttcctcccctctgcactccttctgcctcctttttctctattctccttctgtgctcaggcaccacagcaaatagctttttgtttcctcctggcactaccagtcccagccctgccttcaggaattcttttctctctctctctctttttttaaaagactgggtctcactaggttacctaggctggttttgaactcttgggctcaaatgttcacctgccttagcctcctgagttcctgggattacagatgtgtgccactgtaccgactccagaattattttcttttgtgtctaacacacagttcagacacaggagggagtggaagtgtttcttgttatggcatctgtagaggaactgtgatgcaagggagtgagcactggaatgagaatctgaagacctgagtttgactaccctatatcctgatcacaccagcacctcactctgtcctggccccttggagttccctcactccaaatctgttgctcaaagcatatccaagcccaaggggtgtggtgcctatccctatcttattacatttctagtctaagaacaaagacccaaccctctcctactgttcccagtagcacagactaccattgacaaagaggtatcaaatggtaaaaggagaaaaggaaggaagtacagaaaatacagacacacaatcagtctagtctcacaagttgagctttctgagcccaaatcaactataccatggctttaaagcttgcttagctgcaggccttcctgacccttctctagtccatgcagaagagagaataatccaagcttttcaggccctttctgacccatcctgaaaccaaagcccccgcttcctttacctactcctgcctcctccccacctatcagagtcactgccacctcccgggaagctgagagggtttatcatcaaatcaggctttgtcataaagaaaacagatttattttcctcgctttgagaaggtgctgacaggagcagcgagggaaggggtgttttgtatattgaaagcctttctccccctgtggctaaatctcgcgctattttctaatttacctcaaatgctgctcctccagcctgcctctccat

SEQ ID NO: 462554 - DNA, 963 bp, Homo sapiens
accgcctcctcggcacgctgagcaagagctaaggggtaggtttatatcgaagtgcgttctgtgcggcgcgctccgagctccgttggtcgcgcgcgtgctgtggcgctgagtacggctgttgggtagtcgcgtggctcgccagtgatcgactgtatatcggatgggtggttcatccctggtcactgtggcgccgtccgtcgcttgcgtgttcgtgctgcggtccgccactccgaggcgtcgcggggttctggtgggctgcgggcgcgtgcggttgccggttctgatggtcgtcgcgcgcgcaatggagaagctgcagttcctttacctgtcagacaacctgctggattctatcccggggcctttgcccctgagcctgcgctctgtacacctgcagtccttccctccttcctctctccccttctcttcctcttcatctgtgccctctctctccatccatcccccctggggctcctcttctcacccttgttgtgtggctttggccctagatgcttcagtttctccagttgcaccagagcaggcagagctgaataacctgatagagaccatgcagagagacgtcttctgtgaccccgaggagcacaaacacacccgcaggcagctggaagacatccgcctggatggcaaccccatcaacctcagcctcttccccagcgcctacttctgcctgcctcggctccccatcggccgcttcacgtagctcggagcccttccactcctcccaggtcatctcttggaccagcgggcatcacattctccagcagccgccatctcacacgcctccctcctgtggccgccggcagcatggacaaaggtctccatgcagggggaggaggcctgcttctttccccacagctctcacgtctcccttctccctgcgggtgacaaagaagcccaaggaccacctccttcctgcctcattgtaataaaattccccacactgag

SEQ ID NO: 462555 - DNA, 5190 bp, Homo sapiens
tttgaaacctgaatatgtatttcattgtataatttactgttaggtcaccctcgtcgactgaaagtgaaacctgattctgaaattttagttatagaaaatggaacagctttcccatttcaggtggaagttttagatgaatcagacaacataacagcacaaccaaaattgattgttcattgtaagttttcaggtgctccaaaccttccagtctatgttgtagattgcagtagttctggaaccagtattttaacaggatctgcaattcaagttcagaatattaaaaaagaccagacgcttaaagcaagaattgaaatacctagttgtaaagatgtggcacctgtggagaagactattaagttgcttcccagtagccatgttgcaagactacaaatattcagtgtagaaggacaaaaggcaattcagatcaaacatcaggatgaggttaattggatagcgggtgatattatgcataatcttatttttcaaatgtatgatgaaggagaaagagaaatcaatataacatcagctttagcagaaaaaattaaagttaattggactcctgagattaacaaagaacacttgctacagggtctgcttcctgatgtgcaagtaccaacatctgtaaaagatatgcgctattgccaggtttcattccaagatgatcatgtgtctttggaaagtgcgtttacagtaagaccacttcctgatgaacctaaacatttaaaatgtgaaatgaaaggaggaaaaacagtacagatgggccaagagcttcaaggagaagtagatcagtacggaaatcagattcaagcattttcaccaagttctttatcttctttgtcaattgctggggttggacttgatagctcaaatttgaaaacaacctttcaggaaaacacacagagtataagtgtaagaggcatcaaatttattccaggtcctcctggaaataaggatctttgttttacttggcgtgagttttctgactttattcgagtgcaactaatttctggacctcctgctaaacttctccttatagactggccagaactaaaggagtccattccagtgattaatggaagagatttacagaaccctattattgttcaactttgtgatcagtgggataatccagcaccggtacaacatgttaaaataagtcttacaaaagctagcaatttaaaggttaaagccatctataacaaaagtatcatagaaggacctataattaagttaatgattcttccagacccagaaaaacccgttcgtctcaatgttaaatatgacaaagatgcatccttcttagcagggggtcttttcactgatgacagtatcattaaaaacattaatccagcacgtatttccatgaaaatgtggaagctgtctaccagtgggaaccgacccccagcaaatgatgactacgacaaccatactggaattgatttggttggcactataatagccaccattaaaggctctaatgaggaagatactgataccccactttttattgggaaagttagaacacttgaattccccttcgtgaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacagggcataatagctgatcatttagaagtatcacttgtggtggattgggaattgattgtatgatcaaaatgatgtgcaatatattcatgttttccatattgtctttttttaaatttaaaaagtcatgtgctttaatatctttttaaaatttctttttatttagatctctacctcatttccgaaatggaaaattgtattttaaacccattggagatccagtctttgctcgagacttgttaacatttccagataatgtagaacattgtgaaacaggtaaaagacattatggtgactttacttttgtacagatgttaaatttgtgacacaaatctataaattactgataatgaaaatttatattcttattttgcttatcagtcatagttttatcagtttttttagagtacaaataaaattagaacgaatactagcactctttcaaagaaagacttgcaatgtgcattatattttaatatggccaaggaaaatatcataattttcaaaattcatttattgacttttttagtatttggtatgctgttaggagacaccattattttggataatctggatgcggccaatcattatagaaaagaggtatgtatttgatttctttttaaatttgtagacttcagttttaatgtgtatcatgtccatttgatgatacatatacaaacgactagccttttcaaaaccaatttaaattctgcaaattgataagcaacataaaagtaggcaaaacgtaggaatgaatggaccaggatgcaaatttaaatagatgttttggggctacgaaattgtctaagactcaaaacagtgtctgttaggattggaaaaaagtactgtcaggtaattttggtgtaaaatgtaatttgctgtagccctttgtattggttttctagggcagccattaactgatgtgaataatagaaatattactgtcccacaacagactgggtggcttaaataatagaaatttattgtatcacagttctggaagctggagatccaaattcacagtttcaggagggttggttacctctaaagactgtgaatgaaggatctgttccaggcctctccctgccttggagatgaggactctcttccccctgtctcttcacatctgtgcgtgactgtgttcaaatttcccccttgttgtaaggataccagtcatactggattagggcccaccgcagtgacctcatattaacttgattatctcagtaaagaccctatctccaaataatgtcacattctgagggactgggggttacggactttaacatggatttgttgggggctggtcccaaacaaaggtaatgagttatctcaattgatggttcaccatcagctacagatctaactctgttttattctttcctccccttcttactagtctacttgactggtcttgtaaaaagtaaataaataaaagattatagtggagcacagtttagcccatagcacctttgcaggggagtttggtaaaataaatatttcagttatttactgctgctatatatataacactctaaattgtaagtttaaacaacaacatattagtcctctttgtagatttctccaagtgatgttggctagttgaactggggtggtggcagctctaaaatgcctgccttatgtagctggcaactggtacctgttgtcatctggcatcagctggtattagccaggggttcttttggggatgtctgctagggttattgttctcacccatgagggtgagatagagtagggtaatgccatttagagttttagaagcccttttgtctagctaagaggatccaggagggcagtagtttaaatctttcagaggtcttaacaaaggaacatccttgacttgattttaaccctaaagccacatgttataggcagtaccctggattgatctaagccagtatctgtaaatagtgtattctagaatcacggggactatagggatcatctaggatgatctaggacgagtgagaatagatgagagaccttaagctgagaacaaataatggagagctggacatgtgatgcatgcatgtagttccagctacttgggaagctgagggaggtttgcttgaacccaagagttcaaggctataggctgtcgtgtgctctgatcatgcctatgaatagccactgcactccagcctaggcaatataatgcgattctgtctaaaaaaataaaaattgttaaagaggtgggggatttgtcccaagtcacactttactaatttatggcagagctagaactaaactggtatgagtaatttttctttgggcctcgttaagaagcaataatagggcaccgggtacagtggctcctgcctgtaatcccagcactttgcgaggccaaggtaggggatcatttgaggtcagaagttcgagactagcctggccaacatggtgaaatcccgtctctactaaaaatacaaaaattagccaggcgtggtggcaggcacctgtaatcccaggtacttaggaggctgaggcaggagaatcacttgatcctgggaggtggaggttgcagtgagctgagatcatgccactgcactccagtccggggtgacagagcaagactctatctaaaaaaaaaaaaaaaaaaaaaaaaaaaaggcaataataaattcatcttagtttaggaaaactaaattactgggattttgagcattatatagctaattggaaaatggtatttggcatcttcatgaacgtttccttgtaaacctaatattaagtataatacactgtaccagaaactggctgtgggtgggagagctactatattctggtagtgattagcatttttatatatcccgaattatgaaatagaaacatacccattaaatgttatgataacatggaatcagtttggagacggtgagaagcttgctggtaaggattgaactaactaataggatggtaaccggaagactcctgttcaatgagatatttggatacttactatgtatgagacacagtagtgtgctattatgtgttgaactagctctctgaggaggcatgtggaagtccctgatttgtagcttttgccaatttctatggtgtaagtacttgtatcatggatgatttccagcagtctgtatgaagtccttcatgcctatatgaatgtggtgttcaggagacctggctttcatgacccagtacaagctggttccagcgtatcactaggcacagtgcactgagggttatacagtgatgaattagacaaaccagatagcctttggaaactccagctgagattagctaaaatgctatttcagatatgtatcttaatgaactggcaagagagtcaggattctaagtggaagtgggaacctggagagacaaacagaacactaatgccagatttttgcagtgagaacgtttgccaaactaattgaaccggatagcttcacaggatccgctagatca

SEQ ID NO: 462556 - DNA, 4132 bp, Homo sapiens
  misc_feature (4049)..(4049): n is a, c, g, or t
  misc_feature (4095)..(4095): n is a, c, g, or t
  misc_feature (4097)..(4097): n is a, c, g, or t
tttgaaacctgaatatgtatttcattgtataatttactgttaggtcaccctcgtcgactgaaagtgaaacctgattctgaaattttagttatagaaaatggaacagctttcccatttcaggtggaagttttagatgaatcagacaacataacagcacaaccaaaattgattgttcattgtaagttttcaggtgctccaaaccttccagtctatgttgtagattgcagtagttctggaaccagtattttaacaggatctgcaattcaagttcagaatattaaaaaagaccagacgcttaaagcaagaattgaaatacctagttgtaaagatgtggcacctgtggagaagactattaagttgcttcccagtagccatgttgcaagactacaaatattcagtgtagaaggacaaaaggcaattcagatcaaacatcaggatgaggttaattggatagcgggtgatattatgcataatcttatttttcaaatgtatgatgaaggagaaagagaaatcaatataacatcagctttagcagaaaaaattaaagttaattggactcctgagattaacaaagaacacttgctacagggtctgcttcctgatgtgcaagtaccaacatctgtaaaagatatgcgctattgccaggtttcattccaagatgatcatgtgtctttggaaagtgcgtttacagtaagaccacttcctgatgaacctaaacatttaaaatgtgaaatgaaaggaggaaaaacagtacagatgggccaagagcttcaaggagaagtagatcagtacggaaatcagattcaagcattttcaccaagttctttatcttctttgtcaattgctggggttggacttgatagctcaaatttgaaaacaacctttcaggaaaacacacagagtataagtgtaagaggcatcaaatttattccaggtcctcctggaaataaggatctttgttttacttggcgtgagttttctgactttattcgagtgcaactaatttctggacctcctgctaaacttctccttatagactggccagaactaaaggagtccattccagtgattaatggaagagatttacagaaccctattattgttcaactttgtgatcagtgggataatccagcaccggtacaacatgttaaaataagtcttacaaaagctagcaatttaaaggttaaagccatctataacaaaagtatcatagaaggacctataattaagttaatgattcttccagacccagaaaaacccgttcgtctcaatgttaaatatgacaaagatgcatccttcttagcagggggtcttttcactgatgacagtatcattaaaaacattaatccagcacgtatttccatgaaaatgtggaagctgtctaccagtgggaaccgacccccagcaaatgatgactacgacaaccatactggaattgatttggttggcactataatagccaccattaaaggctctaatgaggaagatactgataccccactttttattgggaaagttagaacacttgaattccccttcgtgaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacagggcataatagctgatcatttagaagtatcacttgtggtggattgggaattgattgtatgatcaaaatgatgtgcaatatattcatgttttccatattgtctttttttaaatttaaaaagtcatgtgctttaatatctttttaaaatttctttttatttagatctctacctcatttccgaaatggaaaattgtattttaaacccattggagatccagtctttgctcgagacttgttaacatttccagataatgtagaacattgtgaaacaggtaaaagacattatggtgactttacttttgtacagatgttaaatttgtgacacaaatctataaattactgataatgaaaatttatattcttattttgcttatcagtcatagttttatcagtttttttagagtacaaataaaattagaacgaatactagcactctttcaaagaaagacttgcaatgtgcattatattttaatatggccaaggaaaatatcataattttcaaaattcatttattgacttttttagtatttggtatgctgttaggagacaccattattttggataatctggatgcggccaatcattatagaaaagaggtatgtatttgatttctttttaaatttgtagacttcagttttaatgtgtatcatgtccatttgatgatacatatacaaacgactagccttttcaaaaccaatttaaattctgcaaattgataagcaacataaaagtaggcaaaacgtaggaatgaatggaccaggatgcaaatttaaatagatgttttggggctacgaaattgtctaagactcaaaacagtgtctgttaggattggaaaaaagtactgtcaggtaattttggtgtaaaatgtaatttgctgtagccctttgtattggttttctagggcagccattaactgatgtgaataatagaaatattactgtcccacaacagactgggtggcttaaataatagaaatttattgtatcacagttctggaagctggagatccaaattcacagtttcaggagggttggttacctctaaagactgtgaatgaaggatctgttccaggcctctccctgccttggagatgaggactctcttccccctgtctcttcacatctgtgcgtgactgtgttcaaatttcccccttgttgtaaggataccagtcatactggattagggcccaccgcagtgacctcatattaacttgattatctcagtaaagaccctatctccaaataatgtcacattctgagggactgggggttacggactttaacatggatttgttgggggctggtcccaaacaaaggtaatgagttatctcaattgatggttcaccatcagctacagatctaactctgttttattctttcctccccttcttactagtctacttgactggtcttgtaaaaagtaaataaataaaagattatagtggagcacagtttagcccatagcacctttgcaggggagtttggtaaaataaatatttcagttatttactgctgctatatatataacactctaaattgtaagtttaaacaacaacatattagtcctctttgtagatttctccaagtgatgttggctagttgaactggggtggtggcagctctaaaatgcctgccttatgtagctggcaactggtacctgttgtcatctggcatcagctggtattagccaggggttcttttggggatgtctgctagggttattgttctcacccatgagggtgagatagagtagggtaatgccatttagagttttagaagcccttttgtctagctaagaggatccaggagggcagtagtttaaatctttcagaggtcttaacaaaggaacatccttgacttgattttaaccctaaagccacatgttataggcagtaccctggattgatctaagccagtatctgtaaatagtgtattctagaatcacggggactatagggatcatctaggatgatctaggacgagtgagaatagatgagagaccttaagctgagaacaaataatggagagctggacatgtgatgcatgcatgtagttccagctacttgggaagctgagggaggggatcatttgaggtcagaagttcgagactagcctggccaacatggtgaaatcccgtctctactaaaaatacaaaaattagccaggcgtggtggcaggcacctgtaatcccaggtacttaggaggctgaggcaggagaatcacttgatcctgggaggtggaggttgcagtgagctgagatcatgccactgtgctctaccctgggggtagtagaacaagancctgtctctttaaaaataaaaagtaggtggggatgggaggagaatnantttttccgtagttagaatattatctaactgttact

SEQ ID NO: 462557 - DNA, 861 bp, Homo sapiens
cgtccttcattatacctaccctttaaaaaaaaaaaaaaaaaaaaggcaataataaattcatcttagtttaggaaaactaaattactgggattttgagcattatatagctaattggaaaatggtatttggcatcttcatgaacgtttccttgtaaacctaatattaagtataatacactgtaccagaaactggctgtgggtgggagagctactatattctggtagtgattagcatttttatatatcccgaattatgaaatagaaacatacccattaaatgttatgataacatggaatcagtttggagacggtgagaagcttgctggtaaggattgaactaactaataggatggtaaccggaagactcctgttcaatgagatatttggatacttactatgtatgagacacagtagtgtgctattatgtgttgaactagctctctgaggaggcatgtggaagtccctgatttgtagcttttgccaatttctatggtgtaagtacttgtatcatggatgatttccagcagtctgtatgaagtccttcatgcctatatgaatgtggtgttcaggagacctggctttcatgacccagtacaagctggttccagcgtatcactaggcacagtgcactgagggttatacagtgatgaattagacaaaccagatagcctttggaaactccagctgagattagctaaaatgctatttcagatatgtatcttaatgaactggcaagagagtcaggattctaagtggaagtgggaacctggagagacaaacagaacactaatgccagatttttgcagtgagaacgtttgccaaactaattgaaccggatagcttcacaggatccgctagatca

SEQ ID NO: 462558 - DNA, 919 bp, Homo sapiens
gacttaggatcgggaatggctgccttctatttgtaccacccaggtctgggagtatgggtggagcacttcccactgttcccaatgctctccaagtcagatccagtgcttgagggtaagccagagaaattttcatttggtcttctggatcttccttttcgtgttggagttccatttaatatccctctggagtttcaggatgaatttggtcataccagtcaactagtaactgatattcagccagttcttgaagcaagtggtttatctttacattatgaagaaataaccaaaggaccaaattgtgtaattcgaggtgttacagccaagggccctgtaaactcttgtcaaggcaagaattataatctgaaggttactctgcctggcttaaaagaagactcacagattttgaaaattagattactacctggtcaccctcgtcgactgaaagtgaaacctgattctgaaattttagttatagaaaatggaacagctttcccatttcaggtggaagttttagatgaatcagacaacataacagcacaaccaaaattgattgttcattgtaaggtaagcttattggaagatatttagattgagtcccattgtagtaagtggcaatgactattttagccacttaatagtaagtcttacacaggatttaagtctgaaacgattattccgtggaaggatttgtgggatcttattgccaatagtttttttttttaatcgtacctaaaccaataaagatgccaactgtgcccagtttcataaatttgtgaataaaagtttactcacctctcctctcttgactccatgcctctcatttcatatatatgaatagaaagacaaaaatgtctttcaggattgggaatgggctgctctgcctatggagtagccattctttattcctttactttaggga

SEQ ID NO: 462559 - DNA, 5281 bp, Homo sapiens
gacttaggatcgggaatggctgccttctatttgtaccacccaggtctgggagtatgggtggagcacttcccactgttcccaatgctctccaagtcagatccagtgcttgagggtaagccagagaaattttcatttggtcttctggatcttccttttcgtgttggagttccatttaatatccctctggagtttcaggatgaatttggtcataccagtcaactagtaactgatattcagccagttcttgaagcaagtggtttatctttacattatgaagaaataaccaaaggaccaaattgtgtaattcgaggtgttacagccaagggccctgtaaactcttgtcaaggcaagaattataatctgaaggttactctgcctggcttaaaagaagactcacagattttgaaaattagattactacctggtcaccctcgtcgactgaaagtgaaacctgattctgaaattttagttatagaaaatggaacagctttcccatttcaggtggaagttttagatgaatcagacaacataacagcacaaccaaaattgattgttcattgtaagttttcaggtgctccaaaccttccagtctatgttgtagattgcagtagttctggaaccagtattttaacaggatctgcaattcaagttcagaatattaaaaaagaccagacgcttaaagcaagaattgaaatacctagttgtaaagatgtggcacctgtggagaagactattaagttgcttcccagtagccatgttgcaagactacaaatattcagtgtagaaggacaaaaggcaattcagatcaaacatcaggatgaggttaattggatagcgggtgatattatgcataatcttatttttcaaatgtatgatgaaggagaaagagaaatcaatataacatcagctttagcagaaaaaattaaagttaattggactcctgagattaacaaagaacacttgctacagggtctgcttcctgatgtgcaagtaccaacatctgtaaaagatatgcgctattgccaggtttcattccaagatgatcatgtgtctttggaaagtgcgtttacagtaagaccacttcctgatgaacctaaacatttaaaatgtgaaatgaaaggaggaaaaacagtacagatgggccaagagcttcaaggagaagtagatcagtacggaaatcagattcaagcattttcaccaagttctttatcttctttgtcaattgctggggttggacttgatagctcaaatttgaaaacaacctttcaggaaaacacacagagtataagtgtaagaggcatcaaatttattccaggtcctcctggaaataaggatctttgttttacttggcgtgagttttctgactttattcgagtgcaactaatttctggacctcctgctaaacttctccttatagactggccagaactaaaggagtccattccagtgattaatggaagagatttacagaaccctattattgttcaactttgtgatcagtgggataatccagcaccggtacaacatgttaaaataagtcttacaaaagctagcaatttaaaggttaaagccatctataacaaaagtatcatagaaggacctataattaagttaatgattcttccagacccagaaaaacccgttcgtctcaatgttaaatatgacaaagatgcatccttcttagcagggggtcttttcactgatgacagtatcattaaaaacattaatccagcacgtatttccatgaaaatgtggaagctgtctaccagtgggaaccgacccccagcaaatgatgactacgacaaccatactggaattgatttggttggcactataatagccaccattaaaggctctaatgaggaagatactgataccccactttttattgggaaagttagaacacttgaattccccttcgtgaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacagggcataatagctgatcatttagaagtatcacttgtggtggattgggaattgattgtatgatcaaaatgatgtgcaatatattcatgttttccatattgtctttttttaaatttaaaaagtcatgtgctttaatatctttttaaaatttctttttatttagatctctacctcatttccgaaatggaaaattgtattttaaacccattggagatccagtctttgctcgagacttgttaacatttccagataatgtagaacattgtgaaacaggtaaaagacattatggtgactttacttttgtacagatgttaaatttgtgacacaaatctataaattactgataatgaaaatttatattcttattttgcttatcagtcatagttttatcagtttttttagagtacaaataaaattagaacgaatactagcactctttcaaagaaagacttgcaatgtgcattatattttaatatggccaaggaaaatatcataattttcaaaattcatttattgacttttttagtatttggtatgctgttaggagacaccattattttggataatctggatgcggccaatcattatagaaaagaggtatgtatttgatttctttttaaatttgtagacttcagttttaatgtgtatcatgtccatttgatgatacatatacaaacgactagccttttcaaaaccaatttaaattctgcaaattgataagcaacataaaagtaggcaaaacgtaggaatgaatggaccaggatgcaaatttaaatagatgttttggggctacgaaattgtctaagactcaaaacagtgtctgttaggattggaaaaaagtactgtcaggtaattttggtgtaaaatgtaatttgctgtagccctttgtattggttttctagggcagccattaactgatgtgaataatagaaatattactgtcccacaacagactgggtggcttaaataatagaaatttattgtatcacagttctggaagctggagatccaaattcacagtttcaggagggttggttacctctaaagactgtgaatgaaggatctgttccaggcctctccctgccttggagatgaggactctcttccccctgtctcttcacatctgtgcgtgactgtgttcaaatttcccccttgttgtaaggataccagtcatactggattagggcccaccgcagtgacctcatattaacttgattatctcagtaaagaccctatctccaaataatgtcacattctgagggactgggggttacggactttaacatggatttgttgggggctggtcccaaacaaaggtaatgagttatctcaattgatggttcaccatcagctacagatctaactctgttttattctttcctccccttcttactagtctacttgactggtcttgtaaaaagtaaataaataaaagattatagtggagcacagtttagcccatagcacctttgcaggggagtttggtaaaataaatatttcagttatttactgctgctatatatataacactctaaattgtaagtttaaacaacaacatattagtcctctttgtagatttctccaagtgatgttggctagttgaactggggtggtggcagctctaaaatgcctgccttatgtagctggcaactggtacctgttgtcatctggcatcagctggtattagccaggggttcttttggggatgtctgctagggttattgttctcacccatgagggtgagatagagtagggtaatgccatttagagttttagaagcccttttgtctagctaagaggatccaggagggcagtagtttaaatctttcagaggtcttaacaaaggaacatccttgacttgattttaaccctaaagccacatgttataggcagtaccctggattgatctaagccagtatctgtaaatagtgtattctagaatcacggggactatagggatcatctaggatgatctaggacgagtgagaatagatgagagaccttaagctgagaacaaataatggagagctggacatgtgatgcatgcatgtagttccagctacttgggaagctgagggaggggatcatttgaggtcagaagttcgagactagcctggccaacatggtgaaatcccgtctctactaaaaatacaaaaattagccaggcgtggtggcaggcacctgtaatcccaggtacttaggaggctgaggcaggagaatcacttgatcctgggaggtggaggttgcagtgagctgagatcatgccactgcactccagtccggggtgacagagcaagactctatctaaaaaaaaaaaaaaaaaaaaaaaaaaaaggcaataataaattcatcttagtttaggaaaactaaattactgggattttgagcattatatagctaattggaaaatggtatttggcatcttcatgaacgtttccttgtaaacctaatattaagtataatacactgtaccagaaactggctgtgggtgggagagctactatattctggtagtgattagcatttttatatatcccgaattatgaaatagaaacatacccattaaatgttatgataacatggaatcagtttggagacggtgagaagcttgctggtaaggattgaactaactaataggatggtaaccggaagactcctgttcaatgagatatttggatacttactatgtatgagacacagtagtgtgctattatgtgttgaactagctctctgaggaggcatgtggaagtccctgatttgtagcttttgccaatttctatggtgtaagtacttgtatcatggatgatttccagcagtctgtatgaagtccttcatgcctatatgaatgtggtgttcaggagacctggctttcatgacccagtacaagctggttccagcgtatcactaggcacagtgcactgagggttatacagtgatgaattagacaaaccagatagcctttggaaactccagctgagattagctaaaatgctatttcagatatgtatcttaatgaactggcaagagagtcaggattctaagtggaagtgggaacctggagagacaaacagaacactaatgccagatttttgcagtgagaacgtttgccaaactaattgaaccggatagcttcacaggatccgctagatca

SEQ ID NO: 462560 - DNA, 5040 bp, Homo sapiens
gttcaattctacacattgattgttcattgtaagttttcaggtgctccaaaccttccagtctatgttgtagattgcagtagttctggaaccagtattttaacaggatctgcaattcaagttcagaatattaaaaaagaccagacgcttaaagcaagaattgaaatacctagttgtaaagatgtggcacctgtggagaagactattaagttgcttcccagtagccatgttgcaagactacaaatattcagtgtagaaggacaaaaggcaattcagatcaaacatcaggatgaggttaattggatagcgggtgatattatgcataatcttatttttcaaatgtatgatgaaggagaaagagaaatcaatataacatcagctttagcagaaaaaattaaagttaattggactcctgagattaacaaagaacacttgctacagggtctgcttcctgatgtgcaagtaccaacatctgtaaaagatatgcgctattgccaggtttcattccaagatgatcatgtgtctttggaaagtgcgtttacagtaagaccacttcctgatgaacctaaacatttaaaatgtgaaatgaaaggaggaaaaacagtacagatgggccaagagcttcaaggagaagtagatcagtacggaaatcagattcaagcattttcaccaagttctttatcttctttgtcaattgctggggttggacttgatagctcaaatttgaaaacaacctttcaggaaaacacacagagtataagtgtaagaggcatcaaatttattccaggtcctcctggaaataaggatctttgttttacttggcgtgagttttctgactttattcgagtgcaactaatttctggacctcctgctaaacttctccttatagactggccagaactaaaggagtccattccagtgattaatggaagagatttacagaaccctattattgttcaactttgtgatcagtgggataatccagcaccggtacaacatgttaaaataagtcttacaaaagctagcaatttaaaggttaaagccatctataacaaaagtatcatagaaggacctataattaagttaatgattcttccagacccagaaaaacccgttcgtctcaatgttaaatatgacaaagatgcatccttcttagcagggggtcttttcactgatgacagtatcattaaaaacattaatccagcacgtatttccatgaaaatgtggaagctgtctaccagtgggaaccgacccccagcaaatgatgactacgacaaccatactggaattgatttggttggcactataatagccaccattaaaggctctaatgaggaagatactgataccccactttttattgggaaagttagaacacttgaattccccttcgtgaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacagggcataatagctgatcatttagaagtatcacttgtggtggattgggaattgattgtatgatcaaaatgatgtgcaatatattcatgttttccatattgtctttttttaaatttaaaaagtcatgtgctttaatatctttttaaaatttctttttatttagatctctacctcatttccgaaatggaaaattgtattttaaacccattggagatccagtctttgctcgagacttgttaacatttccagataatgtagaacattgtgaaacaggtaaaagacattatggtgactttacttttgtacagatgttaaatttgtgacacaaatctataaattactgataatgaaaatttatattcttattttgcttatcagtcatagttttatcagtttttttagagtacaaataaaattagaacgaatactagcactctttcaaagaaagacttgcaatgtgcattatattttaatatggccaaggaaaatatcataattttcaaaattcatttattgacttttttagtatttggtatgctgttaggagacaccattattttggataatctggatgcggccaatcattatagaaaagaggtatgtatttgatttctttttaaatttgtagacttcagttttaatgtgtatcatgtccatttgatgatacatatacaaacgactagccttttcaaaaccaatttaaattctgcaaattgataagcaacataaaagtaggcaaaacgtaggaatgaatggaccaggatgcaaatttaaatagatgttttggggctacgaaattgtctaagactcaaaacagtgtctgttaggattggaaaaaagtactgtcaggtaattttggtgtaaaatgtaatttgctgtagccctttgtattggttttctagggcagccattaactgatgtgaataatagaaatattactgtcccacaacagactgggtggcttaaataatagaaatttattgtatcacagttctggaagctggagatccaaattcacagtttcaggagggttggttacctctaaagactgtgaatgaaggatctgttccaggcctctccctgccttggagatgaggactctcttccccctgtctcttcacatctgtgcgtgactgtgttcaaatttcccccttgttgtaaggataccagtcatactggattagggcccaccgcagtgacctcatattaacttgattatctcagtaaagaccctatctccaaataatgtcacattctgagggactgggggttacggactttaacatggatttgttgggggctggtcccaaacaaaggtaatgagttatctcaattgatggttcaccatcagctacagatctaactctgttttattctttcctccccttcttactagtctacttgactggtcttgtaaaaagtaaataaataaaagattatagtggagcacagtttagcccatagcacctttgcaggggagtttggtaaaataaatatttcagttatttactgctgctatatatataacactctaaattgtaagtttaaacaacaacatattagtcctctttgtagatttctccaagtgatgttggctagttgaactggggtggtggcagctctaaaatgcctgccttatgtagctggcaactggtacctgttgtcatctggcatcagctggtattagccaggggttcttttggggatgtctgctagggttattgttctcacccatgagggtgagatagagtagggtaatgccatttagagttttagaagcccttttgtctagctaagaggatccaggagggcagtagtttaaatctttcagaggtcttaacaaaggaacatccttgacttgattttaaccctaaagccacatgttataggcagtaccctggattgatctaagccagtatctgtaaatagtgtattctagaatcacggggactatagggatcatctaggatgatctaggacgagtgagaatagatgagagaccttaagctgagaacaaataatggagagctggacatgtgatgcatgcatgtagttccagctacttgggaagctgagggaggtttgcttgaacccaagagttcaaggctataggctgtcgtgtgctctgatcatgcctatgaatagccactgcactccagcctaggcaatataatgcgattctgtctaaaaaaataaaaattgttaaagaggtgggggatttgtcccaagtcacactttactaatttatggcagagctagaactaaactggtatgagtaatttttctttgggcctcgttaagaagcaataatagggcaccgggtacagtggctcctgcctgtaatcccagcactttgcgaggccaaggtaggggatcatttgaggtcagaagttcgagactagcctggccaacatggtgaaatcccgtctctactaaaaatacaaaaattagccaggcgtggtggcaggcacctgtaatcccaggtacttaggaggctgaggcaggagaatcacttgatcctgggaggtggaggttgcagtgagctgagatcatgccactgcactccagtccggggtgacagagcaagactctatctaaaaaaaaaaaaaaaaaaaaaaaaaaaaggcaataataaattcatcttagtttaggaaaactaaattactgggattttgagcattatatagctaattggaaaatggtatttggcatcttcatgaacgtttccttgtaaacctaatattaagtataatacactgtaccagaaactggctgtgggtgggagagctactatattctggtagtgattagcatttttatatatcccgaattatgaaatagaaacatacccattaaatgttatgataacatggaatcagtttggagacggtgagaagcttgctggtaaggattgaactaactaataggatggtaaccggaagactcctgttcaatgagatatttggatacttactatgtatgagacacagtagtgtgctattatgtgttgaactagctctctgaggaggcatgtggaagtccctgatttgtagcttttgccaatttctatggtgtaagtacttgtatcatggatgatttccagcagtctgtatgaagtccttcatgcctatatgaatgtggtgttcaggagacctggctttcatgacccagtacaagctggttccagcgtatcactaggcacagtgcactgagggttatacagtgatgaattagacaaaccagatagcctttggaaactccagctgagattagctaaaatgctatttcagatatgtatcttaatgaactggcaagagagtcaggattctaagtggaagtgggaacctggagagacaaacagaacactaatgccagatttttgcagtgagaacgtttgccaaactaattgaaccggatagcttcacaggatccgctagatca

SEQ ID NO: 462561 - DNA, 2965 bp, Homo sapiens
gtgtaggctccctggatgaagagtgttccagcaacacgggatagtatgatccagttagaaatcaggaaaattgatgatcctctgcagcatcacttgcaaaatcaaagtattcagaagagtgtgaaacagtgccatgaacagaatatgtttggaaatattgttaatcagaacaaaggtcatttcctgctgaagcaagattgtgatacgtttgacttacatgaaaaacctttaaaatcaaatttaagttttgaaaaccagaaaaggagctctggcctaaagaactctgctgagtttaatagagatgggaaatccctttttcatgctaaccataaacaattttatactgaaatgaagtttcctgcaattgcaaaacctattaataagtcccagttcattaagcaacagagaactcacaacatagagaatgcccatgtatgcagtgaatgtgggaaagccttcctcaagttgtctcagtttattgatcatcagagagttcacactggagaaaaacctcatgtatgcagtatgtgtgggaaagctttctccagaaaatccagactaatggaccatcagagaactcatacagaactgaaacattatgaatgcactgaatgtgacaaaaccttcctcaagaaatcacagctcaatatacatcagaaaactcatatgggagggaaaccttacacatgtagccaatgtgggaaagccttcatcaagaagtgtcggctcatttatcatcaacgaactcatacaggagagaaaccccatggatgcagtgtatgtgggaaggccttctctacaaagttcagtctcactacacatcagaaaactcatacaggagaaaaaccttatatatgtagtgaatgtggaaaaggcttcattgagaagaggcgtcttactgcacatcatcgaactcatactggtgagaaaccctttatatgcaataaatgtgggaaaggcttcaccttgaagaacagtcttatcacacatcagcaaactcatacaggagagaaattatatacatgtagtgaatgtggaaaaggcttttcaatgaagcactgtctcatggtacatcaacgaactcatactggagagaaaccttataaatgcaatgagtgtggaaagggcttcgctttgaagagcccactcatcagacatcagcgaacacatactggagagaaaccctatgtatgcaccgaatgtcgaaaaggtttcaccatgaagagtgacctcattgtacatcagcgaactcatactgcagagaagccatatatatgcaatgattgtggaaaaggcttcactgtgaagagccgccttattgtgcatcagcgaactcatactggagaaaaaccctatgtatgtggtgagtgtggaaaaggctttccagcaaagatccggctaatgggacatcaacgaactcatacaggagagaaaccttatatttgcaatgagtgtggaaaaggcttcactgagaagagtcatctcaatgtacatcggcgcactcatacaggagagaaaccctatgtatgcagtgaatgtggcaaaggcttaactgggaaaagcatgctcattgcacatcagcgaactcatactggggagaaaccttatatatgcaatgaatgtggaaagggcttcaccatgaagagtactctcagtatacatcagcaaactcatactggagagaagccatacaaatgcaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacttcaacagattgagagagttcacactggagaaatactttcctctggcaaacccctgtggcagggttttcagtaaaatgttttgcctcatcgtgtgctaggaaataatgcagaaaaaacttatgaaaacattcaatgtagaagacttttaggaaaatatcagagaatttaatgaaggaaagaagccttggcaaaatgatggatgagagctttctgtcacaattctaaccttaacagataatatgcctcatgtgcatttgggaacaggatagcttgagccatattcctagttgccttgtcactgattttatacattttaaattgtgacttcctctaatcacgaactaaaatttaatattgtatataataccggagtattttatgcctgcctcattttattatatgattagctcctgcatttctttggttctaagtttgtgttatttcagaataactaaagtacttcagaatgaaactggatacagtatattcagttcataagtgtaattgaccatacttgaatatgtttaagtttataagtaacatcaggtgttatgaaattaatataaataagatgtttttttttatactttctcttaaacttagatctatgatctatttt

SEQ ID NO: 462562 - DNA, 564 bp, Homo sapiens
ggtgtattaaacacatttcaacttgcaatactttcaacctatgatgtactcaccggaatgtaacccattgtaaactgaggaacacctgtactcaccccactggaagggatgtgggaggaaggtcaagcgcctcttccaggtcagaaggggcagaggttggatacaaaccaggcagcctgggtccatggtaaaagaacctccactaagtgaggctggtctccagagcgagtcaccccctggctcccagacagccacacctggtgaaggagaatgcggtgacaatggagagaacccccaggttcagtaagctgcctcgtctggctcactacacctagctgtggggagatctcctcgtcagtcacctcagcctttggcgcacagaagggtccagggtcccctgctcagaggctaacactggccgaagagaaaggcaatttcagttggggtgactgtggcaggaaggggctcactctggccccaccaaggtgaggtggggaccaagtgatagagccctgatccacccactctctgaaacttctttgctaataaaacattcctactaaa

SEQ ID NO: 462563 - DNA, 2681 bp, Homo sapiens
agcccaggcgcctggacatccagcgagtccctggccagtgacgacggtggagcaccgggcatactctcccagggcgcgccctcggggctcctgatgcagccgctgtcgccgcgcgcgcccgtgcgcaacccgcgcgtcgagcacacgctccgggagaccagccggcggctggagctggcgcagacacacgagcgcgcgcccagccccggccgcggggtcccgcgcagcccacgcgggtccggccgcagcagccccgcccctaaccttgcccctgcttcgccccggccctgcccaactgcagctggtgcgcgagcagatggccgcggcgctgcggcgcctgcgcgagctcgaggaccaggcgcgaacgctgcccgagctgcaggagcaggtgcgcgcgctgcgcgccgagaaggcgcggctgctggccgggcgcgcgcagcccgagccggacggggaggctgagacgcgcccggacaagctcgcccagctgcggcggctcaccgagcgcctggccacctccgagcgcggcggccgtgccagggccagcccccgggctgacagcccagacggcctggctgcagggcgcagcgagggcgcgctccaggtcctcgacggggaggtcgggagtctcgatgggacgccccagacccgggaggtggccgccgaggccgtgcccgagacccgagaagcgggtgcccaggccgtgccggagacccgggaggccggcgtggaggctgcccccgagaccgtggaggcggacgcgtgggtgaccgaggcgctgctggggctgcctgcggccgccgagcgcgagctagagctgctgcgcgccagcctggagcaccagcgcggggtgagtgagcttctgcggggccggttgcgggagctggaggaagcccgcgaggctgcggaggaggcagcggcgggggcccgggcccagctacgcgaggccaccacccagaccccgtggagctgtgccgaaaaggccgcgcagaccgagtccccggcagaggcgccctccttgactcaggagagctcgcccggatccatggacggagacagggccgtggcgcccgcgggcatcctcaaatccatcatgaagaagagagacggcacacctggtgcccaacccagctccggacccaagagcctgcagtttgttggggtcctcaacggagagtgagcgcctttcccctcctgtggcagcttctgccgggacatagactggggttggaaccccagctctgcccctctactggcagcgtggtctgggcaatcctcagtttcctcatcgttaaatgggaacggccacacccacatcgcaggactccagaacgagcccacaggggaggtttagcagacacctcccaccctgcccccaggtacgagagctcctccagcgaggacgccagcgacagcatggcgacagcgagaacggtggcgccgagcccccgggtagctcctcgggctccggggatgacagcggcgggggatccgactcgggcacccctggccctcccagcggcggggacatccgggaccctgagcccgaggcggaggcagagcctcagcaggtggcacaggggaggtgcgagctgagcccgcgtctgagggaggcgtgcgtagcgctgcagcggcagctgagccggccccgcggagtagccagcgacggcggcgcagtgcgcctcgtggcccaggagtggtttcgagtgtccagccagcggcgctctcaggcggagcccgtggccaggatgctggaaggggtgaggcgcctgggacccgaactgctggcgcacgtggtgaacctggcggatggcaacgggaacacggccctgcactacagtgtgtcccacgggaacctggccatcgcaagcctgctcctggatacgggggcctgcgaggtcaaccgccagaaccgagccggctactcggccctcatgctggctgcactcacctctgtgaggcaggaagaggaggacatggctgtggtccagagactcttctgcatgggtgatgtcaatgccaaggccagtcagacggggcagacagccctcatgctggccatcagccatggccgacaggacatggtggcaaccctactggcgtgtggggctgatgtgaatgcgcaggatgcggatggggccacagcgctgatgtgtgccagtgagtatgggcgcctggacaccgtgcggctgctgctcacccagccaggctgtgaccctgccatcctggacaatgagggcaccagtgccctggccatcgccctggaggctgagcaggatgaggtggccgctctgctacatgcccacctgagctcgggccagcccgacacccagtctccagagcgagtcaccccctggctcccagacagccacacctggtgaaggagaatgcggtgacaatggagagaacccccaggttcagtaagctgcctcgtctggctcactacacctagctgtggggagatctcctcgtcagtcacctcagcctttggcgcacagaagggtccagggtcccctgctcagaggctaacactggccgaagagaaaggcaatttcagttggggtgactgtggcaggaaggggctcactctggccccaccaaggtgaggtggggaccaagtgatagagccctgatccacccactctctgaaacttctttgctaataaaacattcctactaaa

SEQ ID NO: 462564 - DNA, 503 bp, Homo sapiens
ggcagcctgggtccatggtaaaagaacctccactaagtgaggctggggctgaatcccacgtttcctgcctcaaggagattgcagcaggcccccctcttttcccctctctccagagcgagtcaccccctggctcccagacagccacacctggtgaaggagaatgcggtgacaatggagagaacccccaggttcagtaagctgcctcgtctggctcactacacctagctgtggggagatctcctcgtcagtcacctcagcctttggcgcacagaagggtccagggtcccctgctcagaggctaacactggccgaagagaaaggcaatttcagttggggtgactgtggcaggaaggggctcactctggccccaccaaggtgaggtggggaccaagtgatagagccctgatccacccactctctgaaacttctttgctaataaaacattcctactaaacttgtgttttgtttggggtagagggtgcaatcgacaaacacgacccccc

SEQ ID NO: 462565 - DNA, 2478 bp, Homo sapiens
agcccaggcgcctggacatccagcgagtccctggccagtgacgacggtggagcaccgggcatactctcccagggcgcgccctcggggctcctgatgcagccgctgtcgccgcgcgcgcccgtgcgcaacccgcgcgtcgagcacacgctccgggagaccagccggcggctggagctggcgcagacacacgagcgcgcgcccagccccggccgcggggtcccgcgcagcccacgcgggtccggccgcagcagccccgcccctaaccttgcccctgcttcgccccggccctgcccaactgcagctggtgcgcgagcagatggccgcggcgctgcggcgcctgcgcgagctcgaggaccaggcgcgaacgctgcccgagctgcaggagcaggtgcgcgcgctgcgcgccgagaaggcgcggctgctggccgggcgcgcgcagcccgagccggacggggaggctgagacgcgcccggacaagctcgcccagctgcggcggctcaccgagcgcctggccacctccgagcgcggcggccgtgccagggccagcccccgggctgacagcccagacggcctggctgcagggcgcagcgagggcgcgctccaggtcctcgacggggaggtcgggagtctcgatgggacgccccagacccgggaggtggccgccgaggccgtgcccgagacccgagaagcgggtgcccaggccgtgccggagacccgggaggccggcgtggaggctgcccccgagaccgtggaggcggacgcgtgggtgaccgaggcgctgctggggctgcctgcggccgccgagcgcgagctagagctgctgcgcgccagcctggagcaccagcgcggggtgagtgagcttctgcggggccggttgcgggagctggaggaagcccgcgaggctgcggaggaggcagcggcgggggcccgggcccagctacgcgaggccaccacccagaccccgtggagctgtgccgaaaaggccgcgcagaccgagtccccggcagaggcgccctccttgactcaggagagctcgcccggatccatggacggagacagggccgtggcgcccgcgggcatcctcaaatccatcatgaagaagagagacggcacacctggtgcccaacccagctccggacccaagagcctgcagtttgttggggtcctcaacggagagtacgagagctcctccagcgaggacgccagcgacagcatggcgacagcgagaacggtggcgccgagcccccgggtagctcctcgggctccggggatgacagcggcgggggatccgactcgggcacccctggccctcccagcggcggggacatccgggaccctgagcccgaggcggaggcagagcctcagcaggtggcacaggggaggtgcgagctgagcccgcgtctgagggaggcgtgcgtagcgctgcagcggcagctgagccggccccgcggagtagccagcgacggcggcgcagtgcgcctcgtggcccaggagtggtttcgagtgtccagccagcggcgctctcaggcggagcccgtggccaggatgctggaaggggtgaggcgcctgggacccgaactgctggcgcacgtggtgaacctggcggatggcaacgggaacacggccctgcactacagtgtgtcccacgggaacctggccatcgcaagcctgctcctggatacgggggcctgcgaggtcaaccgccagaaccgagccggctactcggccctcatgctggctgcactcacctctgtgaggcaggaagaggaggacatggctgtggtccagagactcttctgcatgggtgatgtcaatgccaaggccagtcagacggggcagacagccctcatgctggccatcagccatggccgacaggacatggtggcaaccctactggcgtgtggggctgatgtgaatgcgcaggatgcggatggggccacagcgctgatgtgtgccagtgagtatgggcgcctggacaccgtgcggctgctgctcacccagccaggctgtgaccctgccatcctggacaatgagggcaccagtgccctggccatcgccctggaggctgagcaggatgaggtggccgctctgctacatgcccacctgagctcgggccagcccgacacccagtctccagagcgagtcaccccctggctcccagacagccacacctggtgaaggagaatgcggtgacaatggagagaacccccaggttcagtaagctgcctcgtctggctcactacacctagctgtggggagatctcctcgtcagtcacctcagcctttggcgcacagaagggtccagggtcccctgctcagaggctaacactggccgaagagaaaggcaatttcagttggggtgactgtggcaggaaggggctcactctggccccaccaaggtgaggtggggaccaagtgatagagccctgatccacccactctctgaaacttctttgctaataaaacattcctactaaa

SEQ ID NO: 462566 - DNA, 473 bp, Homo sapiens
ttggatagatatgtaaagagatttattatgggagttggctcatgcaattgtggagtcctagaagacccaccacctcctgtctgcaagctggagaaacagcaaagccagtgacgtaattaagtctgaatccaaaggcataagatcaaggagaactgatggtgtaagtcccaaagtccaaaggcttgagaaccaggagctctgatatctaagggaagatgtcccagctccggaagacagaattcacccttcctctgccttttgttttatttgagccctcaatgggctggatgatgcctattcacattggtgagggtggatcttctttactcagtctactgattaacacctgttccagaaacgccctcacaggcacacccagagatattgttttcccagctatctgggcaccccttagcccagtcaaatcaacacataaaattaatcatcataggctctaagttctacttagctcc

SEQ ID NO: 462567 - DNA, 2269 bp, Homo sapiens
tgtgtgctgacagtcatgaccctttggacgtctgcatgtttgtctctggggatcttgacagttaaaagtaacacagaacacccagatcaggctccacaagcctccccagcctcaggcattgctgatgaagaaaaagtaaagtcttctgtgcatctctggaatcagcttctaaagagtgacccctgggaggcaagcctgatgtgtggtgctcaaagtcgggacagtggttacactggaatggccatcaagggtccccttcctgtggggacctggattgacgatgcctgtcagagtcctggaggggtgggttctgcagcttcgccccatgctgacatgcgaatgtccaggcctgcctttctgctgcagggcaatgctccaggttacaacatcgacaccaagcagtttgttgagaaaactttggacctcatgagctgggcaagagcggcctggcaggtggtaggagagcagcctgtccatgcctcagctgtggctccactggctctgtgactgtgcagattttctaacttttgaagacctctgtttggatatccataaaataggtaagatggtgctaatacctacctgtgatgttgtgaagatttaatagcataatacttaaaagcactttgcatacattagcaaagtgcctaaatattagttatttggcggaggctattaaccagtgtgctatgaggtgcaaagtaagttgttaccaataactcaaagaactccagtttgcaaatgttttacttttacttaagagaatctttgcgggagaattaaaaccaattaattcccaccactggccaagagctcatgctgtaattatccaagacagaatagctcaacagaaaaccaagtcatgcaattctgagcacttgtccttgggatgccactttggggctcccatatctgaaatcattttgttctcagtccacctgtgtgacatttctgtcctgctcagccacgggttcacaataatcaagggaatgacccaagggattcacttcttccaagcagccgatgcctttggaagttatgttgacattgcttgtttaaacctagggcaagaaatcctttctctgccagacctgactcttcaggcacactcctcagtttggagacgtgacttgccatgtagtactgagagggaaaacaggccagaaacagccttgttgaaaacttcttttctgcttagctgccctctgaacagtcaccataaagattgtgaggtgctggagccagggatgacctcataaagccctttgctaaatacttagtgagctggtactgtgggccaggcactgtgctcatcatgaacaaaaccaaggcagacaacactgtcattaatggagcttatcatgtaatacggaagcctgggataagcaacaaattacacaagtgacaaatgtgatgagtgctgtgaagcagagtgcggggtgcccagggaatcagcagagccctggaggataacagcctgagctccaggaaggaagtttcttcaagtgtaaaatgagagattggatggatcagaagattcaggcctccttgaagatccccatgggtgaaccccaacacacaggctattcagccagcagccccaagtcctttatgaaaagccaaggttgattgaaactctcccttctcaggagagaaactagaggcaaagcttcctcatcagcagagataaacttgacaggagccaattcaggtaggaccatggccaactcagggctcgtgcttgatcgaaggggatctgtgttagtcagcattctccagagaaatggaacccattggatagatatgtaaagagatttattatgggagttggctcatgcaattgtggagtcctagaagacccaccacctcctgtctgcaagctggagaaacagcaaagccagtgacgtaattaagtctgaatccaaaggcataagatcaaggagaactgatggtcacctgtgtatacttccattatggcatgtaacatgctggcaagaaattgattcattgggttgtgtcttctcagctgcctgaagaatgaaatcatatactctagtttcatatgcccagcattgtacacaacttgacacatcacagcagctctaggaaagcacataggctgacaactgagtgaacaacccactgactgtgtgtcgttcagggttgggaaagcaagggcaggtctctgtgccccatctctagcttttcctcaacttaggctttataaacccttgcatcaaaaaataaaagctaaggctaattgtttcaa

SEQ ID NO: 462568 - DNA, 682 bp, Homo sapiens
gcaacacagcaatcatggctgtccccagtaattttgtcccctctcagtttcaacagtcttctcttggctcttcagataatggggtctgccaccaatacaccaactgtctcaagtcaggtgctgaaacaactcaaaccaggaaatatgaagacatagatatatctcatttaatgctgatacctttaacttttatgagctcagttccctcaacaaaaataagtggagagttgtacttgagaaagaatggtggcagagtacatgcatggaagtgctaccatagctgctctgaaatcagaggaaagtggaattataagaagaccccatctgacaaggctcataaaggagagcaactcttatggaatacatccaagatatatacgtctttgaagaaagacatcactcaactgtgaaagatcaccatgacccctgctttaatttcatcaaaaaacttagtccatcagctcagttaccctttagccttgcatgggaattgactcagagcttctgcgagatcagggtgaatatgaattgtttagcttcagatgatcattcctaaagtgaaaactcctggaacttattggcaaaaaagagaactctttgctatttctaatataaatgtgttattagaattggtctactgttctaataaataacagtaatggaaatggattgaaataatgaa

SEQ ID NO: 462569 - DNA, 1611 bp, Homo sapiens
ggctcaagtcagcccacagcatcccccatacagccccacctggtctgcttcaagtcctacctggcccctggcaagtcccacttggtgacatcttgtgcctgggtccttgagggctgccccagatccgcgattgtcctggggaccggtagttcctccccggatgccagcaaagctccctccagcctccacgcctgcacagtctccagtatgccttcaacagccattagtcaccctcttgtcccccacaagaacaatgttggggagtggggggattgacactcacacagaggatcccctggagactgtcatgagccctgggaaggaggagagcagtcctctccagcaggctgcttcgggcgtgctaatggctggagccaccgagggacaccaggagtttcccccctgctcgccctgcgagcggtcaagactcaggctagcccaggccatccgaaaggctaaacagcgggatgagcccaggggacggtcactgctcacccacgatcaggcatgtcctcgtgtcaccgatgatgaagcggccctagctctggagacaaaccagcaggcctgggtgttccccccacagagcacagagagcagcaggcgctgtgaggggcagcctgggtgggaaagagggaatggagggaggggtgcagaccgcagagaggccgctccaagctgaaaaatggggcacatcagccaaagttgtctttggtgggtatggagaggatgggggtgccctacagctgagtgctgaggctggaggctgcattgacccccaggtagaaggggcaccccaccgccacccccaaatccccaggtactccctcggcttcatttctgtgccctgccacataaaacaacacagccctgacgtttggaatgatctaaggctattttagacaaaaggggaagttatattttggggaatgctgcatctaagagaagagtgaaattatggggtatattttaagcaccataaaaaggtctccttggaatttggagaaagttgattaaaagctgaagtgtaaggtctgggacacccctgccacagccctgccctccccaaatgttctgggggttttactgctccagggttatggagacaggggacccatctgtctatcggcgatgtcagcctcaatgtttggggcgggagtgtgggcaggcatcaatcagccacagggcctggctgccaatttgtttcctagtgattatccaggatagatccgatttctgcaggcctcgccctgggcagctcagtccccaatgtcacagtgcagttgccacctaaggtttccttctgtgtgacttggccacagcaagccagaaccagctcctgaaaccagtcccctcgagaaccccattcccgggagtgcccagaggcagcttggcatcttctgcccagctgctgactggccctgtgaccccgacacgtggttcctcctggtaaaagaaagaaagggatgacttagcagtggtcaggcaccagcacccaacaccttccctagagggggttctctgtaaatcccggacagtatcatcacctctttaagggagagtgaattacggccacctctgtctttgtcagtgtcattacagtattctcagccc

SEQ ID NO: 462570 - DNA, 1417 bp, Homo sapiens
  misc_feature (1403)..(1403): n is a, c, g, or t
  misc_feature (1405)..(1406): n is a, c, g, or t
  misc_feature (1408)..(1408): n is a, c, g, or t
  misc_feature (1410)..(1411): n is a, c, g, or t
  misc_feature (1414)..(1415): n is a, c, g, or t
actcggaaagcagattgtggagctgactatggggaggcctgggtcctgccacagccattttcctgccaagggaggctgtgactgagcgggctacccagcctgggaaactgctttttccatggaactgtgcaacccacagttcagaagattccacttgtgaacccttgccactggagcctgagatctgaaccctggaggttgaaggtatgccagagcgtggtcattgaggacaagttgatgagagattcccgagtacatctatggtcagccttgcgaggacattacaattcagagatgtggccatagaattctctctggaggagtggcattgcctggacacagcacagcggaatttatatagggatgtgatgttagagaactacagaaacttggtcttccttgatccagtttttcaagaaaatcttcagaatttgtgcatttagaaaagaattacttccgtgcctcatgcctgtaatcccagcactttgggaggctgaggcgggggattacctgaggccaggagcttgagaccagcctggccaactaacgaaagtacaaaaaattagctgggggctgtggcacacacctgtaaccccagctacttaggagggtgaggcaggagaatcgcttgaacccaagaggcagaggttgcagtgagttgagatcatgccattacactccagcctgggtgacagagcaagtttccatctcaaggaaaaaaaaaaaagaaaaaaatttcttcaacatgtttcatctaaatataaactttccacatttctgaaatgtggcaaagctttcaaccagtcctcaaaccttactacacataagaaaattcatactggagagaaaccctacaaatgtgaagactgtggcaaagcctttaacttctcctctaaccttactacacataagaaaattcatactgaagagaaaccctacaaatgtgaagaatgtggcaaaaccttcagttggtcctctattcttattacacataaaatgattcatactggagagaaaccatacaagtgtgaacgatgtggcaaagcttttaaccattctgcaactttttttcgcataagaaaattcatattggagggaaaccatacaatgacaccccttaaatttaaactagaccttccaagcaatagaccaactcttcctgagggtaaagggcccctaactcccatggggaccttctttggtggctccccaggaagtaagaaaatgggaactgtactgcaaaaatctatggcagcagtgcctgctgtggtgggggacaattgttgtacattttatggaggctgtgaaggccccgagctctggaagcccacactatttatcagtgatcagacaaataagcaggtggtaaggacgtgcggatgtggggtaaacaggtgaggacntnngnanntcnnta

SEQ ID NO: 462571 - DNA, 848 bp, Homo sapiens
actgcacacggttttcagcctcatgcctccgtggaacctgcctgtcaggcgggcacctggaatctcaagcaactttctcaagaagggccaaggcgttatcgtcggccacgcacaagatttctctccaaacaactcacagcattgagagaattgcttgaaaagaccatgcacccaagtttggctacaatggggaaactggcttcaaagctacaacttgatctatccgtagtaaagatctggttcaagaaccagcgtgccaaatggaagaggcagcagcggcagcaaatgcagacacggccatcactagggccagcaaaccagacaacttcagtgaagaaggaggagactccctcagccataactactgcaaacattcgtccagtaagtcctggaatctctgatgcaaatgaccatgatctacgtgagccttctggtatcaagaatcctggaggagccagcgcctctgcgagggtttcatcctgggattctcagtcatatgacattgaacagatatgtctgggggcttcaaatcctccttgggcctccactctctttgaaatagatgaatttgtaaagatctatgacttgccaggggaagatgacaccagcagcctaaatcaatatctttttccagtatgccttgaggactgcatcctaaatcccctagctctggaaatggaagggattaggcatatgtgagtctccctagctcacagagaaaaaggtggttttaagcaggcacacaagcacttcagggctagccttcctccaccacactcccccaaccagagcagtgcagagaaggggtcaaaatgtacagctcccagttactcctcaaaaaggatttg

SEQ ID NO: 462572 - DNA, 3458 bp, Homo sapiens
ctctggttttccacacagcccggcagcgcgtctggagttgttcgttcctctcgatggccccgtggtcttgctggcttcaggagtgaagctgcagatcttctcggagcccagctggcttcacccagtggatcccgcactggggctgcaggtggagctgcctgccagtcctgcgccatgcgctcgcactcctcagcccttgggcggtcgatgggactcggcgccctggagcagggggcggtgctcgtagggaaggctccgcagcgccggtgggctggcattgctgggggaccctccgcagcccctggcccgggtgctaagtccctcattgcccggggccagcagggccggccggctgctccgagtgcggggcccgccaagctcacgcccatccggaactccagctggcccgcaagcgccgcgcgcagccccggttcccgctcgcgcctctccctccacaccttcccgcaagctgagggagtgggctccggccttggccagcccagaaacgggctcccacagtgccgtggtgggctgaagggctcctcaagtgccactaaagtaggagcccaggcagaggaggtgccgagagcaagcgagggctctgaggactgccagcacgctgtcacctctcaccgtaagtctctgtcagacatttctttcaaagactggggacaggtgggttctcactgtaatttatcttggcactgacaacaggagctggtttggctgcttgtagacaaggaggtcctgtgataattttacaaaatctttctgagaacatggtatgtgactgcctccctcacccagctgcctggttctgttttaactcacttcagttagccagggagagtccaggtcgtctgttgactagtgatgcttaaacattgttcaggcctcttttattcgtatgcaaagattttggcaaggtttagtccttggagacacttagatttaaaacaaatcctgttgaaacaactcttcatagcattttaatactgcagtgacacagtgtgtcaaatacagtgtaaagtgggttccatgggactaacaggttcttctggtgagcccaagtcatgctctgtggcttggtcagcagatattctgggattgaatggctaggtaagggctcctgtgatatttgaaaactcacagaaagctgtatggcaatcatattggggaatttaagaaacaaaataattgcagactgaaaatagcattttaaatgttttctttcaataaataaaagttaatggagtgtttccatgtcaagcattttctgactcattattatgtctagtactcttcgttacatgaactgagtggctgtaagattaaacaagtggattttcaatggatatacagacaggatcaaaatttttaaggactgccaaatttctactcattcattgtaaaagtataatgcatattttaggtagatttttttttttttggttttgtttttgcacttgcatggcaattaaggactacaatttagcaggagtgtgagaatttgattggaaattttattttaatcatgtatttttttaattttgtaatgctgtatgtagaaatgacaagataataattttctctttatctaatgacaagctcattttcacatgatgatttcagtatatcttataaaatatcatgaaggagatatacaaacacttagaactattgcaaataaacttttgtgtaaatttatttggaaagtgtaatgattataatgagaatgtgattgacgattcaggtcatatccttgaaaggaagcatcatattcaaaacagatgcttacatctgatttcaactctagtttttattggaagtgtttattagtagaaattgggcaaaaatgtcattttatattttacatctaccctttcacagtctgatatcaagcagtttagtagttcccaaagggtagtgttgttttgagagctggttaacaatgaaaatatatgaggagcctgggaattcaaatttatggtaagtttctcaggttatcttcatgtacaaaatttgaagacaactgatttcaaaagtagatcattctccagtttggtcataaaatcatgattaatttttaaatttctttctctaggaacttcaaaaattctcatgtcatattgataaaatgcttacaaacaatagcacaaagaccaaacttataaggagaaattgacaacggttggttcacgcaaactcaaaataataattcaaaaagcaggtcaaaaggaagattggcaacctgcagcatattatacaaactacagctcttgctttccatgaaatgcttctccttatatttacaatgtaaaaggactacattggcccaatcttcaagataaataacaaaaccgacaattttttaagcacttgcctaaacaggtggtgatgaaaagcagaaactatatttacaatactaaacaatagaaaaatactcaaagtaaacttaggatggttaacagaatctgagacctggcactgattaaaagaagggtagatatgacttccagccctggttcttggctatattgggggttaaaaaaaaaaaaaaaaaagctctacaagatctgtatctttcacttcagcccaccagagggagagcagataggagtctgttttgacttaagcaatagctgggaatatagagcatactctcacccaatatcccctgaggctttatcacttggtcacttcatggagtatttactatttggacataggtttattatgcctagatgtgaagacaaattcaaaagaacaggattaaatattaatcctttatatggagttactttttgagcctttaggatattctgaataatattcaatagatgacattctttcaacattttaaagaaattaagaagatataatttctttgcacagaatgcttatctctttattctttgtttaaacgtaacaatcgtttaatgtagaatggataacttcacaatatatagaagtgagatgtacaagtctcttgctcatgtggtaaaggtgccagtttaccaggatgtggtacaactagtaacttcttaggatccatattccatgatatgcctcatgctgtatcctcaagagtttatggctttcttacaggttttggtctctggaagataccttttctaacagctgcgtagatgtagaaaaaggatgctaatgtaaaaatttgattaatacaatgaaaattccttgattatttaatggtattaaacaaaagttaatttcttagctttgacaaatgaaccatgtttgtgtaaaatgttaatataagaagagtttggaaaaggtacatgggaattctctatactatcttcatgaaacgctaatctaaaattatttcaaaacttcaaaattgtttaaaagtgtatcatgtgacacgaaagtaaatttacttgggggattttcagataattttcttcaatatagatgggaacagattttcacag

SEQ ID NO: 462573 - DNA, 1568 bp, Homo sapiens
gaaatttcagagcaccaagaataaagagaaaatcctaaaaagcgcctagaggaaagccagatgtcatgcaaaggatcaagaatccaagcagctttgggtgtgcaaaaactagcagacaacagagcaaggctttcaaagttccaaggaaaagttattttcagctagaattgctaaataacaaaagaccaaacatgaaggtgcaataaagatataatcggatgttcaaggactccaaaacttaacttcccacataccctttctcagaaagctactggaggatgtgttccattcaaacgaggagggtcttgctgtgtcgcccaggctggagtgcagtggtgcaatcatgactcactgcatccttgaactcctgggctcaagcaatccttccacctcagcctcccaagtaggtgggaccacgggtgcacatcaccacatctggctaattaaaaaacaaaaaacaaaaaacccccacaaacatatatatatcctcatgctgccagggcccaccattgccacctctgccacgcgacctccaccagcctccaatgaggtctccacctccgtcctctcctccaccatcactcctgcaccaccaatgtcagtgctatcccatcacaccctccatatcacctccaactccagcacctcctcctcctccaccacctccagcacctccacctcctccttcatcacctcttccttcaccacctccacctccatcacctccacctccagcacctcttccttcaccacctccaccgccacgacctccacctccatctccatcacctccacctccagcatctcctcctccatcacctccacctccacttccaccacctccacctccagcaactccaccacctccaccgtcacctccacctccacttccacctccaccacctccaccatcacctccacctccacttccacctccattacctccacctccagcacctctacctctacctcctccaccttcacctccaccacctccacctccaccacctccacctccaccacctccacctctacctccgccacctcctccatctgagggtttgggtcctgacaggatgcccactccatgcagccagccctgcacctcctccaggaccctggggactgaggccctgattccaggagcaatcacccccgagaggctctgatctgaggactccagttatccctgctgttcccgctgtgtccagcagagggcagccgtccccgccccaacccaggaaagggcgggggctgtaggctgtgtctcatgcgggggaaagggggctggactggggggagaccctcaagttccggatgaaggcgtttcctgcagaccccttgggatttggcccacacacaccagctctatcccacttcctgcctttctaaaagttgctggggacagccaaccaccccggggcccaagagggtggtctgacctgctgccctcttgggccctgcctggtgttggaccatcttagcctcagtttccccaactgtaagatggtcttgatcatggttgggctgtggggaagggtctagccagaaaagtcctgaatgaatac

SEQ ID NO: 462574 - DNA, 3148 bp, Homo sapiens
cagcttaagtgattaccagctaacgctctcacttggtttatacttacctagctatgactccctcctggccattgcaccaaaccctgtcttccatacaccagttgcccaggccacccctagatatgctggccccctccagtccctggaacacaggacaaaccagcttctccccttgagctgggctgtggttggtctcccatccagaaagcctctgcctctccctccagcaccttgtctaccagtcagcatgcaacaaacctgtgccaaaagcctactgagcgtccagtaccagacattcctggcccagtcactatgggccctgttcacctcctctctggccatctccctggtgtttgccgtcatccccttctgccgcgacgtgaaggtgctggcctcagtcatggcgctggcgggcttggccatgggctgcatcgacaccgtggccaacatgcagctggtaaggatgtaccagaaggactcggccgtcttcctccaggtgctccatttcttcgtgggctttggtgctctgctgagcccccttattgctgaccctttcctgtctgaggccaactgcttgcctgccaatagcacggccaacaccacctcccgaggccacctgttccatgtctccagggtgctgggccagcaccacgtagatgccaagccttggtccaaccagacgttcccagggctgactccaaaggacggggcagggacccgagtgtcctatgccttctggatcatggccctcatcaatcttccagtgcccatggctgtgctgatgctgctgtccaaggagcggctgctgacctgctgtccccagaggaggcccctgcttctgtctgctgatgagcttgccttggagacacagcctcctgagaaggaagatgcctcctcactgcccccaaagtttcagtcacacctagggcatgaggacctgttcagctgctgccaaaggaagaacctcagaggagccccttattccttctttgccatccacatcacgggcgccctggtactgttcatgacggatgggttgacgggtgcctattccgccttcgtgtacagctatgctgtggagaagcccctgtctgtgggacacaaggtggctggctacctccccagcctcttctggggcttcatcacactgggccggctcctctccattcccatatcctcaagaatgaagccggccaccatggttttcatcaacgtggaggtgctggctgcagtgtgtggagcccatcccagccaacaactggctatgagcgtgaggaaagccagtgctggccctggtcctcctgtgtttaccttggtgcccagctgctcagagccctccagtcagtggaaagctgtggaggccagggatcccacaaccgttggcgtggtggtgacgttcctggtgctgcttattttctcctacaacgtcgtcttcctgttcgtggggacggcaagcctgggcctgtttctcagcagcaccttccccagcatgctggcctacacggaggactcgctgcagtacaaaggctgtgcaaccacagtgctggtgacaggggcaggagttggcgagatggtgctgcagatgctggttggttcgatattccaggctcagggcagctatagtttcctggtctgtggcgtgatctttggttgtctggcttttaccttctatatcttgctcctgtttttccacaggatgcaccctggactcccatcagttcctacccaagacagatcaattggaatggaaaactctgagtgctaccagaggtaaaactgggtgaagaaggcaagagaagactttcagcctcttgatcaccagcacgaccatactgtttcagaaagctgggtggtggtggaggcgctctctcaatggctattcaagtcttctccactaaaacttggttgggtagaggaaattaaattgagtcctggtacctggtcaaaatcattagaagtttacctggcttctcaagttatcttcttccctggttcagactgttggtaagagctgtccagatacccagatgggaaggaaggagacagccgcgcgcttcactccatttgtcacctcatgcatggaccatactctgggtttgagatcattcttcattgaagtttgtaaaaataggttgaaattgtaaagctccatgatcattgctatatgtagatatatttcaatttaagcaaaacaagctgcaagttattccctggcatgctcaaaggattttcgtgcttttcacttaatagtccaaagtctcttaaattcctgctgcagacatcaatagcttatctatattctcaaacaccaaaaggaaaagttgaatcttgctctctttggtatactaatgtagtggtatgctaagctggctcataccaacttagaaaagctgattgtaaaattttcattttgacagctggttattaaatgcagccattattaaaaatcaaatcatacaaacttataattaaatcaattacatttaaaacaaaggtaataaatattcaaagcatatcacttcctaatttgatcttgatgctcttgaggtaatttacgtccatggtacctgtgtggtggaattactatatatgatggtgtgctactgtgcaccttgtctcaactccactcttcgtgatagcatgttggtagcttgaaatcagcctggtgggagtattaccatggacactggcaaaagctacagatcccggagagccagtggttaaacatttaccagcataccactgctagtaatcaaggctaactggtccagaaatcgcccaggagaatgaaatggatgttccatttttttctactgacattgactagcatataaaaggaatttggacatttcagaatcctgtggaatcaccctgttcccagattttcctctgctacttgtatatggaaatctaacccatcaggcacatcggattcactaaaagaagacacagtgacatagagttcttttagagtgaatttcgtttattcagtcaaaaaggatttgttaagcacctgctatgttcaaggcactaatctaggtacagacatacagtggtgactgagacagaagtccctgcctcacaaggattataccgcaggtgaagacatacagacagcaaacaaatactacacgtaacatgccacagg

SEQ ID NO: 462575 - DNA, 1667 bp, Homo sapiens
  misc_feature (301)..(301): n is a, c, g, or t
  misc_feature (306)..(306): n is a, c, g, or t
  misc_feature (323)..(323): n is a, c, g, or t
  misc_feature (326)..(326): n is a, c, g, or t
  misc_feature (334)..(334): n is a, c, g, or t
  misc_feature (338)..(338): n is a, c, g, or t
  misc_feature (342)..(342): n is a, c, g, or t
  misc_feature (346)..(346): n is a, c, g, or t
  misc_feature (351)..(351): n is a, c, g, or t
  misc_feature (367)..(367): n is a, c, g, or t
  misc_feature (369)..(370): n is a, c, g, or t
  misc_feature (382)..(382): n is a, c, g, or t
  misc_feature (394)..(394): n is a, c, g, or t
  misc_feature (407)..(407): n is a, c, g, or t
  misc_feature (411)..(411): n is a, c, g, or t
  misc_feature (423)..(424): n is a, c, g, or t
  misc_feature (428)..(428): n is a, c, g, or t
  misc_feature (434)..(434): n is a, c, g, or t
gggcaatccaggagcagaggtacatgagagataatttgacagagactcatcaagcgacagtctctgcagcatgcacagtatttctgtgctttagaatgaagcttgcaactgcctgatgtttacgtttactgagcaccaccataggtcaggcactgatcctctggactgctccagtcttcccaaaccacatctctcagcaaccttcacagagcacgtcccatgcttccatcctggtgctagagtctggagatacgaaaataaacagaacttgccgggcacggtggctcacgcctgtaatccnagcantttgggaggctgaggcnggnggatcacntgangtcnggantttgngaccagcctggccaananngtgaaaccccanctctactaaaantacaaaattagcnaggngtggtggcaggnncctntaatcncagctcagcctcccaagtagctgtgactacaggcgcatgccatcacgcacagctaattttttgtatttttagtagagacgggatttcaccgtgttagccaggatggtcttgatctcctgacctcatgatctgcccgtctcggcctcccaaagtgctgggattacaggcgtgagccactgcacccagccaaaaattttacatcttttatagagggaaaaaaactctttataccatggcaaggccttttctttcacaaaaagctgggcctactgaacaattcaagctgtgcagtagtagactgaaagcaggatttgttgaggagttacagctcctgtccagagcaaatcctgtagtgatacaaggagaatgtaaacttgccagcttagacagggatcagtcctgagactgctggcagtagcaaatggctattagagtaactgtataatggttttgcctgcactttctctatgtatatacaaatgtacatgtataaatataaaaattaagtgatcatggttcttggtaacctgtcccaagtgctgtgattcacacgcctgacactaaaaggttcttcctggtccagtcagccagctgtgaccaccagcagcacagctgagtgctgagaatctggctggaaagagaaacgtggctcaagtgctggctcaccttctagctgtgtggccctgggcaggttactgaggctcttccaacctcacttttcacatgtaaaatggcatttctaaaagtacctaccctacctcaaaggaattctgaaaaaagtaagtgaatttgtataaagcaaagcactcacaatatgcctgacacacaaactgcttaataaatgttagtaatttttaaaacctcctcataagcggcttagaaattattcatgtttggtacatatttattgcaagtcaagcagatccaacttttttgaaagctggtggtctaggagtatagttttaattatatttgtaaatactcaaaagtattagatgccagtctaatttaaatgcagtctgactgtagcgagtaactgacctgggcaatgaaaaagcagttgtatttttcttgtggtttttcaagaaaatatcctttttatacagatttagaaagaagaatcaatggctatatcgaagttgattgtgactaatttgttaatacagaaaacaacattaacacaaatctaagagtacctttcctaaaataaaatatttaaacttaaaaaaaaag

SEQ ID NO: 462576 - DNA, 946 bp, Homo sapiens
ttgacagggtctcactctgtcacccaggctggagtgcagtggtgcgatcatggctcactgcagcctccaattcatgggctcgagggaccctcctaccttagcctcccaagtagctgggactacaggtgcacaccaccatgcccagttaatttttttaaattttactttttgtagagaccaagtcttgtgatattgcccagactggtcttgaactcctggcctcaagagatcctcccacttctgactcctaaagtactgggatgtgccttccgaaatgcatatgccactgtgcctggccagcaacctggattgtaatgctggcttctgtctccttaacttgcttttaccaaaccaaaccttctctttttgttaggctgtgcaaccacagtgctggtgacaggggcaggagttggcgagatggtgctgcagatgctggttggttcggtatgtggggacctgtaagggagaggggagcatttggggagcactcctctgacaggtgagaagatgcagatagccaccttctgaactcaaactgtccctttcctgagtctccagcaaagccagcagggccccctgtgccgttgttacctgtttccgtttccaagccagccctgagagctgagcctccatatgtgggatctggagatgtaaacggatgcatggaaaagtccaaagcaaacacaagccatgtctgggagcagggccagagggggcccgtgggaatgctgtttagctctcagagcctgagatgggttggaactgcagtcagagttctttttccatcccttcggaacccaccactccctaccccacctctcacagcctctggccaccctgcagagggcccagcttcctgctcaactcctgccctgaccgagagggccaactcttccagttctattcaaatccacccatgtttcatttattcaccaggaaaaaaaaa

SEQ ID NO: 462577 - DNA, 3524 bp, Homo sapiens
cgcgggcctccccagcccggccggccctcccgcgggcggcactcgggcaccgggctcgccgggaccagatccgcgagcccgtcagcctgcgccatgggctgcgacggccgcgtgtcggggctgctccgccgcaacctgcagcccacgctcacctactggagcgtcttcttcagcttcggcctgtgcatcgccttcctggggcccacgctgctggacctgcgctgtcagacgcacagctcgctgcccagatctcctgggtcttcttctcgcagcagctctgcctcctgctgggcagcgccctcgggggcgtcttcaaaaggaccctggcccagtcactatgggccctgttcacctcctctctggccatctccctggtgtttgccgtcatccccttctgccgcgacgtgaaggtgctggcctcagtcatggcgctggcgggcttggccatgggctgcatcgacaccgtggccaacatgcagctggtaaggatgtaccagaaggactcggccgtcttcctccaggtgctccatttcttcgtgggctttggtgctctgctgagcccccttattgctgaccctttcctgtctgaggccaactgcttgcctgccaatagcacggccaacaccacctcccgaggccacctgttccatgtctccagggtgctgggccagcaccacgtagatgccaagccttggtccaaccagacgttcccagggctgactccaaaggacggggcagggacccgagtgtcctatgccttctggatcatggccctcatcaatcttccagtgcccatggctgtgctgatgctgctgtccaaggagcggctgctgacctgctgtccccagaggaggcccctgcttctgtctgctgatgagcttgccttggagacacagcctcctgagaaggaagatgcctcctcactgcccccaaagtttcagtcacacctagggcatgaggacctgttcagctgctgccaaaggaagaacctcagaggagccccttattccttctttgccatccacatcacgggcgccctggtactgttcatgacggatgggttgacgggtgcctattccgccttcgtgtacagctatgctgtggagaagcccctgtctgtgggacacaaggtggctggctacctccccagcctcttctggggcttcatcacactgggccggctcctctccattcccatatcctcaagaatgaagccggccaccatggttttcatcaacgtggaggtgctggctgcagtgtgtggagcccatcccagccaacaactggctatgagcgtgaggaaagccagtgctggccctggtcctcctgtgtttaccttggtgcccagctgctcagagccctccagtcagtggaaagctgtggaggccagggatcccacaaccgttggcgtggtggtgacgttcctggtgctgcttattttctcctacaacgtcgtcttcctgttcgtggggacggcaagcctgggcctgtttctcagcagcaccttccccagcatgctggcctacacggaggactcgctgcagtacaaaggctgtgcaaccacagtgctggtgacaggggcaggagttggcgagatggtgctgcagatgctggttggttcgatattccaggctcagggcagctatagtttcctggtctgtggcgtgatctttggttgtctggcttttaccttctatatcttgctcctgtttttccacaggatgcaccctggactcccatcagttcctacccaagacagatcaattggaatggaaaactctgagtgctaccagaggtaaaactgggtgaagaaggcaagagaagactttcagcctcttgatcaccagcacgaccatactgtttcagaaagctgggtggtggtggaggcgctctctcaatggctattcaagtcttctccactaaaacttggttgggtagaggaaattaaattgagtcctggtacctggtcaaaatcattagaagtttacctggcttctcaagttatcttcttccctggttcagactgttggtaagagctgtccagatacccagatgggaaggaaggagacagccgcgcgcttcactccatttgtcacctcatgcatggaccatactctgggtttgagatcattcttcattgaagtttgtaaaaataggttgaaattgtaaagctccatgatcattgctatatgtagatatatttcaatttaagcaaaacaagctgcaagttattccctggcatgctcaaaggattttcgtgcttttcacttaatagtccaaagtctcttaaattcctcagcctcccaagtagctgtgactacaggcgcatgccatcacgcacagctaattttttgtatttttagtagagacgggatttcaccgtgttagccaggatggtcttgatctcctgacctcatgatctgcccgtctcggcctcccaaagtgctgggattacaggcgtgagccactgcacccagccaaaaattttacatcttttatagagggaaaaaaactctttataccatggcaaggccttttctttcacaaaaagctgggcctactgaacaattcaagctgtgcagtagtagactgaaagcaggatttgttgaggagttacagctcctgtccagagcaaatcctgtagtgatacaaggagaatgtaaacttgccagcttagacagggatcagtcctgagactgctggcagtagcaaatggctattagagtaactgtataatggttttgcctgcactttctctatgtatatacaaatgtacatgtataaatataaaaattaagtgatcatggttcttggtaacctgtcccaagtgctgtgattcacacgcctgacactaaaaggttcttcctggtccagtcagccagctgtgaccaccagcagcacagctgagtgctgagaatctggctggaaagagaaacgtggctcaagtgctggctcaccttctagctgtgtggccctgggcaggttactgaggctcttccaacctcacttttcacatgtaaaatggcatttctaaaagtacctaccctacctcaaaggaattctgaaaaaagtaagtgaatttgtataaagcaaagcactcacaatatgcctgacacacaaactgcttaataaatgttagtaatttttaaaacctcctcataagcggcttagaaattattcatgtttggtacatatttattgcaagtcaagcagatccaacttttttgaaagctggtggtctaggagtatagttttaattatatttgtaaatactcaaaagtattagatgccagtctaatttaaatgcagtctgactgtagcgagtaactgacctgggcaatgaaaaagcagttgtatttttcttgtggtttttcaagaaaatatcctttttatacagatttagaaagaagaatcaatggctatatcgaagttgattgtgactaatttgttaatacagaaaacaacattaacacaaatctaagagtacctttcctaaaataaaatatttaaacttaaaaaaaaag

SEQ ID NO: 462578 - DNA, 2346 bp, Homo sapiens
ttgacagggtctcactctgtcacccaggctggagtgcagtggtgcgatcatggctcactgcagcctccaattcatgggctcgagggaccctcctaccttagcctcccaagtagctgggactacaggtgcacaccaccatgcccagttaatttttttaaattttactttttgtagagaccaagtcttgtgatattgcccagactggtcttgaactcctggcctcaagagatcctcccacttctgactcctaaagtactgggatgtgccttccgaaatgcatatgccactgtgcctggccagcaacctggattgtaatgctggcttctgtctccttaacttgcttttaccaaaccaaaccttctctttttgttaggctgtgcaaccacagtgctggtgacaggggcaggagttggcgagatggtgctgcagatgctggttggttcgatattccaggctcagggcagctatagtttcctggtctgtggcgtgatctttggttgtctggcttttaccttctatatcttgctcctgtttttccacaggatgcaccctggactcccatcagttcctacccaagacagatcaattggaatggaaaactctgagtgctaccagaggtaaaactgggtgaagaaggcaagagaagactttcagcctcttgatcaccagcacgaccatactgtttcagaaagctgggtggtggtggaggcgctctctcaatggctattcaagtcttctccactaaaacttggttgggtagaggaaattaaattgagtcctggtacctggtcaaaatcattagaagtttacctggcttctcaagttatcttcttccctggttcagactgttggtaagagctgtccagatacccagatgggaaggaaggagacagccgcgcgcttcactccatttgtcacctcatgcatggaccatactctgggtttgagatcattcttcattgaagtttgtaaaaataggttgaaattgtaaagctccatgatcattgctatatgtagatatatttcaatttaagcaaaacaagctgcaagttattccctggcatgctcaaaggattttcgtgcttttcacttaatagtccaaagtctcttaaattcctcagcctcccaagtagctgtgactacaggcgcatgccatcacgcacagctaattttttgtatttttagtagagacgggatttcaccgtgttagccaggatggtcttgatctcctgacctcatgatctgcccgtctcggcctcccaaagtgctgggattacaggcgtgagccactgcacccagccaaaaattttacatcttttatagagggaaaaaaactctttataccatggcaaggccttttctttcacaaaaagctgggcctactgaacaattcaagctgtgcagtagtagactgaaagcaggatttgttgaggagttacagctcctgtccagagcaaatcctgtagtgatacaaggagaatgtaaacttgccagcttagacagggatcagtcctgagactgctggcagtagcaaatggctattagagtaactgtataatggttttgcctgcactttctctatgtatatacaaatgtacatgtataaatataaaaattaagtgatcatggttcttggtaacctgtcccaagtgctgtgattcacacgcctgacactaaaaggttcttcctggtccagtcagccagctgtgaccaccagcagcacagctgagtgctgagaatctggctggaaagagaaacgtggctcaagtgctggctcaccttctagctgtgtggccctgggcaggttactgaggctcttccaacctcacttttcacatgtaaaatggcatttctaaaagtacctaccctacctcaaaggaattctgaaaaaagtaagtgaatttgtataaagcaaagcactcacaatatgcctgacacacaaactgcttaataaatgttagtaatttttaaaacctcctcataagcggcttagaaattattcatgtttggtacatatttattgcaagtcaagcagatccaacttttttgaaagctggtggtctaggagtatagttttaattatatttgtaaatactcaaaagtattagatgccagtctaatttaaatgcagtctgactgtagcgagtaactgacctgggcaatgaaaaagcagttgtatttttcttgtggtttttcaagaaaatatcctttttatacagatttagaaagaagaatcaatggctatatcgaagttgattgtgactaatttgttaatacagaaaacaacattaacacaaatctaagagtacctttcctaaaataaaatatttaaacttaaaaaaaaag

SEQ ID NO: 462579 - DNA, 393 bp, Homo sapiens
agagtctcactctgttgccaggctggaatgcagtggcgtcatctcggctcactgcaacctccgcctcccagtttcaagcgattctcctgcctcagcctcccaagtagctgtgactacaggcgcatgccatcacgcacagctaattttttgtatttttagtagagacgggatttcaccgtgttagccaggatggtcttgatctcctgacctcatgatctgcccgtctcggcctcccaaagtgctgggattacaggcgtgagccactgcacccagccaaaaattttacatcttttatagagggaaaaaaactctttataccatggcaaggccttttctttcacaaaaagctgggcctactgaacaattcaagctgtgcagtagtagactgaaagc

SEQ ID NO: 462580 - DNA, 375 bp, Homo sapiens
aaaacctcctcataagcggcttagaaattattcatgtttggtacatatttattgcaagtcaagcagatccaacttttttgaaagctggtggtctaggagtatagttttaattatatttgtaaatactcaaaagtattagatgccagtctaatttaaatgcagtctgactgtagcgagtaactgacctgggcaatgaaaaagcagttgtatttttcttgtggtttttcaagaaaatatcctttttatacagatttagaaagaagaatcaatggctatatcgaagttgattgtgactaatttgttaatacagaaaacaacattaacacaaatctaagagtacctttcctaaaataaaatatttaaacttaaaaaaaa

SEQ ID NO: 462581 - DNA, 2124 bp, Homo sapiens
cgcgggcctccccagcccggccggccctcccgcgggcggcactcgggcaccgggctcgccgggaccagatccgcgagcccgtcagcctgcgccatgggctgcgacggccgcgtgtcggggctgctccgccgcaacctgcagcccacgctcacctactggagcgtcttcttcagcttcggcctgtgcatcgccttcctggggcccacgctgctggacctgcgctgtcagacgcacagctcgctgcccagatctcctgggtcttcttctcgcagcagctctgcctcctgctgggcagcgccctcgggggcgtcttcaaaaggaccctggcccagtcactatgggccctgttcacctcctctctggccatctccctggtgtttgccgtcatccccttctgccgcgacgtgaaggtgctggcctcagtcatggcgctggcgggcttggccatgggctgcatcgacaccgtggccaacatgcagctggtaaggatgtaccagaaggactcggccgtcttcctccaggtgctccatttcttcgtgggctttggtgctctgctgagcccccttattgctgaccctttcctgtctgaggccaactgcttgcctgccaatagcacggccaacaccacctcccgaggccacctgttccatgtctccagggtgctgggccagcaccacgtagatgccaagccttggtccaaccagacgttcccagggctgactccaaaggacggggcagggacccgagtgtcctatgccttctggatcatggccctcatcaatcttccagtgcccatggctgtgctgatgctgctgtccaaggagcggctgctgacctgctgtccccagaggaggcccctgcttctgtctgctgatgagcttgccttggagacacagcctcctgagaaggaagatgcctcctcactgcccccaaagtttcagtcacacctagggcatgaggacctgttcagctgctgccaaaggaagaacctcagaggagccccttattccttctttgccatccacatcacgggcgccctggtactgttcatgacggatgggttgacgggtgcctattccgccttcgtgtacagctatgctgtggagaagcccctgtctgtgggacacaaggtggctggctacctccccagcctcttctggggcttcatcacactgggccggctcctctccattcccatatcctcaagaatgaagccggccaccatggttttcatcaacgtggaggtgctggctgcagtgtgtggagcccatcccagccaacaactggctatgagcgtgaggaaagccagtgctggccctggtcctcctgtgtttaccttggtgcccagctgctcagagccctccagtcagtggaaagctgtggaggccagggatcccacaaccgttggcgtggtggtgacgttcctggtgctgcttattttctcctacaacgtcgtcttcctgttcgtggggacggcaagcctgggcctgtttctcagcagcaccttccccagcatgctggcctacacggaggactcgctgcagtacaaaggctgtgcaaccacagtgctggtgacaggggcaggagttggcgagatggtgctgcagatgctggttggttcggtatgtggggacctgtaagggagaggggagcatttggggagcactcctctgacaggtgagaagatgcagatagccaccttctgaactcaaactgtccctttcctgagtctccagcaaagccagcagggccccctgtgccgttgttacctgtttccgtttccaagccagccctgagagctgagcctccatatgtgggatctggagatgtaaacggatgcatggaaaagtccaaagcaaacacaagccatgtctgggagcagggccagagggggcccgtgggaatgctgtttagctctcagagcctgagatgggttggaactgcagtcagagttctttttccatcccttcggaacccaccactccctaccccacctctcacagcctctggccaccctgcagagggcccagcttcctgctcaactcctgccctgaccgagagggccaactcttccagttctattcaaatccacccatgtttcatttattcaccaggaaaaaaaaa

SEQ ID NO: 462582 - DNA, 1160 bp, Homo sapiens
ctcttaagactcggggtctcatggaaactgagcctctgcaagctaagaagggagaatacaacttccatgcaagggcctcccaggactcagggctggtgagcaaaccaggtctgcaggaacttggcttgactctgcagcccaaaaggcacattttggaggcttgggtctggtcccacttcagactcaggaacaaaacaacaggtcctggttccctggaggatgagggtggcccttacactgactgttccttcaacccaatgcccataccaacatgtgagcagagttttcatgtctttaccctccctaaaggcaagccacgggacacctgcatctgccaacaagactggaagcaggtgaggcacacagagggggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacactt

SEQ ID NO: 462583 - DNA, 1212 bp, Homo sapiens
ctcttaagactcggggtctcatggaaactgagcctctgcaagctaagaagggagaatacaacttccatgcaagggcctcccaggactcagggctggtgagcaaaccaggtctgcaggaacttggcttgactctgcagcccaaaaggcacattttggaggcttgggtctggtcccacttcagactcaggaacaaaacaacaggtcctggttccctggaggatgagggtggcccttacactgactgttccttcaacccaatgcccataccaacatgtgagcagagttttcatgtctttaccctccctaaaggcaagccacgggacacctgcatctgccaacaagactggaagcaggtgaggcacacagagggggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggagcacgagggacagctctccaccgaccgaaggaggagaatgctatttatttcagcaccaaatatccggacagcgcctctcgggaggtccgagaagagaaccgcgatctgtttcagcaccggggctcaggacagttcccagcgggctccgtttcgtctccagaaccctggacagctcctccagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacactt

SEQ ID NO: 462584 - DNA, 1297 bp, Homo sapiens
ctcttaagactcggggtctcatggaaactgagcctctgcaagctaagaagggagaatacaacttccatgcaagggcctcccaggactcagggctggtgagcaaaccaggtctgcaggaacttggcttgactctgcagcccaaaaggcacattttggaggcttgggtctggtcccacttcagactcaggaacaaaacaacaggtcctggttccctggaggatgagggtggcccttacactgactgttccttcaacccaatgcccataccaacatgtgagcagagttttcatgtctttaccctccctaaaggcaagccacgggacacctgcatctgccaacaagactggaagcaggtgaggcacacagagggggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagtagagacggggtttcaccatgttggccaggctggtctcaaactcttgacctcttcatccgtccacctcagcctcccaaagtgctaggattacaggcgtgagtcactgcgcctggcccaagtccggaattttcaacagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacactt

SEQ ID NO: 462585 - DNA, 901 bp, Homo sapiens
ctcttaagactcggggtctcatggaaactgagcctctgcaagctaagaagggagaatacaacttccatgcaagggcctcccaggactcagggctggtgagcaaaccaggtctgcaggaacttggcttgactctgcagcccaaaaggcacattttggaggcttgggtctggtcccacttcagactcaggaacaaaacaacaggtcctggttccctggaggatgagggtggcccttacactgactgttccttcaacccaatgcccataccaacatgtgagcagagttttcatgtctttaccctccctaaaggcaagccacgggacacctgcatctgccaacaagactggaagcagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaata

SEQ ID NO: 462586 - DNA, 1468 bp, Homo sapiens
ctcttaagactcggggtctcatggaaactgagcctctgcaagctaagaagggagaatacaacttccatgcaagggcctcccaggactcagggctggtgagcaaaccaggtctgcaggaacttggcttgactctgcagcccaaaaggcacattttggaggcttgggtctggtcccacttcagactcaggaacaaaacaacaggtcctggttccctggaggatgagggtggcccttacactgactgttccttcaacccaatgcccataccaacatgtgagcagagttttcatgtctttaccctccctaaaggcaagccacgggacacctgcatctgccaacaagactggaagcaggtgaggcacacagagggggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagtagagacggggtttcaccatgttggccaggctggtctcaaactcttgacctcttcatccgtccacctcagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctgagaaccgggaatggaaaacagggaggcagcacagaggcaggaaactcaggtgtcatagcttggctcagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacactt

SEQ ID NO: 462587 - DNA, 1399 bp, Homo sapiens
ctcttaagactcggggtctcatggaaactgagcctctgcaagctaagaagggagaatacaacttccatgcaagggcctcccaggactcagggctggtgagcaaaccaggtctgcaggaacttggcttgactctgcagcccaaaaggcacattttggaggcttgggtctggtcccacttcagactcaggaacaaaacaacaggtcctggttccctggaggatgagggtggcccttacactgactgttccttcaacccaatgcccataccaacatgtgagcagagttttcatgtctttaccctccctaaaggcaagccacgggacacctgcatctgccaacaagactggaagcaggtgaggcacacagagggggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagtagagacggggtttcaccatgttggccaggctggtctcaaactcttgacctcttcatccgtccacctcagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacactt

SEQ ID NO: 462588 - DNA, 1152 bp, Homo sapiens
ctcttaagactcggggtctcatggaaactgagcctctgcaagctaagaagggagaatacaacttccatgcaagggcctcccaggactcagggctggtgagcaaaccaggtctgcaggaacttggcttgactctgcagcccaaaaggcacattttggaggcttgggtctggtcccacttcagactcaggaacaaaacaacaggtcctggttccctggaggatgagggtggcccttacactgactgttccttcaacccaatgcccataccaacatgtgagcagagttttcatgtctttaccctccctaaaggcaagccacgggacacctgcatctgccaacaagactggaagcaggtgaggcacacagagggggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagtagagacggggtttcaccatgttggccaggctggtctcaaactcttgacctcttcatccgtccacctcagcctcccaaagtgctaggattacaggcgtgagtcactgcgcctggcccaagtccggaattttcaacagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaata

SEQ ID NO: 462589 - DNA, 1254 bp, Homo sapiens
ctcttaagactcggggtctcatggaaactgagcctctgcaagctaagaagggagaatacaacttccatgcaagggcctcccaggactcagggctggtgagcaaaccaggtctgcaggaacttggcttgactctgcagcccaaaaggcacattttggaggcttgggtctggtcccacttcagactcaggaacaaaacaacaggtcctggttccctggaggatgagggtggcccttacactgactgttccttcaacccaatgcccataccaacatgtgagcagagttttcatgtctttaccctccctaaaggcaagccacgggacacctgcatctgccaacaagactggaagcaggtgaggcacacagagggggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagtagagacggggtttcaccatgttggccaggctggtctcaaactcttgacctcttcatccgtccacctcagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaata

SEQ ID NO: 462590 - DNA, 911 bp, Homo sapiens
aaaaagtccagattcagtgtggatacggccatggggacattcacatcaaattaatgtgctccacttttattgctgaaagagcgcaggagatcagagaatctatgtggagctgaattcccacataaatgatgaagctgaagccaaaagaggttcagtacttacccaaggccacatacggttgataagtagcagagacattttggaattcgggtttgctatctctaggccctaagttctggagaatcagtctcttcatttcaacttctcaccctcaccatgcccccacatgcccccagatatccttttaataagagagagctcaggcaaagatctggctatcagctcgggaagccactgagggaactgttttgcttgttttattctttttggctctctgcttcttgtgtcaaccgaattgtgtgtgctggcccttctcctctccctggtttcacgggaaaggttcttgaggctggagagcgcagttatcaacacgtcccaccctcagagagctctgtgagaaggaagcatgtagagcacgtgctcagtatttgctgggagctagtgaaagctgtggaatgccgctggtcaagctgcagagacagggcaactggggcaggtgatggcagtggcagtgctgttggtggcagatggctggggcccaggacactgagggtggcctggctccgtcattcctcagacaactgtgctggctatatatactccaaccctgtctatgttatttccaccacggcgatttggggtggatgtacggggaagaaattctaggcatagagaatcccagcaaaccccaaagcaggacaacacagggccaaagggtgggtgtgagcagcaggaggaatgcagtttggctgagctgaggagtagacagggagtggcgggaagagggaggg

SEQ ID NO: 462591 - DNA, 1848 bp, Homo sapiens
  misc_feature (3)..(3): n is a, c, g, or t
  misc_feature (7)..(7): n is a, c, g, or t
  misc_feature (9)..(11): n is a, c, g, or t
aanttantnnnaagaaaaggctgtaaaaatgtggatgagtttaagatgcacaaaaaaggttataatagacataaccagtgtttgacaacttcccatagcaaaatatttcagtgtgacaaatatgtgaaagtctttcataaattttcaaattcaaacagacataagataagacatacttcgaagaaacctttcaaatgtaaagaatgtggaaaattattttgcattctttcacacttagctcaacataaaaaaattcatactggagagaaatcctacaaatgtgaagaatatggcaaagcctttaatgagtcctcaaactgtactacacataaaagaattactgagaaaaaaccttacaaatgtaaagaatgtggcaaagcctttaactggttttcacattttactacacataagagaattcatactggagaaaaaccctaccaatgtgagaaatgtggcaaattttttaaccaatccacaaaccttactacacataaaagaattcatactggagagaaaccctataaatgtgaagaatgtggcaaagcctttaaccagtcctcaaaccttactgaacataagaaaattcatactaaagagcaaccatacaaatgcgaaaaatgtggcaaagcttttaagtggtcctcaacccttacaaaacataaaagaattcataatggagaaaaaccctacaaatgtgaagaatgtggcaaagcttttaaccgatcctcaacccttaatagacataagataactcatactggagggaaaccctacaaatataaagaatgtggtaaagcttttaaccaatcctcaactcttactatacataagataattcatactgtagagaaattttacaaatgtgaagaatgtggcaaagcctttagccgtatctcacaccttactacacataagagaattcatactggagagaaaccctacaaatgtgaagaatgtggcagagctttcaaccagtcctcaacccttactacacataaaagaattcatactggagagaaaccctatgaatgtgaagaatgtggcaaagcttttaaccggtcctcaaccctcactacacataagataattcattctggggaaaaaatctacaaatgtaaagaatgtggtaaagcctttaggcggttctcacaccttactaggcataagacaattcatacataaaattgtaaagactgtggcaaagcttttaaacaatctttataccttactacacataagataattcatactgaagagaaaccctacaaatgtgaagaatgtggcaaagcttttaaccagtcctcaaatcttactaaacataaggtaattcatactggagaaaaacctacaaatgtgaagaatgtggcaaagtcttcaaccaatcttcacaccttactacacataagataattcatactggagagaaaccctacaagtgtgaagaatgtgacaaagcctttaacaaatccttaattcttaacagacatgattcataccagagagaaactctacaaacctgaaagttttaacagtgcttttgacaacacctcaaacttttccagatgtcaaagaaatgctggtgagaaattctagaaatatgaagaatgtgacaaagccattaaattgttgtcacatttaattgtaggtaaggtgattcatactggagaaaacttctacaagtgtaaacaaagtggcaaaacttttaaccaatgctcacactttattgcacaggacatttatacttgagaataaatatacaagtgtaaagaaagtgaaaaccctattaatatctgctcacatcaactcaacatcagagttcatacttaataaaatcattaaaagtgc

SEQ ID NO: 462592 - DNA, 1421 bp, Homo sapiens
ggctcggagggagctgggaaggaggggcgattgcaattgaggatggaaccagagaccgttgttgaatttagggtcagaaaaatctgttgtctagatgaagaattaaatagagcaaagacaattgttgctccaactccaggtttcactcataaaacaacgtgggcgtttgtcagagactcagggttcaaactattggaggtccagatgacatctggcttctcagctcccccagaatactggctgcagtgcttatcagtgcattattcatcaaaactgatgatgcaaggcagaatgaacagtaatcccagagatcctgagatgagaaaagggtgtttgacttattcaaagaagaccaaggaagcccaaagaccagagaagagtgcaggaaaggggcggcggtctgagatgcagtcagagcagtggcaagcccccagagtctgtggcaaagacttcaggtttcatcctgaagaggaagacaggtctttggagagttttgatcaaggaagtgagatgaaatatcttaggcttacaaagaactactctgacatctaaatggaaaatggactgatgaagcaaaagaagccacaaggaagccagttcagaggctattgaaatgctccagctgaacagaatcccgacataagtttgggatcatgaacccatgacatcaacatagtcaggttgagtatgaagaacactgtgctgtggtgacagggagcctggttttttcctggttttggcattagctctatgtgtgacctcaaccaagtcactcaagctgttacagtctctctatgtggatgaaatgaaggggttgaaatagctactcactgtagctctgaatggctataattctatgaaactagaaaagaataaaatgtgtttatagtcattctctgaccctatttctccttttttaataaacaaaacacaatcctaaaacacgtttgttttttcaaagacagtttttgctttattcacactccttcctctgctttgtgggatgatctcaatgaatttctgaggaactgagaagaccaatttccaaatcatctggagtaattaattccagtggttggagttaattatgattaggcaattcataaagtatacagtagaaaaaaagcagcaattgatgagacttcatctgcagtgagatttttttcaaaggcattcttctggcaatgcatttcaaagttaaacatatgtgtgcttcaatggtgggaaaatagtttacgagggtatcattagttttattttctcagaccatataggagccagggaaaaaagacctgtatacgccaaaggatgaccatgatgaaatgaatcttttcaagccatagatctatgatttgcatactctaagaaatgggcagccaaaacaattttctaaactcaggtacatgtgcacattgtgcagg

SEQ ID NO: 462593 - DNA, 3311 bp, Homo sapiens
ggctcggagggagctgggaaggaggggcgattgcaattgaggatggaaccagagaccgttgttgaatttagggtcagaaaaatctgttgtctagatgaagaattaaatagagcaaagacaattgttgctccaactccaggtttcactcataaaacaacgtgggcgtttgtcagagactcagggttcaaactattggaggtccagatgacatctggcttctcagctcccccagaatactggctgcagtgcttatcagtgcattattcatcaaaactgatgatgcaaggcagaatgaacagtaatcccagagatcctgagatgagaaaagggtgtttgacttattcaaagaagaccaaggaagcccaaagaccagagaagagtgcaggaaaggggcggcggtctgagatgcagtcagagcagtggcaagcccccagagtctgtggcaaagacttcaggtttcatcctgaagaggaagacaggtctttggagagttttgatcaaggaagtgagatgaaatatcttaggcttacaaagaactactctgacatctaaatggaaaatggactgatgaagcaaaagaagccacaaggaagccagttcagaggctattgaaatgctccaggaggaaataaattttttctgggttagtttgctgtaaagaccaaatactctgcagtgcctaggaggcaggagcctgggaataagtccagctccacatgttggcctgtgtgtgttgtccagtgagggaactgagagtccagcaccaatgaatgtgacacacagaggcccaagtcttggaagaggaagcagaaatcaaaactgctccagagcacatctggaaaaaacaagcaaagctcatcttcctttattttgtgttttgtaacactgagcaatttgattaaaacaaatcagcaggacaaaaaatgaagttgcttttctgtggggagacaaaatcaatgagaagaatcaaggttgagtaaatatcttatggatactcaggggagataatattccaatttccagaatttaaaggaaaatttttagaattagttgttttctaaaacataaagttacttttattttgtaccttaaatgacattgaaagtatggggcacttgtaagagtaaatagttcacacctaagaaggtcccaaaagtgcttataatatgttttttaccagataagatgtggacatttaaaataaaataatgtctttacaaaactatttgcataagtgatttagatagagttggcatctaaaccagatttggtgacacaggtgaaatgatctgattggctgtcataaatttcaacccaggcaatgacactggaaaagaatcaatgcctgcaagtgtgtcgccatggtggtgcaccactcagagatgcctccaagggtgaacctgctacaaagagtgcgcatggccaacagcccctggttgtgctgactttgggatctgcctcagcttttgagcagatatcaagcacttgcaaggcagcctcctgccaatgactgagcaaagcagcagtagatgggcttgcaatttatttctggacggtgagatgctcctttttgggcccttcttgtgctggagctactcgttgtgttagccgaggctttcccagggctacaccatggtctgaggctctcctccctgttctttcttccttcccttgcacctttgcaaggtgtcagacctccatcatggtctaaaaggcttttcctaactgctcttgtttcttttcccctttctctttcaagtcactctccccagttaatgtcttgtgcttctagctctgtcttggcatctgcttctgggaggactcaactagtttattgcattatcttttactttgtcatatcagggagcccccagggaagatgtgggaagataataattaagcttgcttttattgtttttcttttatttgtattttccccattaataccaatttttgctttttaggaagatatgacaaactctaggtcattccttgtctccgattcctgcttttcagatttctgctctggctaggttacatagattctttctgagagagaatttagcagctctcaggttaacactaaccttttgatttagtgtgaatagtaaccgtttgatttttaaaaagtatacatctttaaaacgtaaattttactctgacaactaaaaaaactacaaatttttatccactattttccaattcttccttgaagtcctctgatgcagaattggtttctaccaaacataacagatttatattctctaaccacaacatatttagagaggaaagattgtgacggtgaatctgaaaacaactgagacgaagttggggtgggttcacccaaatccaagctttcctcagataagaataccagggctttcctgagcacagggctcattgtcaatgaatccccacaattgccaacctcttagtgtccatgtatgatttttatctgatttttgttttataagtcttacaagacccattatccttctttcttatttctcagctgaacagaatcccgacataagtttgggatcatgaacccatgacatcaacatagtcaggttgagtatgaagaacactgtgctgtggtgacagggagcctggttttttcctggttttggcattagctctatgtgtgacctcaaccaagtcactcaagctgttacagtctctctatgtggatgaaatgaaggggttgaaatagctactcactgtagctctgaatggctataattctatgaaactagaaaagaataaaatgtgtttatagtcattctctgaccctatttctccttttttaataaacaaaacacaatcctaaaacacgtttgttttttcaaagacagtttttgctttattcacactccttcctctgctttgtgggatgatctcaatgaatttctgaggaactgagaagaccaatttccaaatcatctggagtaattaattccagtggttggagttaattatgattaggcaattcataaagtatacagtagaaaaaaagcagcaattgatgagacttcatctgcagtgagatttttttcaaaggcattcttctggcaatgcatttcaaagttaaacatatgtgtgcttcaatggtgggaaaatagtttacgagggtatcattagttttattttctcagaccatataggagccagggaaaaaagacctgtatacgccaaaggatgaccatgatgaaatgaatcttttcaagccatagatctatgatttgcatactctaagaaatgggcagccaaaacaattttctaaactcaggtacatgtgcacattgtgcagg

SEQ ID NO: 462594 - DNA, 873 bp, Homo sapiens
ggctcggagggagctgggaaggaggggcgattgcaattgaggatggaaccagagaccgttgttgaatttagggtcagaaaaatctgttgtctagatgaagaattaaatagagcaaagacaattgttgctccaactccaggtttcactcataaaacaacgtgggcgtttgtcagagactcagggttcaaactattggaggtccagatgacatctggcttctcagctcccccagaatactggctgcagtgcttatcagtgcattattcatcaaaactgatgatgcaaggcagaatgaacagtaatcccagagatcctgagatgagaaaagggtgtttgacttattcaaagaagaccaaggaagcccaaagaccagagaagagtgcaggaaaggggcggcggtctgagatgcagtcagagcagtggcaagcccccagagtctgtggcaaagacttcaggtttcatcctgaagaggaagacaggtctttggagagttttgatcaaggaagtgagatgaaatatcttaggcttacaaagaactactctgacatctaaatggaaaatggactgatgaagcaaaagaagccacaaggaagccagttcagaggctattgaaatgctccagttcctttggccacgctgtaatcactagtgagctcttctggcagttataagtcacatgtcatgtgacagattttcctgtatgattttcattaaaatgctttggaatcctgggacagaaagaaattatgtaaataggaacagcggtttattgaaaggaaagcaaatgtccagaagcaaaaacaaacaaacaaaaaacaaacaaacaaacaaaaacagaaaaaacttccccaaaagtaaagaatcacagcttta

SEQ ID NO: 462595 - DNA, 3929 bp, Homo sapiens
tgggcaaagccaacagcactggaatcctatctgtgcgaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcaggtgagagtcctgtgtgtcccaaaaagctatcatcagggcagagaccctggcaccacttatagggaatgccaagccagccgcaattatgctgagttccaaccctgctcacagggttcagactctcacaaaacagaggaggacagaacaccaagactcagcggaggaggtggagcccccggagagctcatcgtcaactggacgctgcagaaaggaccactgcacagctctgactcaaacgcggataacttcctgtcccccttccacgcacccgctgccccttacgcgaatccacgctgcaggccccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagcccccaccacaccctggcaccgtcatttcccactccgtggcgatgctgatcctcataggctccctggagctctgatcctggaacccctccctctgcgccgcagctggacgccacctccgacggacacagccagccccttcctgctgccaagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggccatcctttcctgagctctgggtatactaccagtcacagaacgtcagagctggaagaagccttagagctcaacttcttcaagcccctcactttacagatgaggaaatggaggtggtccagagagggtctgggattcccaaggtcacacagcccagaagagatggggctgggttaagaactcgagtcttccacctttctgttcaaggctgtttgtctacccagaggaaggaggcactgctgaatggctatggcctggctaagaaggtgattagtcagtagggtgtgaaaattctacttcaaggggttcggattggtgatcatggggattggcatggctgggttcccgtccaaggtgtgggcagagcttctaccaaacttcaacatggagggctgacttgaagctccctgtccccctcactcttgccccaagaaaagaggccaaagcaagagcagattccctaggcaagagcagcagcacaactaggaaaccccaaagcccatgctccgacaggtggcccttcacagggggcagcgggacaggcatcttgaagggcatatgtcctcggaagctccgagcctgttttctgtagtttatagttagagctctattttgttatggttttttaaacttttaagtcctgctctattttcctgggcaggtttatgttgatgtttacccactacaattttttaaaaatataagctcacatgccttttccctgccacagccaaacccccactgcaccctacccacccacccctagcccaggtcagctttcctggagctggctaatgaaagcctcctcacctcttcccaacccttacaagcaagggtgctaggggctcagctatacgaccattctccctgacagggagtccaaacttggcctagcatccctcctggcccccctctggccacgacttggcctgtgcctggttctctatcagaaaggggatgctgaacaaaacctccttccaagttttatccaattcgttcctcattgcctcgggctgcgtcaggggaagcaggggacaggtgtccagttgctgggccgagggaggagctggtttggcataggacctaaccagtgaagctagaggctacagccactaaacttgcttcaggccaacgatagttactcacaagtaagtaccttaatgctaatgaggtccactaaaaaggggaggaaggcagacctcctgggagacccacgaagggtttttagccagggaaaactgagccccaggaaaacctaaccactgggcaggcagaatttgtttgagggatagaacgacaacaaaataaatgttcctgcagcctgagatttcaggtagagtactgactaaggtttaataagacaataggtgacctgaggacatgcaagcttgtaaaatgcaacagcctcctgctagagtgacttgtacatgagcttgcttgcagaagactagattagatgtttctcaggatcccctcctgcgcaggggttctctgattttcgtgttctctgcccagatgggctgggggagttgagagtgtgcttattttcactgcgatcatgagaccacagttctgggttatctcctctcatacatcaagccccagaggaggcggcaagaggaacagccacaaacaagtactttaccccacagcttagtggccagtaaacaccctgggggactaggaaaaggaaccaactgtaggcacctctccagggcctagggagacaagtgtcctctcttctgcatacatttgggctccccttacagagccctttgccctggctctctggtccttgttgctctaacagtccagatgtaca

SEQ ID NO: 462596 - DNA, 2313 bp, Homo sapiens
  misc_feature (1)..(1): n is a, c, g, or t
  misc_feature (5)..(6): n is a, c, g, or t
  misc_feature (8)..(8): n is a, c, g, or t
ngtgnncnaggcacaccatgcattaccccatgggtcatcgtcttgtgcatggcaccgaccccctgaccctgtgtgtccccaggatgctgcccatcacagaccgcctgctgcacctcctggggctggagaagacggcgttccgcatatacgcggtgtccacccttctcctcttcctgctcttcttcctgttccgcctgctgctgcggttcctgaggctctgcaggagcttctacatcacctgccgccggctgcgctgcttcccccagcctccccggcgcaactggctgctgggccacctgggcatgtaccttccaaatgaggcgggccttcaagatgagaagaaggtactggacaacatgcaccatgtactcttggtatggatgggacctgtcctgccgctgttggttctggtgcaccctgattacatcaaaccccttttgggagcctcagctgccatcgcccccaaggatgacctcttctatggcttcctaaaaccttggctaggggatgggctgctgctcagcaaaggtgacaagtggagccggcaccgtcgcctgctgacacccgccttccactttgacatcctgaagccttacatgaagatcttcaaccagagcgctgacattatgcatgctaaatggcggcatctggcagagggctcagcggtctcccttgatatgtttgagcatatcagcctcatgaccctggacagtcttcagaaatgtgtcttcagctacaacagcaactgccaagagaagatgagtgattatatctccgctatcattgaactgagcgctctgtctgtccggcgccagtatcgcttgcaccactacctcgacttcatttactaccgctcggcggatgggcggaggttccggcaggcctgtgacatggtgcaccacttcaccactgaagtcatccaggaacggcggcgggcactgcgtcagcagggggccgaggcctggcttaaggccaagcaggggaagaccttggactttattgatgtgctgctcctggccagggatgaagatggaaaggaactgtcagacgaggatatccgagccgaagcagacaccttcatgtttgagggtcacgacacaacatccagtgggatctcttggatgctgttcaatttggcaaagtatccggaataccaggagaaatgccgagaagagattcaggaagtcatgaaaggccgggagctggaggagctggagtgggacgatctgactcagctgccctttacaactatgtgcattaaggagagcctgcgccagtacccacctgtcactcttgtctctcgccaatgcacggaggacatcaagctcccagatgggcgcatcatccccaaaggaatcatctgcttggtcagcatctatggaacccaccacaaccccacagtgtggcctgactccaaggtgtacaacccctaccgctttgacccggacaacccacagcagcgctctccactggcctatgtgcccttctctgcaggacccaggaattgcatcggacagagcttcgccatggccgagttgcgcgtggttgtggcactaacactgctacgtttccgcctgagcgtggaccgaacgcgcaaggtgcggcggaagccggagctcatactgcgcacggagaacgggctctggctcaaggtggagccgctgcctccgcgggcctgagcgtgggcgcgcccctgcggctcccgagggtccaggccccgcccccaaaggaccaggactcgccccaaagatcccgagggcataggccacccccctcgaagttcaggttcagctcctggatgaccaggcaccgctgttgagcagcctggtggtactggccacgcccctcaaggcaaggctcctccccttagggggcctgatcccgccccttgaggcttaggtcccgccccctgacttctcgcacctgtcctgtttgagggaccagggtcgaccctgcccccttgggctcaggccccgcccccaggatcctacggattgaggtcctcaggccacgcccctgcagatccaggtctccaggccttgcccactgagccttcagaggacctaagacccacctatgactcagggcccaccacaccccacccccccccaactggctgaacccctggcaggcttccaaactgaggaaagctggagcctgacagttttgggttgggcatgtatatttgggaagccttagtataaatattttatatatttttccaaaagctagtgaagcgatttcaaatgggggtgatttttcctaccagatgacattcgttgttatttggaaacatttttggttgtcacaacc

SEQ ID NO: 462597 - DNA, 661 bp, Homo sapiens
  misc_feature (2)..(3): n is a, c, g, or t
  misc_feature (9)..(10): n is a, c, g, or t
  misc_feature (12)..(12): n is a, c, g, or t
gnngctctnncncaggctctctcagttcagttcaagcccagaggtgatggctgatgagtggtttatcttccagctacatgttttcgaccttcacacaggaggccctcaattaaaagggaagcctgagctatggtcagctgtaatgaacatcaactgtcctgtagcctgtggccagatgccctccccacaggggcctctcgcgcagactcagggagctttggtcacctgggcccaacaagtgtggagcagagagcagaacacagtagtaatgatggcagcaaaagcccatctggggcctgagactagaggaggaggaggctggccagaccctcctcagatgcgcagaggacagcttcaggataaggagagatcagatcatgcctgctccatctcggcgggctcatcttctctcgcccccatctgcatggtcctcttgattttcttcataataataacactgaaatcctttgagtgctaacattactgtctgtgctggtggggaagccagtgaagtcagatagggcataggggctgctgtaaaaggcttcagcttttattctgaatgcaatggagtcccgtcggaaggttttgaaaaaaggcgtgacattgtctgctttctactgtagaacagaagaaacaagtggaggtgggaggagaggaa

SEQ ID NO: 462598 - DNA, 699 bp, Homo sapiens
  misc_feature (2)..(3): n is a, c, g, or t
  misc_feature (9)..(10): n is a, c, g, or t
  misc_feature (12)..(12): n is a, c, g, or t
gnngctctnncncaggctctctcagttcagttcaagcccagaggtgatggctgatgagtggtttatcttccagctacatgttttcgaccttcacacaggaggccctcaattaaaagggaagcctgagctatggtcagctgtaatgaacatcaactgtcctgtagcctgtggccagatgccctccccacaggggcctctcgcgcagactcagggagctttggtcacctgggcccaacaagtgtggagcagagagcagaacacagtagtaatgatggcagcaaaagcccatctggggcctgagactagaggaggaggaggctggccagaccctcctcagatgcgcagaggacagcttcaggataaggagagatcagatcatgcctgctccatctcggcgggctcatcttctctcgcccccatctgcatggtcctcttgattttcttcataataataacactgaaatcctttgagtgctaacattactgtctgtgctggtggggaagccagtgaagtcagatagggcataggggctgctgtaaaaggcttcagcttttattctgaatgcaatggagtcccgtcggaaggttttgaaaaaaggcgtgacattgtctgctttctactgtagaacagaagagttttctgtgcttgtctccagttccttttggaggactaagtgtggctgctgtgttaagcataga

SEQ ID NO: 462599 - DNA, 5841 bp, Homo sapiens
  misc_feature (1)..(2): n is a, c, g, or t
nngtcagagcattcccgacatctccacgctgccctggttctcgctcagtacccctatggtctgcctcctcttcatccgtgccacccgggacctggtggacgacatggggagacacaagagtgacagagccatcaacaacagaccctgccagattctgatggggaagaggtgaggctggggctgcagctggggatccgcggggacacgggggctccagcccagcagggtcatcggcctcggcaagtgtccatcaccttccgtgctccctgatctcccggctggttgagtccgacaggaaccgggcctgcattcattaggcgtttggccgggacgaggacagaggccgaggccctgatggcgaacccttgcagagcttagggctcgggcgatggggaggacaaggaaagtctgaagaggacgtgggtgcaggaccctggaggtcactgggtgggagcgtggacccgcggggagtggggtgggagcccggggaaggcttcctgagggggcaaaggcccggaggtggggactgcagctgcgggccccccgtcatcccgtgcctctggtctcccggtgtggggagggtttgcagagggaggggcctccttcacaaccccctctccccgcagcttcaagcagaagaaatggcaggatctgtgcgtgggggatgtggtctgtctccgcaaggacaacatcgtcccagtgagctggggttgaccccgaggtcccagaaccacgcgccccctcaccgagagcacccctcccagggtggggagggctgccgcacccccaatttgtcttgcatcccctcttgcaacgctgccccccactccacaccaggccgacatgctcttgctggccagcacggagcccagcagcctgtgctatgtggagacggtggacattgacggggagaccaacttgaagttcagacaggccctgatggtcacccacaaagaactggccactataaagaagatggcgtcctttcaaggcacagtgacgtgtgaggcgcctaacagtcggatgcaccacttcgtggggtgcctggaatggaatgacaagaaatactccctggacattggcaacctcctcctccgaggctgcaggattcgcaacacagacacctgctatggactggtcatttatgctggttttgacacaaaaattatgaagaactgtggcaagatccatttgaagagaaccaagctggacctcctgatgaacaagctggtggttgtgatcttcatctccgtggtgcttgtctgcctggtgttggccttcggcttcggtttctcagtcaaagaattcaaagaccaccactactacctctcgggggtgcatgggagcagcgtggccgcagagtccttcttcgtcttctggagcttcctcatcctgctcagcgtcaccatcccgatgtccatgttcatcctgtccgagttcatctacctggggaacagcgtcttcatcgactgggacgtgcagatgtactacaagccgcaggacgtgcctgccaaggcccgcagcaccagcctcaacgaccacctgggccaggtggaatacatcttctcggacaagacgggcacgctcacgcagaacatcttgaccttcaacaagtgctgcatcagcggccgcgtctatggtgcggccccgacacctgagctcccagctgggtcctcgatcttcaaggggctcagggtgcctgagaaccagagccacgtggtggaaactgaggtcagctttcgccccaagattgctcggggtgtcggttccagggccacaggcctggcttgtgtggctgcaccagtggcccccggaagcctgaaactaggggtcaggggctatgggatcccgaatggggggcctgtgggagctgaagcaggaagctgtgtctttccccagggccggattcagaggccacgacccgacctaagcggcccacccacagccggcccgtgcccccgccacccccaggagaacccctacctctggaacaagttcgccgacgggaagctgctcttccacaatgcggccctgctgcacctcgtgcggaccaacggggacgaggccgtgcgggagttctggcgcctgctggccatctgccacacggtgatggtgcgggagagcccccaccagctgttgtaccaggcggcctcccccgacgagggggcgctggtcaccgcagcccggaacttcggctacgtgttcctgtcccgcacccaggacaccgtcacgatcatggagctgggggaggaacgggtctaccaggtcctggccataatggacttcaacagcacgcgcaaacggatgtcggtgctggttcgaaagccagagggcgccatctgcctgtacaccaagggcgccgacacggtcatcttcgaacgcttgcacaggaggggggcaatggaatttgccacagaggaggccttggctgcctttgcccaggagaccctgcggacactgtgcctggcctacagggaggtggctgaggacatttacgaggactggcagcagcgccaccaggaggccagcctcctgctgcagaaccgggcacaggccctgcaacaggtgtacaacgagatggagcaggacctcaggctgctgggagccacagccatcgaggacagactccaggacggtgtccctgaaaccatcaaatgtctcaagaagagcaacatcaaaatatgggtgctcaccggggacaagcagggcagccagtgcggggcgggtcgcagaggcgctgagctggtctgcttcgcagaaacggctgtgaacatcggcttcgcctgcgagctgctgtcagagaatatgctcattctggaggagaaggagattagccgcatcctggagacctactgggaaaacagtaacaaccttctaaccagggagtccctgtcgcaggtcaagctggccttggtcattaacggagacttcctggacaaactgctggtgtccctgcggaaggagccgcgcgccctggcgcagaacgtgaacatggacgaggcgtggcaggagctcggccagtccaggagggatttcctctacgccaggcgcctgtccctgctgtgccggaggttcgggctcccgctggctgcaccgccagcccaggactccagagcccgccgtagctccgaggtgctgcaggagcgcgccttcgtggacctggcgtccaagtgccaggcggtcatctgctgccgcgtgacgcccaagcagaaggccctgatcgtggccctggtcaagaagtaccaccaggtggtgaccctggccatcggggacggtgccaacgacatcaacatgatcaagagtggctgcttgtgccctgcagccgcggacgtgggcgtggggctggcgggccaggagggcatgcaggcagttcagaacagcgacttcgtgctcggccagttctgcttcctgcagcgcctcctgctggtgcacggccgctggtcctacgtgcggatctgcaagttcctgcgctacttcttctacaagagcatggccagcatgatggtgcaggtctggtttgcctgctacaacggcttcaccggccagcccctgtatgaaggatggttcctggctcttttcaacctcctgtacagcaccctgccagttctctacattgggctctttgagcaggacgtgagcgcagagcagagcctggagaagccggagctgtacgtggtggggcagaaggacgagctcttcaactactgggtcttcgtccaagccatcgcccatggtgtgaccacctctctggtcaacttcttcatgacactgtggatcagccgcgacacggcgggacccgccagcttcagcgaccaccagtcctttgcggtcgtggtggccctgtcttgcctgctgtccatcaccatggaggtgggcaaggtcctcacctccccggggccttggacatggcctatggaggcctcctcccctggggacccctgctttgggggcattgccaggtgcccttcctggaccccaggggctggtgtcctggtgcaagccccgctaggccccggatttaccccaccgctgcctgtccaggtcattcttatcatcaagtactggaccgccctgtgcgtggcgaccatcctcctcagccttggtttctacgccatcatgactaccaccacccagagcttctggctcttcagagtatcccccacgaccttcccgtttctgtgtgagcccccatggggaagtgggacgggcgatgccgacctcagcgtgatgtcctctccctccatcctgctggtggtcctgctgagtgtgtccataaacaccttccctgtcctggccctccgagtcatcttcccagccctcaaggagctacgtgccaaggaggagaaggtggaggagggccccagcgaggagattttcaccatggagcccttgcctcatgtacaccgggagtctcgtgcccgccgttccagctatgctttctcccaccgccagctgacgttggagagccagccagactcctcggaggagaagtcagcatttttgaagccctccacaccgttccggaagagctggcaaaaggagcctcacacccccaaggaggggacggtgccacttccagacaagacccacaaatctcaggtggagactctgccaccaagtctggaagaatcgtccacgtccacgagcgagcagcctatggaggtggagctgtggcccgcggagaagcagtcatcatcatccatggagtggctgctggtgcccggggaggagcagctatccttgcccccagaggagcagtcattgccctctgcggaggggaccagggttcagcagtgacgtagcatctgaatccctagacccatctgatgaagaggcatcttcgagcccaaaggagtcacgctggcatatcaggaagatgtccttcctgggaagaagaagctccagccagttctgctgcaagtcaaccagcatgcagggggccttcctctaaagacaaggactccacatgcttttctttttctaataaaccagggtccatctgaccccagcgctaattcaggctccctctttccctacactttttttgtgatggaatattccttcccggtttttaaaatcaaaacactgacctctagtggtccagccgggtatttgcagggaaaactttccttcttcatgctgggcctctgttcccaagctggcacatctgtgcccctttccacctccagggactatctggggatggctcagggacgtggcctcatggcacaagaggagtcagaggcagaggacattgtcccagagccccctttgatgattttggggagtcctctgttctgactcatttaaataagaaatctgtaaacgccactggtcctttctgccgcagtctctctcgcgatcacgctccctctaactttccctctggtctccagccctgacattcaatgcgtctcccacggaactcgtcaaagaaacgacatgccatcgtctgcaaaattataatttaacggtataaagcttcaagtcacgtattccaaaaactagctaaggatttttttttaatcacataaactatacattaaatattttgaggtatttcagagaaaattgtcaaaggctcgaaggaattgtgctggaggtgttgatccctgcatggagaacgcatgctctttggtatgtgacagccaagtgggcatgcggggaggcaggagagggcctgaggggccggcgggcaggtcggggatagagccttctgtgggggtctggccaagtttggggtggggtccggaaacaggtaggggtgtgtgtgtgtgtgtgtgtgtgtgtgtgtgtgtgtgtgtgtgtgtgatacgaagatatctgaaaaggatccaggag

SEQ ID NO: 462600 - DNA, 2266 bp, Homo sapiens
  misc_feature (1)..(1): n is a, c, g, or t
  misc_feature (9)..(10): n is a, c, g, or t
nctcctctnngccaaggaagcggccccctaaaaccgcttccgggactgcagcttctctccccacactctcaaggagcagagccttctcgggccacaattctccgcgacccaaaaataactacacagatgtgaggaaaagggccaaagcctacagcacaaggtggttctcagttaaagccttatcgcttacggccaggaagctcgaaacctaacccagcgccagccttttatagccggtccctcgagccccgccctagcaacttctcctagcaacgcctcgccccgtgctctgccgccttatctgcctccgccaggcctttcctgttcccctcccccagcccgcaccgccccgccgcccggctcacttgacccgccccaggggaggggaggggtgaacggaagcgtgaggggcggggcgttggaagatgctcgcgtcatcaagaggcgccgggcgagttgcggcgcctggtgtctcagagaggcttgaggttcgggtagtcggtgacatggcggaggccgcggcgctggtgtggattcgcggccctggcttcgggtgcaaggcggtgcggtgtgcctcgggtcggtgcaccgtccgggattttatccaccggcactgccaagatcagaatgttccagtggaaaacttctttgtgaaatgcaatggagcactcattaacaccagtgacacagtgcagcatggagctgtttatagtttggaacccagactttgcggtggaaaaggaggttttggatctatgctccgagcacttggtgctcagattgagaagacaaccaatcgagaagcttgtcgggatctcagtggaaggagactacgcgatgtcaatcatgaaaaagcaatggctgaatgggtaaaacaacaagccgagcgagaggctgaaaaggagcagaagcggctggagcgactgcagcggaagcttgtagaacccaagcactgcttcaccagccccgactaccagcagcagtgccatgagatggctgagcgtctggaggattccgtcctcaaaggtatgcaggctgcctccagcaagatggtttcagcagaaatcagtgagaatcggaaacggcaatggcctactaaatctcaaacagacagaggagccagtgcgggaaagaggagatgcttctggttgggcatggagggactagagactgcagaagggtccaactctgagagttcagatgatgacagtgaagaagcaccaagcacttcaggaatgggtttccatgctccaaaaattggtagcaatggtgtcgagatggcagccaaatttcccagtggttctcagagggcgagagtagtgaatacagaccatggatcaccagaacaactgcagatcccggtgactgactctgggaggcatattttagaagactcatgtgctgagctgggggagtccaaagagcacatggaaagcaggatggttacagaaacagaagagacccaggagaagaaggcagagagtaaagaacccatagaagaggagcccactggggctggactgaataaggataaagagacagaagaaaggactgatggggaaagagttgctgaggtagcacctgaagaaagggaaaacgttgccgttgccaaactgcaggaaagccagccaggaaacgcagttattgataaggaaactatagatttattggcgttcacctctgttgcagaactggagttgctgggtttggagaagctcaaatgtgaactgatggcccttggactgaaatgtgggggcactctgcaggagcgggcagcaagactcttctctgtcagaggactggcaaaggagcaaattgacccggctttatttgccaagcctttgaaagggaagaaaaaatgagtatcatcagagctgattcctatttgtttatagtgtctaccatttacaacctgcataatgtggactcttgaccagtattcctgttgatattaaaagctaactttttagtaacccaattctaactatcccctttttccttgtcagggctgtagaattaatgtctgaaaccatctgggccttaaattttctttgtctggttttctatagtgtatttaataaatatagggctattcacattttttggtttgatcttggtgtcatttaggtaatgaatctatccaagaaatctatccttttgacccaggctgaataatattccattgtatgaatagactccattttgtttatccatttgatttgtttgttttgagatggattctcactgtcacccaggttgtgggtcc

SEQ ID NO: 462601 - DNA, 450 bp, Homo sapiens
aaataactaacgcagggataaataattaggtttggggagggctgggtatgaacttgtcagtctcaaggttacaaattgtgcagtggtgctttaaaaaatctgctcctagactagaatgtttatcattttaaatctgtgtaaatttgagattaactgtataaaatgttggtatcttaagaaatttaaatctggagctgtagattgcagctctttttgcaatccatgttatttatgatttctttaaacttagtccctatagtagaaactgagttgttaaaatttctggttaggtatgcaggctgcctccagcaagatggtttcagcagaaatcagtgagaatcggaaacggcaatggcctactaaatctcaaacagccatttaggtaacagccatttaggtgcagccatttaggtacagccatttaggtaacagccatttaggaggatcctg

SEQ ID NO: 462602 - DNA, 1530 bp, Homo sapiens
aaataactaacgcagggataaataattaggtttggggagggctgggtatgaacttgtcagtctcaaggttacaaattgtgcagtggtgctttaaaaaatctgctcctagactagaatgtttatcattttaaatctgtgtaaatttgagattaactgtataaaatgttggtatcttaagaaatttaaatctggagctgtagattgcagctctttttgcaatccatgttatttatgatttctttaaacttagtccctatagtagaaactgagttgttaaaatttctggttaggtatgcaggctgcctccagcaagatggtttcagcagaaatcagtgagaatcggaaacggcaatggcctactaaatctcaaacagacagaggagccagtgcgggaaagaggagatgcttctggttgggcatggagggactagagactgcagaagggtccaactctgagagttcagatgatgacagtgaagaagcaccaagcacttcaggaatgggtttccatgctccaaaaattggtagcaatggtgtcgagatggcagccaaatttcccagtggttctcagagggcgagagtagtgaatacagaccatggatcaccagaacaactgcagatcccggtgactgactctgggaggcatattttagaagactcatgtgctgagctgggggagtccaaagagcacatggaaagcaggatggttacagaaacagaagagacccaggagaagaaggcagagagtaaagaacccatagaagaggagcccactggggctggactgaataaggataaagagacagaagaaaggactgatggggaaagagttgctgaggtagcacctgaagaaagggaaaacgttgccgttgccaaactgcaggaaagccagccaggaaacgcagttattgataaggaaactatagatttattggcgttcacctctgttgcagaactggagttgctgggtttggagaagctcaaatgtgaactgatggcccttggactgaaatgtgggggcactctgcaggagcgggcagcaagactcttctctgtcagaggactggcaaaggagcaaattgacccggctttatttgccaagcctttgaaagggaagaaaaaatgagtatcatcagagctgattcctatttgtttatagtgtctaccatttacaacctgcataatgtggactcttgaccagtattcctgttgatattaaaagctaactttttagtaacccaattctaactatcccctttttccttgtcagggctgtagaattaatgtctgaaaccatctgggccttaaattttctttgtctggttttctatagtgtatttaataaatatagggctattcacattttttggtttgatcttggtgtcatttaggtaatgaatctatccaagaaatctatccttttgacccaggctgaataatattccattgtatgaatagactccattttgtttatccatttgatttgtttgttttgagatggattctcactgtcacccaggttgtgggtcc

SEQ ID NO: 462603 - DNA, 213 bp, Homo sapiens
ccatatgctagtagtaagcatggctcacctttctaagagaatatcacagtatgaacaagtgcattaattcgtcagagacattttatatataaaagtgtatatgtaatatatctattcagttatatctcttcctccctcatccccagaatggctgaatgggtaaaacaacaagccgagcgagaggctgaaaaggagcagaagcggctggagcga

SEQ ID NO: 462604 - DNA, 2217 bp, Homo sapiens
  misc_feature (1)..(1): n is a, c, g, or t
  misc_feature (9)..(10): n is a, c, g, or t
nctcctctnngccaaggaagcggccccctaaaaccgcttccgggactgcagcttctctccccacactctcaaggagcagagccttctcgggccacaattctccgcgacccaaaaataactacacagatgtgaggaaaagggccaaagcctacagcacaaggtggttctcagttaaagccttatcgcttacggccaggaagctcgaaacctaacccagcgccagccttttatagccggtccctcgagccccgccctagcaacttctcctagcaacgcctcgccccgtgctctgccgccttatctgcctccgccaggcctttcctgttcccctcccccagcccgcaccgccccgccgcccggctcacttgacccgccccaggggaggggaggggtgaacggaagcgtgaggggcggggcgttggaagatgctcgcgtcatcaagaggcgccgggcgagttgcggcgcctggtgtctcagagaggcttgaggttcgggtagtcggtgacatggcggaggccgcggcgctggtgtggattcgcggccctggcttcgggtgcaaggcggtgcggtgtgcctcgggtcggtgcaccgtccgggattttatccaccggcactgccaagatcagaatgttccagtggaaaacttctttgtgaaatgcaatggagcactcattaacaccagtgacacagtgcagcatggagctgtttatagtttggaacccagactttgcggtggaaaaggaggttttggatctatgctccgagcacttggtgctcagattgagaagacaaccaatcgagaagcttgtcgggatctcagtggaaggagactacgcgatgtcaatcatgaaaaagcaatggctgaatgggtaaaacaacaagccgagcgagaggctgaaaaggagcagaagcggctggagcgactgcagcggaagcttgtagaacccaagcactgcttcaccagccccgactaccagcagcagtgccatgagatggctgagcgtctggaggattccgtcctcaaaggtatgcaggctgcctccagcaagatggtttcagcagaaatcagtgagaatcggaaacggcaatggcctactaaatctcaaacagacagaggagccagtgcgggaaagaggagatgcttctggttgggcatggagggactagagactgcagaagggtccaactctgagagttcagatgatgacagtgaagaagcaccaagcacttcaggaatgggtttccatgctccaaaaattggtagcaatggtgtcgagatggcagccaaatttcccagtggttctcagagggcgagagtagtgaatacagaccatggatcaccagaacaactgcagatcccggtgactgactctgggaggcatattttagaagactcatgtgctgagctgggggagtccaaagagcacatggaaagcaggatggttacagaaacagaagagacccaggagaagaaggcagagagtaaagaacccatagaagaggagcccactggggctggactgaataaggataaagagacagaagaaaggactgatggggaaagagttgctgaggtagcacctgaagaaagggaaaacgttgccgttgccaaactgcaggaaagccagccaggaaacgcaaactggagttgctgggtttggagaagctcaaatgtgaactgatggcccttggactgaaatgtgggggcactctgcaggagcgggcagcaagactcttctctgtcagaggactggcaaaggagcaaattgacccggctttatttgccaagcctttgaaagggaagaaaaaatgagtatcatcagagctgattcctatttgtttatagtgtctaccatttacaacctgcataatgtggactcttgaccagtattcctgttgatattaaaagctaactttttagtaacccaattctaactatcccctttttccttgtcagggctgtagaattaatgtctgaaaccatctgggccttaaattttctttgtctggttttctatagtgtatttaataaatatagggctattcacattttttggtttgatcttggtgtcatttaggtaatgaatctatccaagaaatctatccttttgacccaggctgaataatattccattgtatgaatagactccattttgtttatccatttgatttgtttgttttgagatggattctcactgtcacccaggttgtgggtcc

SEQ ID NO: 462605 - DNA, 2453 bp, Homo sapiens
  misc_feature (4)..(5): n is a, c, g, or t
  misc_feature (7)..(10): n is a, c, g, or t
  misc_feature (604)..(604): n is a, c, g, or t
  misc_feature (606)..(606): n is a, c, g, or t
  misc_feature (608)..(608): n is a, c, g, or t
  misc_feature (610)..(610): n is a, c, g, or t
  misc_feature (612)..(613): n is a, c, g, or t
gagnncnnnnagcactgcagccccagcctgagcagcagtcgttctcacagatgcacctgggccaccgcggccacatgcgtcgcagtgagagcacctactctgtaaatagtactggccggcgggggcgtggcaccctgggacagcctccacctggacggcgatggaacccagcgatgcaggccatagtgccagcaagagcccctgcatgttggtggccctgcggccaaccaacgtggaccgtgagggagacaagttctttcagtcgcattacacctacaatccacagttcgagtaccaggagcccatgcctatggctgtggtgaagtactgcgaggcctctggacagttcatccatcaggcagttggcatcattgaggctgttctggagaagtttggaacctacgaacactttgaggctgccaccggcaggcagctgctcaccaagtgccagatatggtccattgtggaggttgtggtgcagctgagtgaagacctgctgtcccaggcggtgatgatggtggagaacagccggcccacattggcggtcaacctgaccagagcccgccagtactggttggagggcatgctgtggcatgaaataggncngngngnnggcacccactacctgcggggcggtaacaacgcgcgccagccgtggcacaacgcggagggccggctgcggtacgggctacggccggcgaaccccacgaggagggcctggccaccctgcacagcgtgctgctccgcaagcagccgttcctgtggcgcgctgcgctgctctgctctgctacaccagccgccacgctgtgcgtctgtccttccgccagctcttccaggacctggcgcgctacgtgcgggacgccgacgtgcgctgggacaaggaccaggtgtacctgaacggcatcctgtgcattctgggacatcgccagaccatcgatttcccgctgctgacctcactgggcaaggtgtcctatgaggatgtggaccacctgcggccccatggggtgctggataatacccggatgccccaccttatgcaggacttggcacgctaccggcagcagctgaagcacatcatggccaccaaccggctggatgtggcggagctgggtcgcctgctgcccgactgatcattcgtgctgtctgcttctcactgggtcctggtgggggtcgggatcccttctcctggggtgattgatggcctgagcttggggtactacctggggtagtagagacccagttggtctggggtgtgctttccaacattttgcctctctcactggtcatgtatttattccatatttatatgatctacttcctgtggctgggagcagcagctcctgaaggttccatggcagggaacaagacactccttctggaaggcaccgattttcctagccccactcccattacacgcacacacacacacacacatacagagtgattcaggccttgtgaatcaagcccaagagctcccttggccctgtccccactccctccactggcctctgcttttcctgtctttgcccacaccctcacagctggtctctggcacaggctggcatagcctaggagcagctgcagttgtccctgagggacaggccctagagtttggtggcccaagtcctaaacccctcctggaccaggtgaggtgcagagcgccttttgtgtaagttactggtcagaatcctcactgagctcccagtccagagggaagccagacaattaaaacagtaataacaaaaaaaaaaaagaaaaaagaaaaaaagggataagaagcctgacatataaatagcatgaattgataagaacaaacaacccgacagaacgatgcaggaaaatgctaaaagtgtttaaatcctagacttgaaaagaaaaaatcgccaacaaaatgtgaaataaaaatgctcagtttaattagttaagaattcaactacattcaaatgaaaataaaagccatttgtcatccttagaaagaaaaatgataaaaacaggagtaaaatcctgtgcgtgaggccaaaggaaattggacactcttgtccctcacatggaggagggcaaagtactaaaacctttccgaaaaatatctattaaagtaaaaacaggcacactctaaataagtcatcccacttttgcgaatctgttctgtggaaaatgcatgttcttcctaacctttgctaagcatttaaacacactcatatatattatgacgtataaatgtttgtgcagtgatatctattatggcactgttcattgtggcaaaaatccggaagcaaccttatgtccattaaaggtgagaggattgaataaattatgcatatctgcactatggaatattttgaagctattaaaaaagaatgatatgattttataaatacttaattggagaaatgttcatgacattggtaatgaaaatgaaagagtaatttgtaaagcatgaacttattgaaaaa

SEQ ID NO: 462606 - DNA, 2424 bp, Homo sapiens
  misc_feature (2)..(2): n is a, c, g, or t
  misc_feature (5)..(6): n is a, c, g, or t
  misc_feature (8)..(8): n is a, c, g, or t
tnttnntngaaccagaggccggggcaagcgcctcttaggctcccacagccccctgtgttcctcactccaggtctgaccttctgggtagtagttgtctaattaggtgcgtatctccttcgactggggtgcctgcgggaggcctttcattgtcccgcgctaggattatgcaaataagcaggcctcgggcccaggatccagtccgaactagcgccctccacccccagcgcatcccagttttgtaaggcgcgttcctgccccgcacacgcacgcgcgaacccttcagcttcttgttcctttgggccgcgggctgtaccaagtaaacccaggcagcgaggggcaaagcacggcgccccccgcgcgggtctcgtcgacggcccgacgcgcatagcccctcttcccacagcgctacaggactagtccgtctcgccgcgcaagcgccctaggctcttcacgccccctgcgcgctgtcctaccctacttgcgacgcaggcgcagaggctgggcgtgcagccgccgccgcagagccggagcgggggccgccggcgccgcatccctctctacctgccaacatcctgtattagagaacttgtggccggaggtgtggctgtggagagctggccggggagggacgctgctcagctgctgctctgctcctgtctcctgtcccctcccccggtcatgacagagacccgtgagccagctgagactgggggctacgccagcttggaagaagatgatgaagacctttccccaggctggaagggagtggcgcaatcatggctcaaatgcagcctggaactcctcggctcaagtgatcctcccgcctcagcctcccgagaagctggtactacaggccccgagcattcctctgattcagaatacactctctcagagccggactccgaagaggaagaagatgaggaggaggaggaagaggagaccactgacgatcctgaatatgatcctggctacaaggtgaagcagcgccttggcgggggccgtggtggcccatcccgccgggccccccgtgcagcccagcccccggcccagccttgccagctctgtggccgctcaccccttggggaggccccaccgggaaccccaccctgccggctctgctgccctgctacagccccccaggaagcaccagcccctgaaggcagggccctcggggaggaagaggaggaaccacctcgggctggggagggccgaccagctgggcgggaggaggaggaggaagaggaggaggagggaacctaccactgtacggaatgtgaggattccttcgacaacctgggggagctgcacgggcacttcatgctgcatgcccggggtgaggtgtaggcagagcccccatacggggagcttggcagaaggggtggggtgggaggagggggctgaggaaattggggttgtgacagtggtcatgggggatggggtactgccggtctgtgttgtcttagaagtagatgtgtgatggccagaataaaagccaaaatctgtatctgtgtgtgttggttcagagtgtgtgtgtgtgtgtgtgtattcccgcccgtgtgtgtgtttgtgtgtgtgtgtgtgtgtgtgtattccccctgggctccttcttggggaaccttggggtcttttgggaaagataacatttactgcgtgcttgtattcgatgaggtttccatgtatttacttacagaccccataatgtaaaggctctaataatagaattttgtttctcactcacaaaatggtgctgggtgagtcatttggggacccaggccatcccttaagcctgttgtctcccccatggtccagactgggtggccatagcctgggtcctgctggcagaagaggacaggatgcctggtgaggtgcacgtgttgtcttacaagccctggcctgccaggggcacacactgcttccattgacacgcctttgctgagaaattagatatgtggccgcagctaactgcaaaaacaacctgggagaagcagtctagccaagcgcccagaaagcagaaaacagttcatggaggacagctagggctttctgccacatagcctaggaacttccacaaagaggactttaattataatcacagctacgctttctcagcgcttcctgggtatctggtgccagtccaagggctttatatatattgactcatagaaatggtgcatctaggaacttacaaaaatagaaccttaatgataattgcagctgccattttcccagcacttacagagtgctgtacttaatttgcatgagattatcagcttcttagaataaccctgtgagacagggattgtgatccattaattcatttaacaaatatttttgagtacctgctgtgtgctaagcattgggaacacagcagtgaataaaataaaatcgttgtcctcatggagcttacatgggagtgggtagagg

SEQ ID NO: 462607 - DNA, 2035 bp, Homo sapiens
  misc_feature (2)..(2): n is a, c, g, or t
  misc_feature (5)..(6): n is a, c, g, or t
  misc_feature (8)..(8): n is a, c, g, or t
tnttnntngaaccagaggccggggcaagcgcctcttaggctcccacagccccctgtgttcctcactccaggtctgaccttctgggtagtagttgtctaattaggtgcgtatctccttcgactggggtgcctgcgggaggcctttcattgtcccgcgctaggattatgcaaataagcaggcctcgggcccaggatccagtccgaactagcgccctccacccccagcgcatcccagttttgtaaggcgcgttcctgccccgcacacgcacgcgcgaacccttcagcttcttgttcctttgggccgcgggctgtaccaagtaaacccaggcagcgaggggcaaagcacggcgccccccgcgcgggtctcgtcgacggcccgacgcgcatagcccctcttcccacagcgctacaggactagtccgtctcgccgcgcaagcgccctaggctcttcacgccccctgcgcgctgtcctaccctacttgcgacgcaggcgcagaggctgggcgtgcagccgccgccgcagagccggagcgggggccgccggcgccgcatccctctctacctgccaacatcctgtattagagaacttgtggccggaggtgtggctgtggagagctggccggggagggacgctgctcagctgctgctctgctcctgtctcctgtcccctcccccggtcatgacagagacccgtgagccagctgagactgggggctacgccagcttggaagaagatgatgaagacctttccccaggccccgagcattcctctgattcagaatacactctctcagagccggactccgaagaggaagaagatgaggaggaggaggaagaggagaccactgacgatcctgaatatgatcctggctacaaggtgaagcagcgccttggcgggggccgtggtggcccatcccgccgggccccccgtgcagcccagcccccggcccagccttgccagctctgtggccgctcaccccttggggaggccccaccgggaaccccacctgcacgggcacttcatgctgcatgcccggggtgaggtgtaggcagagcccccatacggggagcttggcagaaggggtggggtgggaggagggggctgaggaaattggggttgtgacagtggtcatgggggatggggtactgccggtctgtgttgtcttagaagtagatgtgtgatggccagaataaaagccaaaagatctggtaaaaaacaaaaagaaaacaaaaaaaaaaaagaaaagaaaaaagaaaaccaaaaaaaaaagaaagaaaaaagaaaaaaaaaaagggggggggggcgcgggcacgaaaataacatcccgcgggggggggcccgcacttagaccgcatccccccgcttttttgtgtgaaaaaggggggccccaagggggggggcaaataaaaagggggggggggggggggcggaaaaacggggggggggggggacacagcgtggccggggggcgacttcttggggagagagcgacacccccctcgcggggcggggcgggggaaacacttggggggaccaaccaccccccaacaaaatatataaggagcgcggagggaaaacaataaaaaccccgaggcgtgcacagagggggtacaccacccgagggaatatggcgggggggagaaaagatgggaccacggggaatatgttagaggaacacactttccgccgcggcgtgattataaaacgagagtgaagtatgaggcccggccgcgggggcgcaaaacaaccacgacgcagagatagaaagagcagaagcatggcagaaagcaacgacgaggcagaggccaagagggccgcgggagcagaccagaacaacacgagggaggagaagcaaccgaagggagccaagcagaaccgcacgaaaggaagcgcaacgacacccaccacacaacacacgaccggaaccgaagcgaacaaccaggcggaccacgctgcgcaagccggcagcgagcgggcagcgaagagcgaacagaggggggggggccgagagcgggaagaaagaaacaaggcatgg

SEQ ID NO: 462608 - DNA, 2325 bp, Homo sapiens
  misc_feature (2)..(2): n is a, c, g, or t
  misc_feature (5)..(6): n is a, c, g, or t
  misc_feature (8)..(8): n is a, c, g, or t
tnttnntngaaccagaggccggggcaagcgcctcttaggctcccacagccccctgtgttcctcactccaggtctgaccttctgggtagtagttgtctaattaggtgcgtatctccttcgactggggtgcctgcgggaggcctttcattgtcccgcgctaggattatgcaaataagcaggcctcgggcccaggatccagtccgaactagcgccctccacccccagcgcatcccagttttgtaaggcgcgttcctgccccgcacacgcacgcgcgaacccttcagcttcttgttcctttgggccgcgggctgtaccaagtaaacccaggcagcgaggggcaaagcacggcgccccccgcgcgggtctcgtcgacggcccgacgcgcatagcccctcttcccacagcgctacaggactagtccgtctcgccgcgcaagcgccctaggctcttcacgccccctgcgcgctgtcctaccctacttgcgacgcaggcgcagaggctgggcgtgcagccgccgccgcagagccggagcgggggccgccggcgccgcatccctctctacctgccaacatcctgtattagagaacttgtggccggaggtgtggctgtggagagctggccggggagggacgctgctcagctgctgctctgctcctgtctcctgtcccctcccccggtcatgacagagacccgtgagccagctgagactgggggctacgccagcttggaagaagatgatgaagacctttccccaggccccgagcattcctctgattcagaatacactctctcagagccggactccgaagaggaagaagatgaggaggaggaggaagaggagaccactgacgatcctgaatatgatcctggctacaaggtgaagcagcgccttggcgggggccgtggtggcccatcccgccgggccccccgtgcagcccagcccccggcccagccttgccagctctgtggccgctcaccccttggggaggccccaccgggaaccccaccctgccggctctgctgccctgctacagccccccaggaagcaccagcccctgaaggcagggccctcggggaggaagaggaggaaccacctcgggctggggagggccgaccagctgggcgggaggaggaggaggaagaggaggaggagggaacctaccactgtacggaatgtgaggattccttcgacaacctgggggagctgcacgggcacttcatgctgcatgcccggggtgaggtgtaggcagagcccccatacggggagcttggcagaaggggtggggtgggaggagggggctgaggaaattggggttgtgacagtggtcatgggggatggggtactgccggtctgtgttgtcttagaagtagatgtgtgatggccagaataaaagccaaaatctgtatctgtgtgtgttggttcagagtgtgtgtgtgtgtgtgtgtattcccgcccgtgtgtgtgtttgtgtgtgtgtgtgtgtgtgtgtattccccctgggctccttcttggggaaccttggggtcttttgggaaagataacatttactgcgtgcttgtattcgatgaggtttccatgtatttacttacagaccccataatgtaaaggctctaataatagaattttgtttctcactcacaaaatggtgctgggtgagtcatttggggacccaggccatcccttaagcctgttgtctcccccatggtccagactgggtggccatagcctgggtcctgctggcagaagaggacaggatgcctggtgaggtgcacgtgttgtcttacaagccctggcctgccaggggcacacactgcttccattgacacgcctttgctgagaaattagatatgtggccgcagctaactgcaaaaacaacctgggagaagcagtctagccaagcgcccagaaagcagaaaacagttcatggaggacagctagggctttctgccacatagcctaggaacttccacaaagaggactttaattataatcacagctacgctttctcagcgcttcctgggtatctggtgccagtccaagggctttatatatattgactcatagaaatggtgcatctaggaacttacaaaaatagaaccttaatgataattgcagctgccattttcccagcacttacagagtgctgtacttaatttgcatgagattatcagcttcttagaataaccctgtgagacagggattgtgatccattaattcatttaacaaatatttttgagtacctgctgtgtgctaagcattgggaacacagcagtgaataaaataaaatcgttgtcctcatggagcttacatgggagtgggtagagg

SEQ ID NO: 462609 - DNA, 1255 bp, Homo sapiens
aaggaaggacggaaggaaagatagagaggggacatgactttggttttggggtaggggtgagggggatgtctcatgcgagagtaggggccctggggactagtgaccagcagattcctgacccacacacctcctcccccaacccccaggagggccctggagagtggctgacgctggactcccaggtcatcatggcagacagtgagatctgtggcaccaaggaccccaccttccaccgcatcctcctggacacgcgctttgagctacccttagacattcctgaagaggaggctcgctactgggccaagaagctggagcagctcaatgctatgcgggaccaggatgaatattcgttccaagatgagcaagacaagcctctgcctgtccccagcaaccagtgctgcaactggaattattttggctggggtgagcagcacaacgatgaccccgacagtgcagtggatgatcgtgacagtgactaccgcagtgaaacgagcaacagcatcccgccgccctattatactacgtcacaacccaacgcctcagtccaccaatattctgttcgcccaccacccctgggctcccgggagtcctacagtgactccatgcacagttacgaggagttctctgagccacaagccctcagccccacgggtagcagccgctatgcctcttccggggagctgagccagggaagctctcagctgagcgaggacttcgaccctgacgagcacagcctgcagggctccgacatggaggatgagcgggaccgggactcctaccactcctgccacagctcggtcagctaccacaaagactcgcctcgctgggaccaggatgaggaagagctggaggaggacctggaggacttcctggaggaggaggagctgcctgaagatgaggaggagctggaggaggaggaggaggaggtgcctgacgatttgggcagctatgcccagcgtgaagacgtagctgtggctgagcccaaagacttcaaacgcatcagcctcccgccagctgccccagggaaggaggacaaggccccagtggcacccaccgaggcccccgacatggccaaggtggcccccaagccagccacgcccgacaaggtgcctgcagctgagcagatccctgaggctgagccacccaaggacgaggagagggccaaggccaactggctgcgtgccttcaacaaggtgcggatgcagctgcaggaggaaaactccctggaggagatgacacttaaggagaagtgatg

SEQ ID NO: 462610 - DNA, 312 bp, Homo sapiens
aaggaaggacggaaggaaagatagagaggggacatgactttggttttggggtaggggtgagggggatgtctcatgcgagagtaggggccctggggactagtgaccagcagattcctgacccacacacctcctcccccaacccccaggagggccctggagagtggctgacgctggactcccaggtcatcatggcagacagtgagatctgtggcaccaaggaccccaccttccaccgcatcctcctggacacgcgctttgagctacccttaggtgagtacaggggcccgggaccttcacccagccccagcccca

SEQ ID NO: 462611 - DNA, 741 bp, Homo sapiens
aatattgacccctctttaattcatcaagatgaatccagcttcccgcagtaattatctcccttccagtccagatgcaaggatgggtgagcagttcaggatgagaccatttcttcttcttacctacttcatcattcatgctcatctcaatgttggctataaggtaaagggaagcacgcctcaagtgatcatgcaaacaactccagtgaagacactgcgcatgctctcttcccaagtgcgggcaggcagctgtgcatgtgggcagcccaccccaaaggaagaagaatcaggaaagaaggggcgcaagactccggacgtatgccaacgcataaaaccccaagtcaaaagctcaaaccacacatctgtcctccaagatgcctacttggccccttccaagagtaatttactttcgtttcattcctgctctaaagctttttaataaatgttcactcttgctctaaatcttgccttggcctctttttctgccttgtgcccctcagtcagattctttcatctgaggagggaagaattgaagttgctgtagacccgtatagattcgctgccagcagctcgggatacctgccaccactaacattttgatgttagatgtctgcagatcccacaatccctccctctctttcctgagatgagagtctgtaatgaagaatttgcccgtgctcttgcatggtcattcctccccctgaagcctcagtgggctgtcatttgcccagaggcaacatgtgt

SEQ ID NO: 462612 - DNA, 1568 bp, Homo sapiens
agaagcctgctccttgggacccacactgggtgaggtttcctattcccatatttagtgcgagtggtgagatcccagatgtggtgagcctgtggtatggaggcccttgactccagtgaccctgatgtgagctcctgtggtgctcccggctgcagcaatgcctgagccgccagatgcgcaccaccagctccaggagccacttcgctctttttgtcctttttgtctcttttaatcctcgccccagaccctgaggaggccaggctcagccttcttcctccagggagggggttctggctgcgccaaggtgaaaatgcactccagaaggttcctgtcatctcaggctttccgcgggaccacagaacctcgtgtcctgtgcatggtccttccacagaaccctccagatcccatccttgcccaggacctctgtggggatggcagcgtgattgacgtcctccacaaactccaccagggcggcctgggccttcttatccatcaagcccttcatgtgttgcagcccgaacgtgcccaggggcaggagggtcgactgcaggacggcttcaacatccacctgctccaggccctccaggatcccggtgaccagcagggccctgtgcgcgtccatgtccaggcccctggcactagcagaaagaacctggtggcaaagttccagaggttagcggagcctagcatggaggcggtggtcaaggtgaagccccacgacaaggatgccaaaatgaaataccaggagtgcaacaagatcgtgaagcagaaggcctttgagcgggccatcgcaggcgacgagcacaagcgctccgtggtggactcgctggacatcgagagcatgaccatcgagggtgagtacagcggacccaagcttgaggacgacaaagtgacaatcaccttcatgaaggggctcatgcagtggtacaaggaccagaagaaactgcaccagaaatgcgcctaccaggtaatgcacctgtcaggtaccgggcacccgggaaccctgggatggcatcacagcactgccaggcgcgggcactgagcaaaatgacaggagaagggcagccacaacagccaacaccaaacaggagtcgtggtcattatggattggcagtaatccctcccaatattcagatacaataaactatctctacaaataaagccaccaaccttggctcacttgttcagaagatagcaccccatcctgtaacaacatgcctctgagcttcttactacctgggttgaggtctcctggattgtgccctgtccccacttttttttaatgacaacaaacttttaaatatttattcattggatctgattttgttttggacactggcatgcaaaggggagggagatggtcataggactgttgtcaacgttcaaaagcaaaacaggatttatatgagaaagttgtaaaagaccttccaccctgcgtgtgtgtgcacacacacacagcctcagatttctcatctgggaaatagagataataatggggctggctttacatgactgtggtgaagattaaatgaagcaatatattaaaggctattctagccaatgtctggcat

SEQ ID NO: 462613 - DNA, 1615 bp, Homo sapiens
agaagcctgctccttgggacccacactgggtgaggtttcctattcccatatttagtgcgagtggtgagatcccagatgtggtgagcctgtggtatggaggcccttgactccagtgaccctgatgtgagctcctgtggtgctcccggctgcagcaatgcctgagccgccagatgcgcaccaccagctccaggagccacttcgctctttttgtcctttttgtctcttttaatcctcgccccagaccctgaggaggccaggctcagccttcttcctccagggagggggttctggctgcgccaaggtgaaaatgcactccagaaggttcctgtcatctcaggctttccgcgggaccacagaacctcgtgtcctgtgcatggtccttccacagaaccctccagatcccatccttgcccaggacctctgtggggatggcagcgtgattgacgtcctccacaaactccaccagggcggcctgggccttcttatccatcaagcccttcatgtgttgcagcccgaacgtgcccaggggcaggagggtcgactgcaggacggcttcaacatccacctgctccaggccctccaggatcccggtgaccagcagggccctgtgcgcgtccatgtccaggcccctggcactagcagaaagaacctggtggcaaagttccagaggttagcggagcctagcatggaggcggtggtcaaggtgaagccccacgacaaggatgccaaaatgaaataccaggagtgcaacaagatcgtgaagcagaaggcctttgagcgggccatcgcaggcgacgagcacaagcgctccgtggtggactcgctggacatcgagagcatgaccatcgagggtgagtacagcggacccaagcttgaggacgacaaagtgacaatcaccttcatgaaggggctcatgcagtggtacaaggaccagaagaaactgcaccagaaatgcgcctaccaggatttcagacaaaaatcaggaatcatcaccagccaagactgtgttcagaccacgtgacgtcttccaggcaccaggaagaaatacgaccaacctccgtaacaaatgagagaaacttcacctgactgtgttttgtgcatttggtttatgagtcgttttaaaaacgtgtacttttactgctgcgttcaggttttcagccatagaatattctagaaaaaaatagtgataacatttatttcaccgctataaccctgaatgtgtagctgtgttttttaaaaaaacatttttttacaattgtagaatatgtaacatgcctccagaaacgtgccctaaacacaaatatataatttggcaaataattacatagcaagtcctatgttactgtcatctgatctagaaatcatcgtcctcccagaagcccctcatgtgctctggccatctcaaatccctccctgccccagggataaataacatcctgttttgtgataaactctgccttttctatacacgtgtatgcttattaacaaactatgaatttctccacacggtagatttgattatgtttgaatcttacatgaatgtaatcctattggtggattgtttttgctgtatgtgtgtgtgtttcagaaaaaatacattaagaaaagaaaagga

SEQ ID NO: 462614 - DNA, 1635 bp, Homo sapiens
gaattatgtgcttcaaacaggttgaaagtgataccttctgcagccgtcatttccagggctgagactataaatgctacagtttccgcttttgcttcttcctcattttctcttgccaccactaagtaagaagagccttttgcctcccaccatgattctgaggccttaccagccatgtggaactgttaaagaatttgacaccaattttacatatgtgcaacagtcagaattctacttggagccaaacattaagtacgtatttcaagtgagatgtcaagaaacaggcaaaaggtactggcagccttggagttcaccgttttttcataaaacacctgaaacagttccccaggtcacatcaaaagcattccaacatgacacatggaattctgggctaacagttgcttccatctctacagggcaccttacttctgacaacagaggagacattggacttttattgggaatgatcgtctttgctgttatgttgtcaattctttctttgattgggatatttaacagatcattccgaactgggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtc

SEQ ID NO: 462615 - DNA, 1532 bp, Homo sapiens
gaattatgtgcttcaaacaggttgaaagtgataccttctgcagccgtcatttccagggctgagactataaatgctacagtttccgcttttgcttcttcctcattttctcttgccaccactaagtaagaagagccttttgcctcccaccatgattctgaggccttaccagccatgtggaactgttaaagaatttgacaccaattttacatatgtgcaacagtcagaattctacttggagccaaacattaagtacgtatttcaagtgagatgtcaagaaacaggcaaaaggtactggcagccttggagttcaccgttttttcataaaacacctgaaacagttccccaggtcacatcaaaagcattccaacatgacacatggaattctgggctaacagttgcttccatctctacagggcaccttacttctggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtc

SEQ ID NO: 462616 - DNA, 1442 bp, Homo sapiens
gaattatgtgcttcaaacaggttgaaagtgataccttctgcagccgtcatttccagggctgagactataaatgctacagtttccgcttttgcttcttcctcattttctcttgccaccactaagtaagaagagccttttgcctcccaccatgattctgaggccttaccagccatgtggaactgttaaagaatttgacaccaattttacatatgtgcaacagtcagaattctacttggagccaaacattaagtacgtatttcaagtgagatgtcaagaaacaggcaaaaggtactggcagccttggagttcaccgttttttcataaaacacctgaaacaggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtc

SEQ ID NO: 462617 - DNA, 1153 bp, Homo sapiens
ggctcagaagataaacgaggggctggaacacctcgccaaagcagagaaatagagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatcactcattgtatccattacctgtgaagcatatctttttctttccataagagcttttctaagacaccagcaggaattaacagaaaatgtactgtcatgttttaatacattgattaaaaaatttgcaagccaaattatacataaattatgttctaaacaaaaggggtaataagcataggtattctctcttggacacttgtcacgatttagtggtcatattgataaattcataattcagtaggctttatattgataaatttaatggaccaa

SEQ ID NO: 462618 - DNA, 1679 bp, Homo sapiens
ggactcggcgcagtgctgcggggcgagggcttctctacttgggcgctctgctcctgaagattgtggtgggggctgtctgtgcatcggaggctcgttagcagcatccttggcctctacctgctgggtgccggtcgcatctcttccccatttgtggcaacccaaaatgtcatctggggaacaacatcgctctgttgagaaccaccgccctagaagagccccctgtgtggaggggaccataggtttaccccaaaaactcctcggtgaacctttgtcatctggcattttactgtccctgtgggcagggactgtgcttcgttcgtcctttgatgttttccttattgattctttggagaaaaaggtcaaaaggactaacagcctgaaaactggttttttaaaatggaagccagattatgacagtgccgcttctgaatatggaaaagcagctgttgcttttaaaaatgccaaacagtttgagcaagcaaaagatgcctgcctgagggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatcactcattgtatccattacctgtgaagcatatctttttctttccataagagcttttctaagacaccagcaggaattaacagaaaatgtactgtcatgttttaatacattgattaaaaaatttgcaagccaaattatacataaattatgttctaaacaaaaggggtaataagcataggtattctctcttggacacttgtcacgatttagtggtcatattgataaattcataattcagtaggctttatattgataaatttaatggaccaa

SEQ ID NO: 462619 - DNA, 927 bp, Homo sapiens
cgccgggtccgtctctcactggcgcggccttagcacccggggggggcgggagggagggctcagggctgaggggcctcggcgcgctggtgcccgcagggctgccggggctcggtgtcctctgggtcacacctcccggggtcggggtcagctctgcggcgcctcgggaagcgccgtgggtccaccccgccggaagtcaaaaaaaaagaacccgtgtgggcggggactcggcgcagtgctgcggggcgagggcttctctacttgggcgctctgctcctgaagattgtggtgggggctgtctgtgcatcggaggctcgttagcagcatccttggcctctacctgctgggtgccggtcgcatctcttccccatttgtggcaacccaaaatgtcatctggggaacaacatcgctctgttgagaaccaccgccctagaagagccccctgtgtggaggggaccataggtttaccccaaaaactcctcggtgaacctttgtcatctggcattttactgtccctgtgggcagggactgtgcttcgttcgtcctttgatgtgtatgtcctgccacctctggtacagtacgtagtaggcaccctgcaaatgtttgtgggactgaactgataatccttaattcatccttttggcagcctcttccccccgtttcattactccagtgcatttttatctggcagttacagttaatagaaagtcagcattgtgggccgggcgcggtggctcacgtctgcaatcccagcactttgggaggccgaggcgggcggatcacaaggtcagaagatccagaccatcctggctaacacggtgaaaaccgtctctactaaaaatacaaaaaattagccgggcgtggtggcgggcgcctgtagtcccagctactcgggagcctgaggcaggagaatggcctgaacccggaagg

SEQ ID NO: 462620 - DNA, 1481 bp, Homo sapiens
ttctagaggagtccctatcacaatgtcgtcaacttttagtgactgcacagtttatcattggtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtatgacagtgccgcttctgaatatggaaaagcagctgttgcttttaaaaatgccaaacagtttgagcaagcaaaagatgcctgcctgagggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatcactcattgtatccattacctgtgaagcatatctttttctttccataagagcttttctaagacaccagcaggaattaacagaaaatgtactgtcatgttttaatacattgattaaaaaatttgcaagccaaattatacataaattatgttctaaacaaaaggggtaataagcataggtattctctcttggacacttgtcacgatttagtggtcatattgataaattcataattcagtaggctttatattgataaatttaatggaccaa

SEQ ID NO: 462621 - DNA, 1353 bp, Homo sapiens
ttttctaaggtggtaggtgtgaaataaagataatacaaatctaatttttccaggaactatagcactgcccgtccccatgaaattaaattataatttcactgttcaacataatataaaactgttttgagtaacagtgaaatagaagcatgaatttagatacacaccagccctatatgatggacttattcacacatagtatttttgataacaacctaattagatactgtctttcattgcttactataattctgagaaaccacttttaacagtatacatttacactaccacttaactaaatggggacatataaatatataaatttttaaagaaaaaaattccagttatttagaggagaaataaaacttcaattatttacttttttgaaactgcatttagataaaaaggtatatggtttatgatacttttcacaatgtaataaatttatattccaattttctcataaacgagaggttgtaaagcaaaatatttgttccttgaaaataacctctctcttctaaccctggtaagaacaatgagtgtgcccttaatttcaagactcttgttgtcatccatgtcaattgtctttttcatgaagtataatattttgagagagagagagagttgtaaaaattaaagagaaaacctgcttttggaatgcagcaattctaaatcatttcactaagaagcatcctttgatatgctggtctgaatttttaatataaaacctaagcagtacttatttctgaagtagaactttctccagttttaataacttcatacatagcaagactaaggacatcaacctgtgcttttgagattttggtaggtgttctaataatgtattattttagatatggctcattgtcaaattgggtggacagagatttcatgaattggttacagaaagctaactaaactcttaatgactgaataatggtttgcattttgcttgagccaaaaaagatgtttaagccatgtaccactacattccctgcttaacattcctaagtttctttattcttcatagttttctaatgaacatatattttcctgagtaagattataaaaaagttaacctttcttccaaaagtataaagacaaataaaatgtcgactcacaatacatattttttgcatagcattaaaggtgcggagatattgcctgctcctcttcattatgattggcccacctcttaaaaagactgcaacaggccgggcgcggtggctcacacctgtaatcccagccgttttatttatttatttttgagacggagttttgctctcattgcccaggctggagtgcaatggtgcgatcctggctcaccacaacctccatctcctgggttcaagcatt

SEQ ID NO: 462622 - DNA, 2113 bp, Homo sapiens
ggctggccaaggccagagccggctccctcagcttgcagggaggtatggagggagaggcgcgagtacgaaccggggctgcgcgcggcacttgcgggccagctagagttccaggtgggcgtaggcttggcaggccccgcactcggagcagccggccggccctgccagccccgggcaatgaggggcttagcacccgggccagcggctgctcgggaaggtgtactcggtcccccagcagtgccagcccaccggcgctgcgctcgatttctcgccgggccttagctgccttcccgcggggcagggcccaggacctgcagcccgccatgcctgagcccccggcctccgtaggttcctgtgcagcccgagcctccccgatgagcgccgccccctgctccagggcgcccagtcccatcgaccacccaagggctgaggagtgcgagcgcacggcgcgggactggcaggcagctccacctgcagccccggtgcgggatccactgggtgaagccagctgggcttctgagtctggtggggacgtggagaacctttgtgtctagctcaaggattgtgaacgcaccaatcagcgccctgtcaaaacagaccacttggctctaccaatcagcaggacataggtagggccagataagagaataaaagcaggctgcccgagccagcagtggcaacccgctcaggcccccttccacattgtggaagctttgttctttcactctttgcaataaatcttgctgctgctcactctttaggttcacactgcttttatgagctgtaacactcaccgcgaaagtctgcagcttcactcctgagccagcgagaccacgaacccaccagaaggaagaaactccgaacacatctgaacatcagaaagaacaaactccagacgcgccaccttaagagctgtaacactcaccgcgagggtccgcggcttcattcttgaagtcagtgagaccaagaacccaccaattccggacacaccattgtctgacattaaaggtgcggagatattgcctgctcctcttcattatgattggcccacctcttaaaaagactgcaacaggccgggcgcggtggctcacacctgtaatcccagcactttgggaggccgaggcgggcggatcacgaggtcaggagatcgagaccatcctgcgtaacacggtgaaaccccgtctctactgaaaaatacaaaaaattagccgggcgcggtggcaggcgcctgtagtcccagctactcgggaggctgaggcaggagaatggcctgaacccgggaggcagagcttgcagggagccgagatcgcgccactgcactccagcctgggcaacagagactccgtctcaaaaaaaaaaaaaaaatactgcaacagatgattcaattgtctaaaatacttcgaagtacagaaattaaatgctttagcccataaacatatcccttatctactgtgttgctaaggaacatatcagccatatctatcatgcacacttcagcagtctcttggcaaccagtgggaagatggtagacaactttttccagttgggaaagtacatttccatttaaatgttcctgtgacatgcttttccacccattgtcttgctctagattttcaactttcaatgaagtctgactgtgatacttttttgtatacattttcctgtgatgggcatacatcttggacaagcttttgcctactgaagcctctatttttccattcactgtggaagttaatacatgaaagttattattgcactctagtacttctgtgtctgacagttgtcctttggacaaaaacttttctgccaaatttctgtcattcagttttgtagtgattggctgagatgaaccttcctaaagaaacagtaatgaacttgcgtaaaagttaagctgcttctggttttcaaaccactgcagaattttctcagtcttctgaataatggcagcaacagcatcttttattaagcagtacccattatgaaaaaatccgaagactccatcctttatagcttcttttgttaagcttcttccataatgttggtttgtgtctcatagctatgggaatgaacaagataaaccctcatgccaagcaccaagaacccaatctcttccatt

SEQ ID NO: 462623 - DNA, 1178 bp, Homo sapiens
gtgattatgccactggttgatgggcagaaacgcccacctgctgctggctgcccaggggtcactccttgactatggtagcaagactgaaggatacccaacttacatttctacagtggaacacagaattatgtcattctccataggtgaagctgaccttagagaacactcaaaagtattgtgcaaatatgaaaaactaaggctgattcatcaaaagcaatccagtcaacatccaaaaactcctgattcatccgagggcactcttagcacacttccagttggctgcatggagtcacagatccacattccagctaccagggagcagacagagggactatccagctctctgtggcctcctcagaaagagatgagagactcaagaccccaggacatgaaatcacttacctggaatggcatggtcaataaaggcagattatggcagtggcaatgtattaagaggagtatcaatgggaattgaagatccaagcaagttaaatatgtgggtggagggatacaaaaacgttgaatgagattctaacattttaggctatttacaacagcacagtgagtcaggggagggtccagtggaaagcgactggagacacatccggcagacaggcagaaatgtcagtttcacctcaaagttgtggcagaagtagtctgagccaagaagcacaggcattcctggggtcagcagatcagggcagaaaggtaagctgggaacaaagtgacattgaccttgaacattaggcaagggcttatcttcgaggctgatgcttcccagtcagtgcttcccagccttcctcattaccatggcacatacagaaagcaaatatgtgtgcatctcactgggcagtgactgagtgggctacctcccaggcctgttcctgcagtgccccttggttcttcatgagactattcagggtgtttttctgggcaagtaactccaaaggcaagcatgagagcagctcgaagacttaagaacatgtcacagggagaacaagaatgccatatgagtaaaaaggcagaggcaggagtgatgcacctacaaagccaaggaacagaaaagagagccagaaaaccaccaggagccaggacagaggcatgaaacagattctccctcacagccctccaaaggaaccaagtctgccaataccttgatcttggacttctagtctccc

SEQ ID NO: 462624 - DNA, 5764 bp, Homo sapiens
gacctctgactcctagttccccgccgaagccacctctttgcagctttgtgcccggggtcctccttgcacacctgggttttcctcgggccgccctccggcttctgtcctctgagcctggcccaggattccttgcccctcccccaccggtccaccctggctgtttatggggtgggcagaggctgggaatgagaggcgccctctctggggggcctggcagcccccagggaccctcctactggggcctgccacggtggggggacaatgtttcccattttctgcggagccccccaactctcacctccaggcagagtccaacaccccctccccacccagaggtccacgaggcgagacagacccaaagagagaggcaaggacgtgggcgttggtcggtcttgcggggaggaggtgccgtgctctccccacttcctgacccagcagaaagcgcccgggcgtgtccagataaaccgcgccttaatcgaggcgccattccggcccggaacaggccaggcccagggtgcagagtggacactcccaggtgtccaagccggcgagctcgggtcccgcagaaccggcggccctggagacgccccgagggcagccccgctgcagccttgctcgggtcccctagcccggcgcctccgcaaaccaacccaccgcgggccgccgagccccgctccgggatccgccggctgcctccatcccagaagagtgcgcagagaattaaatctagatatttacatgtttaatggctaaaggagcctgtcttctggcagggcagggagggcgctcaggtggtttaactcagcgccgggatcccgctcagctgcgggggccgcgaaccccgccgctgggccgacgattgggcccctccggagcgcggcgcccaacgcgggtttcgttgcgtcggggaagtccgtggcctgcagcgtccagtccccaggctgtcagccgagccctggagtggggcgttctccaggcccccaacccctgatccaggccgttcccctcccgcgcaccctccggcgggggctgcagcccgcgcccctcgccgccaagccccattttcccacagtgcaaactgcagcaaacgaactggttttctcctgagcgcacgctgcggggagacgattccaacggcgtccagtgaggaggggcccaggcctgcgagacggggcgcgttcctgtccccagacccctccggctgcgcctcaacccccagcccggctctctgacctgcatcggtcgggccgggcacagaggaggcaaagcaggcggaggccgcgagaggagagcagcctgacctcccgcctgagcccggacccttcccctcgggcaccctcggacgcccccgccccagcgtgttactttctagatggggaaactgaggcgcggccagggcgatgcggcggaagtcccgcgcccggccgtctcccgcgcctgccagacagagccccgagaagagggcatagaattccctcctctaattgtgtcccagaactctgggacgacggaggccaagctgctgagggaggggacgaggacgcggggccccagggaccaacccctccgctccccggccagccgcggccgcccagcctcggtgccccggcgcaaacaagcgcggtgtttgccgagcgcgaggcgggcggcgcggcccgagagcgatgaggattcgatggagccgctcgccgcggcgggggcaacggagcccgggcgggcgcggggatcgatcgggcacagctgtcgcctaagagcccgcgggagcatccacccgcgggccagagctgcccgggcgccccgcaactgcgggcaggaaatccgggacgtcgggcccgccaggggcgaaaccccaaagtcgcgacacccggggtggggaggtcaggacgtccccacggccaacgtggaaccttcgggagccgcgcgctcagcctcgccgggacccccgccaggccgtaaaagcccagagtctccccccaaatctaaataaaatccccagaccccgcccgaacgaaggcggctggagtccagagggagaactcctgccacacactaggcaccggcggccgggatttggggcgcccgcaggtttcgggggccgggagtgggagcagagcggatctagggctgcggctgggcttgggtggggcgcgcattcattgccatcgtttagtaaaacctcgctttaataaaagcagggaggggtgcgcagagcccggacactttcatttcggtgggagacaaatcgaatcagaaagtcagttgggggcgcactgtgcagggttctgggggagccccaggaaaggaaaacttgaggtatctgactctgcctttgatatttttagctgcaatgggagagtcaataacaacagggaaggtggtgtgtccaaaaatgggggagagacgcgaaatcggagactctgggtcgaggcccccagccccacctgggcagagtctgtcctcggacccccgcccgctgtcccccgggtacggcctgccccagcgggcgcgggcgggcgcagtggccagggacgccgaagccccaagtctggccgacttcggcctgcttggtgctcgagtggggccggggcgggcggagagcgaggctgcgggaggcagcggtggcaggagcgggtgggcgggggcgctgacgtcagacccgggcccgggcgccggcggccgctcccctgccacatcctggtggccgcgctcgcagccgggccgggccgtgcgccgcgcagcctggcagcctcgcgcgcagccaccggggagcgggcgggacatggagctgagcctggagagcctggggggcctgcacagcgtggcccacgcgcaggcgggcgagctgctgagcccgggccacgcgcgctcggcggcggcgcagcaccgcggcctggtggcgcccgggcgcccgggcctggtggccggcatggcgagcctgctggacggcggcggcggcggcggcggtgggggcgccgggggcgcgggcggcgcgggcagcgcgggcggcggcgcggacttccgcggggaactggcgggcccgctgcacccggcaatgggcatggcctgcgaggcgccgggcctgggcggcacctacacgacgctcacgcccctgcagcacctgccgccgctcgcggccgtggccgacaagttccaccagcacgcggcggccgcggccgtggccggggcgcacggcggccatccccacgcgcacccgcacccggcggccgcgccgcccccgccacccccgccgcagcgtctggcggccagcgtgagcggcagcttcaccctcatgcgcgacgagcgggcggcgctcgcctccgtgggccacctctacggaccctacggcaaggagctgcccgccatggggtcgccgctgtcgccgctgcccaacgcgctgccgcccgcgctgcacggcgccccgcagcccccgccgccgccaccacccccgccgctggccgcctacggcccgccaggccacctggctggggacaagctgctgccgcccgccgccttcgagccgcacgccgcgctgctgggacgcgcggaggacgcactggcccgcgggctgcccggaggcggcggcggcacaggcagcggcggagcgggcagcgggagcgccgcggggctgctggcgccgctgggcgggctggcggcggccggggcgcacgggccgcacgggggaggcggcggccccggcgggagcggcggcggccccagcgcgggcgcagcggccgaggagatcaacaccaaggaggtggcgcagcgcatcacggcggagctgaagcgctacagcatcccgcaggcaatcttcgcgcagcggatcctgtgtcgctctcagggcacgctctccgacctgctgcgcaaccccaagccgtggagcaagctcaaatccggccgcgagaccttccgcaggatgtggaagtggctgcaggagccagagttccagcgcatgtcggcgctgcgcttggcagcggggcggcggccgatgcccggggccagcgccccaagccccgcccgtgcgccccggcagcccgggaccccctatcaggaagctagaccgcgatccgcgccgctgcccgtttgtaccgttgccaaaagggagaaagggattgtgccgcctccccgccccccggtcgccgcttctgcccctttcgggagcgccgcgcgcttctttgtagttcggccccgcgatcgataccccctccctctcccctccggccgctggcaaaggtcacccgagaatggcgggggaggggcggccccggggaccctcggcccgcgccgcccggaggccttcacaccccgacccggcgcccgccccgcgcagtttggtcgtggctcgggtgcgcgcgcccctgcccgcctggctttgggggacaatagccgcggcggctggcgcctgatcgatcgcttctccgagcacaagggcgagaaaggcgggggctctgggaggcgccccactagcaaagaggcagaggggcttgcggctgtgcccccaggcagcccgtccaggcaggggggctgggcgaagagaggacagcgggggaggtccgggaacctggacgatttcagtctgtcctgctcccctccccatgacacatacagcggcactcgtgcgctcaccatagaccggcggtcatatccgcacacagccacggccctcgaggtgcagtgcgaggcctcagatttgggggccacagaaaacatcagccagagcgtcacagaagggcaaaccgcaggcgagaagtcccatggggggggggtgggctccccgcagccgggtcagcagcacccagcacccgccctgagtggacaccgcctgcttcgcctgcacctgaccctgcacccaggggtgcgtgggggaaccggaggggtgagcgcagctcctggcaccccgagcctcccgcagggcgctggggcgttgaggatgataaacccggaccacgctgcccgcctgctctctgccgggtccgctgcccacgccgtggccccgccgcgcggccccgcggccgcggggttcacgccgtcaaccttgcgcacctgtcgcgtctcaggtgccctgggggccgcgtctacaccaccggactccgcctggggcgcctttagttccggtcgctgcgcaaatgaaaagcggttaagtggcggcaaatcgcggcggttagggggagacggccggatgcgtccccatctccacctaacacggcgacgccccaacgctggtgctcggaaagggaactctgcccccgccccgcccccgcaccatttcaaccccgcagcagaggactcgccgccctttctactccggcatccccattccccgctccgcgagcaccgcgggcctccccaggcctcctccaaggagaactttgcgccccgggtctcccgtcgcgcttgcccggctcggggcgggccacgcgtttccgcaggggtggtgaggcctgcgctgcgcttccccctgtgccccagctcctccaagtatgatgatgttgtgggcattttccatcacccagcaaacgccgtcccgcagcacccgggaagctgcggagtcgggctggggccgccgcgttgcgcacatcggtccttggcgggtgtgtggatcccagagcgcgcccggcccccaacagcctgacaggacctggacgcacgtgccccggcgccaggagacccgggacccgggaccacgcgcccgcggccttggagcctcagggtcactggtgcgggctccgcaggaaagcgcagcccccagcaggcacccaccatccca

SEQ ID NO: 462625 - DNA, 1126 bp, Homo sapiens
gccccttctgaccagggttatgtttacttcctcacagccacttttacttctagagttgtagccccaagaaggatgtcaaataagggaacgaaacaccctccagagagatacctccaaagctcacctatagaggtcaacctctgccagtcctttgggatgaggtcatgaatgcctttctgcagtggaaagctttgccttctgcagttcgtgagtcagttgtgacatggacagcatatagtccttcaacctcagcctgctcactggtgggatatggacctattcgagtctgctgcctcagatatatgggctatcattatcctaagtgcctgcacacctacccacccctgacctgcctgccctgctcaggattaactcagtctggaaagcttcgcttggcttttgctttgttttcttccattttcaacgagcatgtcgtcatttgctctcatatcatttctttcaatccccacggtcccacccactaccagatgggtagaatctcaagtcccgggctggtaacccatggttccctcctcaccactgaaagttacaacaaagacacaaggaacagttaaagaagctctacataatcacctccctcaaacccctaaagagtatgctaaattccaagtcatcactagccagcctagagaaggaggaaagccaactgttaactggagctaaatagctagatttccaaaaagtctttggccaattgtgtctgtctttcctctctcattttcccccatgggcaaaatgagaataatactttacctgcctagtccatataactaagatttgagaagcgctttgagatccacagatgggcaaaagctaacacttcagagccctcctatgggctaggtcttcactggcattcctcatacctaccttgtaaattagatgtcatctccagttttcaaatgaggaaatcccattcccaagaccccaagaatttgacccaagtcacacaattggtaaactgagctgggaatctaatctagaatcttgtaactccaaaggctaatagctgaaataatttaatttccccctaaaagtggcatatgtacttttataaatttatttattcaataaaataattcttaagcacctactatgtgccaaa

SEQ ID NO: 462626 - DNA, 783 bp, Homo sapiens
gggtgcattgaatcctttacgcttgggactctgagggaaaagtccattaggggtctctggaccgcgacgcatgccaggttccttccgtatcttcctccaggtcccccctctatcctccacggccccatccaagccagggatgaaatttaacggcaagaagggcgcagttgacgcggcgtcaatgaactgagactaagtcaaaagccgggtaaagctaggtcttcgacgtgaagccccgcccactgtgcccataggcccctcccctgggacggtgatgaaagacctgcccactccgctcgaaggcccccgccccctgggtctagtttcagaacaagactttttttgtacagccccgcccattccaggactgcagggtctggtggggaaggtcccgcccactctgcgcataggccccgccggctccgcgcttaagacggccgctgagttagttgtggagactccgcccactctgctgaaagactccaaccctgggtttagatagcgaagggactgcctctggcttgaatttgcatagccccgctcactgtgctcttaggctccgcctccccgctaagcctgcccccgccttagcatcccatacttgcagaccttgctcctaaacagtgtgatccctcattttaggccctccaaccctatccccatcagcctggtcatcaccggcgtcacccccgccccgcgccctgcccctaggttcctgtgccagcaagatgctggagcgaggcgcggagtccgcggccggggctaccgatcctagtcccactg

SEQ ID NO: 462627 - DNA, 1932 bp, Homo sapiens
agtgagaataggacatcccactctcatctggaggatctatgtcacttttcagccaccgtaggccccgccaccggcggtgcactttctgtcgatacggtagcttcgcgcttgctcacgaacttgcctgcctggctggcgcacccagcccctccttccattccttcttccccctctctgcagcctctgccagcccgcactgcgcatgctttctgacgccccctttggtccagcgtgggaggaggggatggaaatgaggttgggctaagcagcttgcgcgcgctcccttgcctgccctcccccgacgccggacgcgcgccgggcggggcagctccgctggtccgagggcagtgcagcagcggcgacagcggctgcggccgtggccgtggcgggaggagccggaagccccgcccccggggaggggccgtcctgcaggtcccccctctatcctccacggccccatccaagccagggatgaaatttaacggcaagaagggcgcagttgacgcggcgtcaatgaactgagactaagtcaaaagccgggccctccaaccctatccccatcagcctggtcatcaccggcgtcacccccgccccgcgccctgcccctaggttcctgtgccagcaagatgctggagcgaggcgcggagtccgcggccggggctaccgatcctagtcccactggcaaggaaccagtgaccaaagaagctccccaccagggcccaccgcagaagcccagccagtcagctccagggcccaccgcgtccgcgggctcgcctccccggcctcgccggcggcccccgccccagcgcccgcaccgctgccccgactgtgacaaggccttctcgtacccgtccaagctggccacgcaccgcttagcacacggaggcgcccgaccccacccatgcccagactgccccaaggccttctcctacccctccaagctggcagcccaccgcctcacgcacagcggcgcccgcccgcacccgtgcccacactgcccgaagtcctttggccaccgctccaagctggcggctcacctctggacccacgcacccacccgcccctacccgtgccccgactgccccaagtccttctgctacccttccaagctggcggcccaccgccacacgcaccacgccaccgacgcccgcccctatccttgcccgcattgccccaaggctttctcatttccctccaagctggccgcccatcgcctatgtcacgaccccccaaccgcgcccggcagccaggcgactgcctggcaccgatgctccagctgcggccaggcctttggccagagacgcttactgctccttcatcaacgcagccaccaccaggtggagcacaagggggagagagactgagccctcccttggctcactgtccccttctgccgccagccctagccagtaagaggtgggatttctaagaccgactgtatgagctcgcctcttccagatagctggcagagggcagggcaagggattggccatttatactgggctcgagctcagaagcccgaggaactctttgctcccctgctttggggagatctcaaaccatggacgtggagctgtggtttgacagcgctggctctgcttctccccacacacttacatggcaaaggtaaaaagtctgctactatcgtgggttgatgaggattgtgggcaaacaggctctcttgttaaaagtttaaactggtgtctccactttggccatatgacggtatctaagaaattgaaaatacatacatgcttgtctcaactcttccacttgtaggaatttattctataaactcatgaatgtgaaaaaaaagcatagtgttaagggtgttcactgcagtgcgactgttgtggccaaagactggaagcaactcaagtgcccaagaacaggggaccgactattgaattacagccatggaatggaataggt

SEQ ID NO: 462628 - DNA, 1382 bp, Homo sapiens
cgaagcagccaggaattctgattagtctgctgggtatgtagaaggtgcatggtctgggtgttaagagatgagcctggtcagtcagagttgagtttaaaccaggatctggaggttgctggctgtgaacctggagcatccttttggtgccagaaagtaaagaaatgctttaaaaaggggacagggggatatagaaaggacacaggagacagcctgaaagagctcctaatggccaagattgaagaatttgaacaaaaatatgaaatgaagcttctggatcctcacacagctctgctgaagaaagtggctgtatctgcagcctttcttttctcacaagcctcttccttccacttggcaatacaaacgcaaaccggccccatccccaaggcagacagtgcactgtcccaggacacaacacctctagtgggcagaaagaagaaactgtctaagagattggtgctgacttcgagaaaacaatttttttcaataattagaattacttcaatgactgattaacaaattgttagccactgaggcctccttttaccatcctctgtcacccctcaaatcaaataggttttatttctctgctgttgcctggcaacggagatgtggcaagagatgtcagaggttaaggagcagactaaagtcattatggaaagcaagctcttatcagcattttccatctaactttgtaatctttgaaataaaatagttttcattgtatcaaatgtctgtaatttttttcttatcaaatgccaagtatttagagacatttttttctttctgaatataagtccactacacatggagaattataattatgtgcattgctttgaaattttgaaatgggcttctctattacactagcatactttgaaggttaaagtgaaaaactggcattctgaagccatgtactatgccaaaagtagttgtgaacacatttgaaagcattccaagaagtatcagaaacaaatattggctctaaataatatcctcactttgaaccattagttaatgttgaattaaattctattttcaaatacattggcctgcctattagaaaattattctttagagaaaggaacccaaaatgttctataggttctcttgtctctattttgaaatggaaaggaatgtgaccaagatttaagcatcatctttagagtttatttttttcagcctattctgtaccaaatgcaaggctcctaaggatttgttgctcataggtgattaattgtactcagcgtgacacagtttaagacttctccagtggggatagcacaataggctttcatggcatttcatttctaggcagtgggttggtttcatgagtcctaacccaaattttaaacgtttacaaattactgctataaaggttaagc

SEQ ID NO: 462629 - DNA, 307 bp, Homo sapiens
cagagagcgagaggggctgcagggacaccgagatggccgatgagattgactggctggacctgcccggccggtgggcctacggagttgacggcggtgggagaatcttcttcatcaatgatgaggaaaagtcaaccagctgggtgcaccctggaacaaagtcacccatccagagtggacacacctcctgcccaggtttgcccaagggctgggaagtggattccacccaggaaggagctgtgtatttcatcaaccacaatgaaagacggaacacatttctacacccaaagactgcccaggtcccagagga

SEQ ID NO: 462630 - DNA, 647 bp, Homo sapiens
cagagagcgagaggggctgcagggacaccgagatggccgatgagattgactggctggacctgcccggccggtgggcctacggagttgacggcggtgggagaatcttcttcatcaatgatgaggaaaagtcaaccagctgggtgcaccctggaacaaagtcacccatccagagtggacacacctcctgcccaggtttgcccaagggctgggaagtggattccacccaggaaggagctgtgtatttcatcaaacacacaggcagaggttcagaggcaggagacgcagccgcggggcaggatgtggaggcagtgggaagggaaggtgtccgtggggtgtacgaaggaggacatcatactggtggtggcaaggccagctccggaggggttacgtttccaatcccccaccgccaagatctgccagcacttagatctgccaccatctaccacctacatcagcttagccgctaacctattttttcttttttttaagataggactgaatttttcctgtttggacccaaatgcttcttgcttcagttaagaattgtgaattgtttcttcttttctccctcttgcagataccatcttcatattccttttggtacatggctctagagattgttcactaaacactttcacatgtattac

SEQ ID NO: 462631 - DNA, 2341 bp, Homo sapiens
tatatgacaggtgacctgctctccactggggcagcctcaactttcttgtaatgtttcttctgccctttgcaggtcctcctgatgccacgtccacccatctacctgaaaacaaaacaggcacagagcacctcctgcttgcttgtgtggtcgcagggccccggcgagtcacccaatgctgcagaatctcagcctcacactataggtcgtggcagccccaaatgtggctccaccccaaagattgggctctcagcctccggtccagtcccagaggcaagccgagtgggtcttccctctccctccaaagacaaggcaactggtgtccgagtcatactctgaggataaacctatttcctaagcaaaagcctctccatcatggaaaagcatccaccagccacggtcctccccaggctacctgtggggcccaggaaggcctgcatgaagtcgggagcggagcttgttgggcgcctggtatttatcaactcctgtgctccagcctgggcgacagagtgagactctgtctcaaaaataaataagtaaaaaagtaaataacctgatcctctggagaagggaacacaaggggaatggagggtttgttgaaattaaagcgcacggcgagaaaggatgggtcactagcatcctccttttccctgcgcgggtgtccccggaagcaccccctccctcgccaagcccagcttctgcacaggctccaggagacgttgctccggggtcctgccggggacaccgggctgcgtccccgtcggccgccgcgcagatgcgcacttggagcagactcgggttccggggctgggggaaagagaaacccgggctccaaaccctcctggaagtctcttgagggcgcgagctccgcagaggcaggagcctccgcgcacgtgcacgcccgaaactgctaaagcccacgcgcgagcttgaccgccgcgtggaggcgccggctgcggggagagaagccgccccggccccggccccttcctgcggcgccctccggccctggccccggccccagccgtgcgcgggcggccgctcccccacaagctggcctggctgacccagcgccgccgctgggccttcaaagggcggccgcttcctgtcgccccgggacggctcggccgagccctcctcgtcacggggcgggcgtccccgccgtcacctcctttgcccttagtcgggaggacgcccccctactgcactccccggccgagctgggcagacccccgtcctcccacctgggggctcctccttctgctccctcgcctccctctgctctccggtcccctcccctcgccctcatctctgggaaagttgtttcagccctgaagtgtgcctgagcacgagcaccttctcctcctccctgttccccatacgagtcacaggaatgacccaaggcactggataaaaattcagattcctgcggactctgattccgaaggtctgagtggtggtgttggggtagggagcccgaccagcgctaaagagggcaggctggcagaaagtccagcgagcgtgaggggccaacacagcgctccccgcctcccccggaggccgctatggcatttggggtgcagagcccaaccgagtgcaagaattgtcgcattatgcttctaaatcaaaggtcatctggctttggtgtcctgcaggacaaggtgggaggcaatgtcagccactataaggtagctttgtccctccaactcttcatccgagagactggaacagaggaaggggtctcgtttctagggtacagcagccacctccctttccctggcctctcagctgagcactgcgtcgtcgtgggccctgggggtcccagagcctctccagagttctccaaggacttggccccagaagacccagacgtccccctcaaagtcaagcaggcttacaagaggctaatgggaggcgagctggtctctgtcctggagctgcccctgccctggccatgccctggccgcatttctggatcaatggccactgaccagaggcctgactgtgccactgacctacacatcggctattaaccccaaacttgttggcagaatttgtattaactatttatgacacttcatcacccggttccattgcagtattgtagcctgacttctgagccagtgtttcacactctaagcttatgaaatgcttctccaatcagctaagaaccaatggcccagaactttatcaacttctgataggagtttgcagcccacaaaacccagctcagcacactccctgcagagaaaacatctgcacctgggcttcttggcccagaaaaaggtgatgtagccacttcagagtaaagtgtagccattgttcctcctccccctctgtcatc

SEQ ID NO: 462632 - DNA, 471 bp, Homo sapiens
tatatgacaggtgacctgctctccactggggcagcctcaactttcttgtaatgtttcttctgccctttgcaggtcctcctgatgccacgtccacccatctacctgaaaacaaaacaggcacagagcacctcctgcttgcttgtgtggtcgcagggccccggcgagtcacccaatgctgcagaatctcagcctcacactataggtctgtgatccatccacttccacccacagacgggtttgctggaaagagtaaaagcaaaattaaacaaaagagcattatattctgttcctttcttttaaactcatctgctgggcaaatggagttttacaatctagagctgaatgagagatggcttcagccaaatccgagtttcttttcttttctttctttctttcttaaattctttctctctctctttccttccttccttcctttttttttagatgaagtcttgctctgcttgagatctg

SEQ ID NO: 462633 - DNA, 267 bp, Homo sapiens
tatatgacaggtgacctgctctccactggggcagcctcaactttcttgtaatgtttcttctgccctttgcaggtcctcctgatgccacgtccacccatctacctgaaaacaaaacaggcacagagcacctcctgcttgcttgtgtggtcgcagggccccggcgagtcacccaatgctgcagaatctcagcctcacactataggtctgtgatccatccacttccacccacagacgggtttgctggaaagagtaaaagcaaaattaaac

SEQ ID NO: 462634 - DNA, 1586 bp, Homo sapiens
tgaggcagacaaatccagtctgtagagaagagatgacagcctttgggcaggcagggctgggcagggacccatcctcttggctgcattgtgatgtcttaagaagactgaaggggcaccgtgacgtcatagattgcgggcccacccctccccctgtctgcctgccctccccactggccgggcctcaacctcttctccccacaaccccaaccccagaggaaaagccccctcacctggcgtcccgcaaccatggatgcaagtcgccccaagtcctcggaatcccagtcctccctggaggcccccaggcccggcccaaaccccagtcccaacgtggtgaacaagcccctgcagcgggactcccccggcatggtggccgacaggctgccaccaaagaccggcgcggtggttattgacatgggcacaggcacctgtaaggtaggttttgctgggcaggccagccccacctacaccgtggccaccatcctgggctgccagcccaagaaacccgccacctcggggcagtccgggctgcagacgttcatcggcgaggcagcccgcgtgctcccagagctgacgctggtgcaacccctgcgcagcggcatcgtcgtggactgggatgccgccgagctcatctggcgccacctgctggagcacgacctccgagtggccacccacgaccacccgctgctgttctccgacccacccttcagcccggccaccaaccgcgagaagctagtggaggtggccttcgagtcgctgcgctccccagccatgtacgtggcatcgcagtcggtgctgtctgtctacgcccacggtcgtgtcagcgggctggtggtggacacgggacacggggtcacctacacagtgcccgtcttccagggctacaacctgctccacgccacggagcgtctggacctggcgggcaacaacctgaccgccttcctggcggagatgctgctccaggccggcctgcccctgggacagcaggacctggacctagtggagaacattaagcaccactattgctacgtggcctccgacttccagaaggagcaggcccggccggagcaggagtacaagcggactctgaagctgcccgatgggcgcacggtcaccctgggcaaggagctgttccagtgtccggagctgctgttcaaccccccagaggtcccggggctgtcacccgtcggcctctccaccatggccaagcagagtctccgcaagttgtcactggagatgcgcgcggacttggcccaaaacgtgcttctctgcggtgggtcctcgctcttcaccggcttcgagggtcgcttccgggcagagctgctgcgcgctctgccagccgagacccacgtggtggtggctgcccagcccaccaggaatttctccgtatggatcgggggctccatcctggcctccctgcgcgccttccagtcctgctgggtcctgcgggagcagtacgaggaacagggtccctatatcgtgtaccgcaaatgctactgaccagggcagagctggggagggcgtgggggcagtaaagcctctgctacagccggctctgtcctgtccttcctccagggcctgccccatcc

SEQ ID NO: 462635 - DNA, 1171 bp, Homo sapiens
aggaatgaggccaaggcagggatgtcgcagctcctgccagggcacccacctggctggggaagcctcacaatcatggtggaaggcaaagaggagcaagtcacatcttacatggatggcagcaggcaaagagagagtgaggaagacataaaagtggaaacccctgataaaaccatcagatcttgtgagatgtattcactactaggagaaaagtatgggggaaactgtctccatgattcaattatctcccaccaggtccctcccacaacacgtgggaattatgggagtacaattcaagatgagatttgggtggagacacagagccaaaccatatcatgtttactttcggggacatccgtcatcaccattggaatccagacacacaccatgaaacataaacagactgaggccaacaaaggtgaagacagttgcctaaataacacagcttatttgcagaagagctaacaagcgttgagtcgatactattttagctatattgtgtgactttttgtaccagagaacttacaaaaatcatcagggccagatggcctgcaagatattggatcattaggacataaaaattaggtagaatcaagaacgtcggtgctcacccagtatgaggatcatacgaattggtggttggaaaagcattgaaatgtcactgactttgactgtcagatgtgtggggtcaggcaggcatgtgtttctcggatgctcattgtagctcttgcttatccatttttattaactgatccagtgactcacaaggaagttggcattattgtgtgtggaacagcagcagagcttactaacattctcagctacaaaacaaaaaataacgaaccagagacttcagctcagttcttgtgattggagttgtgtttcctccagagtgacgagcatggtataagacgcctcgccctgcaccccatcacggctctccccagacagccctgacagagggtcctggggactttttcttcttatgtctgtacctcatcagttaattctggctccatacagaatgcaaaaatatctactcgctgctctaggatcccctactgttaatcatagaaagccaattgccgggtatgaacttgcagaaagcacaatctttaggaactgagtgctccttaatgccttttcacagaaggaattatttccctccagttgt

SEQ ID NO: 462636 - DNA, 1153 bp, Homo sapiens
gcgccctcacccgccaccgccgccgcggccgccgccgcacccggacagcgagcggctgaggccgccagggcccaaaggacagcggcccagacaggggctggcggcccggccggccccggctcaccgactcgggcagcatccacctgccccagccaacacccttctctcgccccaggtcctttctcagcctccagctgggctgtccccaagctgagctgaggctcttctcctccgatccccacctctgcccggacatccaccatggggacagccaccaggaggaagccacacctgctgctggtagctgctgtggcccttgtctcctcttcagcttggagttcagccctgggatcccaaaccaccttcgggcctgtctttgaagaccagcccctcagtgtgctattcccagaggagtccacggaggagcaggtgttgctggcatgccgcgcccgggccagccctccagccacctatcggtggaagatgaatggtaccgagatgaagctggagccaggttcccgtcaccagctggtggggggcaacctggtcatcatgaaccccaccaaggcacaggatgccggggtctaccagtgcctggcctccaacccagtgggcaccgttgtcagcagggaggccatcctccgcttcggctttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaagtgagtgtgaagagggaggggaagcagagcacggtctctcgggggcacaggtgaccccaggggtctagcaaagtactgggcacacagtgggtatc

SEQ ID NO: 462637 - DNA, 460 bp, Homo sapiens
agcccctggtctctgcctccagttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtgg

SEQ ID NO: 462638 - DNA, 1181 bp, Homo sapiens
aaccagagccactcaacagcgctggaacccattcggtggggcctggggcccctcatcccaagccaggagggtttctggggaggggtgcagcccctggcagactgacagtgtggcctgggggtttgggggtgccagggaagcaggggccaacctcataggaggagacacgagtgcggttctctttcccccactggggggcctgctgtgtcagcagccaggcgggaggcctgggcggcagagccagtggtacaggggcctgggcagggcggtgtctggcagcagcggcaccatgtccaccatccagtcggagactgactgctacgacatcatcgaggtcttgggcaaggggaccttcggggaggtagccaagggctggcggcggagcacgggcgagatggtggccatcaagatcctcaagaatgacgcctaccgcaaccgcatcatcaagaacgagctgaagctgctgcactgcatgcgaggcctagaccctgaagaggcccacgtcatccgcttccttgagttcttccatgacgccctcaagttctacctggtctttgagctgctggagcaaaaccttttcgagttccagaaggagaacaacttcgcgcccctccccgcccgccacatccgtacagtcaccctgcaggtgctcacagccctggcccggctcaaggagctggctatcatccacgctgatctcaagcctgagaacatcatgctggtggaccagacccgctgccccttcagggtcaaggtgattgacttcggatccgccagcattttcagcgaggtgcgctacgtgaaggagccatacatccagtcgcgcttctaccgggcccctgagatcctgctggggctgcccttctgcgagaaggtggacgtgtggtccctgggctgcgtcatggctgagctgcacctgggctggcctctctaccccggcaacaacgagtacgaccaggtgcgctacatctgcgaaacccagggcctgcccaagccacacctgttgcacgccgcctgcaaggcccaccacttcttcaagcgcaacccccaccctgacgctgccaacccctggcagctcaagtcctcggctgactacctggccgagacgaaggtaagggaaaagttgggggtttgagaccagcctggggaacatagtgagacctcctctttataaaacatgg

SEQ ID NO: 462639 - DNA, 1191 bp, Homo sapiens
ggagggcagtgggtgtgggtgagaatccctgggcagagaagggcgccgccatgctgggcacggctgagtcacgctccagcgacgccttgccccagggtgctggagctggcgccaccctgggtgtggtcactgagctgatgtggggcctcggtgcctggggaactgacttcgaagatgccaagccccctggcctcccgcctggcctaggttctggggtcaccctccaggactgtggtggcccacaccctgagaatgccttggagagcctagaggccctgagccttgggcctgggaatcgtgccctgactttccctacccagtgccaccctctgagggctgcccatcggggcggttgttattgtcgctgcactgggattggggcagaggggcggggggctcctggtcaggcggcgcttggccgggcagcccaggttggcggctggctcgaggcccagcccacggagcttctgctgagagtctgggcccattaggcaaagcgtgccagcctctggccccgcccggtgcccccctcacccctgtgccacggccggctggggttcctggggatgggatttgcttcctgtcacaaatcacattgccagggatttccaaccgaccctgagctctgccaccgaggatgctgcccggggacggggtggcagagaggccccgaagcctgtgcctggcctgaggagcagggcttagctgcttgtgagcagggtccacaccaagtcgtgttcacagtggctaagttccgccccccaggccctcacctcctctggccttgccgcctgtcccctgctgccgcctgtctgcctgccatcctgctgcctggcctccctgggctctgcctcccgtgcctactgagctgaaacacagttggtttgtgtacactggctcagttcagcaggaacaggggtcaagcccccttggagcctgcagcccctgccttccctgggtgggctgatgcttggagcagagatgaggactcagaatcagacctgtgtctggaggagggatgtggtgggtggggttggctgggcccaaatgtgtgctgcaggccctgatccccaactctgcaactggggacccctgcatggccacagctcaggctgggctgtggtgccagcatagataggtgggtgagtgggtggcccttccattaaaagggaagccagctgtgtcctttcc

SEQ ID NO: 462640 - DNA, 588 bp, Homo sapiens
  misc_feature (33)..(33): n is a, c, g, or t
  misc_feature (66)..(66): n is a, c, g, or t
  misc_feature (75)..(75): n is a, c, g, or t
  misc_feature (79)..(79): n is a, c, g, or t
gtggcccttccattaaaagggaagccagctgtntcctttccgggcctggaggcttggcccctcctntcccaagcntggnaggggcactggcccggcccgcacctgcttgtgagcagggtccacaccaagtcgtgttcacagtggctaagttccgccccccaggccctcacctcctctggccttgccgcctgtcccctgctgccgcctgtctgcctgccatcctgctgcctggcctccctgggctctgcctcccgtgcctactgagctgaaacacagttggtttgtgtacactggctcagttcagcaggaacaggggtcaagcccccttggagcctgcagcccctgccttccctgggtgggctgatgcttggagcagagatgaggactcagaatcagacctgtgtctggaggagggatgtggtgggtggggttggctgggcccaaatgtgtgctgcaggccctgatccccaactctgcaactggggacccctgcatggccacagctcaggctgggctgtggtgccagcatagataggtgggtgagtgggtggcccttccattaaaagggaagccagctgtgtcctttcc

SEQ ID NO: 462641 - DNA, 1087 bp, Homo sapiens
  misc_feature (20)..(20): n is a, c, g, or t
gctctccaaggaagttaagnagccagacccttggataaccctaaggaatatcttggatgtcttcacggggcttatgacttattctgaggtttacaaaatagaggcccccagctgagcaaagagagggctgcagcgccgagggaacagctgccggactcaccggagaggcctcctggagcacgccgggaccccctccaccccctggctttggctgcatccatggctagtttgcctgaactatatctgagccactgagagtatttattaagcagagaataattttgagtttcacttttataacttttgtttcaaaagttgttttggataatttaatgaaatgactgtaaaccagaattccccttttcattatttctttgtgtcaatataaaaagagttgatgattttaaaagccagtgagatgtccctgtctgtggatgtcagcgggagggtggggtctgacgcctttctctggtggctgtccaggaagattgccccagcttgcactcccttttggcgggttccagagccttccatttgaaaggagcatctctcaccactctgccccacccagcaccagctcttctggaacccactgacttcctaaacactttcttcctccttcacctcattgaattcaagactttagaaaacagccaaaaactctagaggtgggggtgggttcgatctggaaatccctgctgtaatctttttaagggaatccactggaaattattaatttatgttttaaataaaaccattccttacttaacagaatattaagccactcatttttttaacagaactttcgagatataattaaaatgccataaatttcacccccacacagtgtacaattccaaggtttccaatatagtcacagaagtctctgcaacaattaccacaattttagacatgaagaccatttgttggcagccctacctgcctctatgtgtatgtatataattttaatattggattggatattatagtaatattgtactgttacctatttgtgtttttatattgctgttttattttattcagatgaataataattatctccatatagtcatacatttatataggg

SEQ ID NO: 462642 - DNA, 1164 bp, Homo sapiens
agcccacggttctggagtctgtgaaggtctccagagctccctggataaatcatgaacagaagcatctatgaccgacagttgctctgtgtccttctagcctcgcaggagtttccagctcatgagggcagaggagatgaagagaggccgatcgacgcaaaaattatgaccaaatgtctccatctgatgaagcagctgcattcctatgggggcggtgggctgtgcgcttgcctggtgtcttatgagtctgcatcttgtaaagaagacagcggcgatgtagctggacttgaagccagacaggaggaattagggaactctgtcactgaattacagcacgcagagttgaaaaccatttgtagacaatttcgtgttacagtagccaaagcagaaggcaatttcagtattaatctaactaaggttttgtgtagtttactatcatccaggcagcccgagggctccactggacccagaactctgagttctgatgctgcctatcatttgcttttcctcatgagctcctggaccacctcatatcaccagcaccctctacccaaggtcctggagccaacactggagtaaaagagcacaagagaactccttagaggtggaaggataccctctgaggtcaaatcactgggcttgtggccatgagaccacagactttgcctggcttccagtgactgtccgagatgacctgtggagtgcaccgcctgtacttggacatcactgtcttttcggatccatacccgtcatccttggaatttcccctgtatccaaacctgttcctgatacaggtataaccctaaggaatatcttggatgtcttcacggggcttatgacttattctgaggtttacaaaatagaggcccccagctgagcaaagagagggctgcagcgccgagggaacagctgccggactcaccggagaggcctcctggagcacgccgggaccccctccaccccctggctttggctgcatccatggctagtttgcctgaactatatctgagccactgagagtatttattaagcagagaataattttgagtttcacttttataacttttgtttcaaaagttgttttggataatttaatgaaatgactgtaaaccagaattccccttttcattatttctttgtgtcaatataaaaagagttgatgatttt

SEQ ID NO: 462643 - DNA, 1846 bp, Homo sapiens
agcccacggttctggagtctgtgaaggtctccagagctccctggataaatcatgaacagaagcatctatgaccgacagttgctctgtgtccttctagcctcgcaggagtttccagctcatgagggcagaggagatgaagagaggccgatcgacgcaaaaattatgaccaaatgtctccatctgatgaagcagctgcattcctatgggggcggtgggctgtgcgcttgcctggtgtcttatgagtctgcatcttgtaaagaagacagcggcgatgtagctggacttgaagccagacaggaggaattagggaactctgtcactgaattacagcacgcagagttgaaaaccatttgtagacaatttcgtgttacagtagccaaagcagaaggcaatttcagtattaatctaactaaggttttgtgtagtttactatcatccaggcagcccgagggctccactggacccagaactctgagttctgatgctgcctatcatttgcttttcctcatgagctcctggaccacctcatatcaccagcaccctctacccaaggtcctggagccaacactggagtaaaagagcacaagagaactccttagaggtggaaggataccctctgaggtcaaatcactgggcttgtggccatgagaccacagactttgcctggcttccagtgactgtccgagatgacctgtggagtgcaccgcctgtacttggacatcactgtcttttcggatccatacccgtcatccttggaatttcccctgtatccaaacctgttcctgatacaggtataaccctaaggaatatcttggatgtcttcacggggcttatgacttattctgaggtttacaaaatagaggcccccagctgagcaaagagagggctgcagcgccgagggaacagctgccggactcaccggagaggcctcctggagcacgccgggaccccctccaccccctggctttggctgcatccatggctagtttgcctgaactatatctgagccactgagagtatttattaagcagagaataattttgagtttcacttttataacttttgtttcaaaagttgttttggataatttaatgaaatgactgtaaaccagaattccccttttcattatttctttgtgtcaatataaaaagagttgatgattttaaaagccagtgagatgtccctgtctgtggatgtcagcgggagggtggggtctgacgcctttctctggtggctgtccaggaagattgccccagcttgcactcccttttggcgggttccagagccttccatttgaaaggagcatctctcaccactctgccccacccagcaccagctcttctggaacccactgacttcctaaacactttcttcctccttcacctcattgaattcaagactttagaaaacagccaaaaactctagaggtgggggtgggttcgatctggaaatccctgctgtaatctttttaagggaatccactggaaattattaatttatgttttaaataaaaccattccttacttaacagaatattaagccactcatttttttaacagaactttcgagatataattaaaatgccataaatttcacccccacacagtgtacaattccaaggtttccaatatagtcacagaagtctctgcaacaattaccacaattttagacatgaagaccatttgttggcagccctacctgcctctatgtgtatgtatataattttaatattggattggatattatagtaatattgtactgttacctatttgtgtttttatattgctgttttattttattcagatgaataataattatctccatatagtcatacatttatataggg

SEQ ID NO: 462644 - DNA, 1045 bp, Homo sapiens
  misc_feature (2)..(2): n is a, c, g, or t
  misc_feature (5)..(6): n is a, c, g, or t
  misc_feature (9)..(9): n is a, c, g, or t
  misc_feature (11)..(11): n is a, c, g, or t
  misc_feature (14)..(14): n is a, c, g, or t
cncanncantntcngatccacagtcagaatgagctaccaaagatgcaaatcagatccagttactctcctgctaaaaattctccagcatctcttgcctccaggtccaaaatctccccctctctattatacaaagctctccccagatgctatctgcaacctctgtacccagatcaagcctggacccttgttgtctctgcgcgaagctgagcagtcagaactcctgtttgggttcagtgtgggtacctttggtttcaaaaatgcattaggtggggaggatgaaggcagcaccttcggtctgagaactgcaggtctgcgagtgtctccatttggggtgactgccgtcttcattgaactgaccctcgccaccctcgccatagtccaccaggctgtcgtcactctcctgctgcttgatggtgccgtccagagatgtctgactgccctgcaggggcttgttgtcctcatcactggccaaagagagacagagaatctcagtgcccagtcaagggcattgcaccaagaaagttgccagtacggggtgaagactgatgaacacgtgtcctctgcactctggttgcccagggcgccccgggctgaaaagcagctcccgacaactcttctgtacccccagcaagctgacttcaagcccctctattcttagtgcttcagctgttaccactgagtgggcctctcccaagctgaccacctccttaactctcatcagcaccagtgaccctttattcatccccatcatccctccagccacctccacaaccgtaagcccagagcctcctcctacagctctccttggatgcatgcgcttgaaattcaacctgcatcttcctgccccctgccttgattctcccagctctcctgctgctgccacaggccacaccactgtgcccatctctaagagctgccacttcttccaaaacacttcccatattcctctcactgttccattctattccaggggtcccctcacctgtgcctgcctgccacttcctgtggatacaatgagacatcccgttaccaccttcctaggagg

SEQ ID NO: 462645 - DNA, 669 bp, Homo sapiens
cggccgcttagtcgcagggcccgccacccgagggtcgcgcagcccactgggcccgatggagccgccgcgtgccgggcgcgtgcgcgagctcgcccgggcgggggccgcggggcgctaacggtcgcagacgagttcgccgccctgggccgggaggcggctcaacaccgtgactgccgacctccgagaccgtttacctcactgcggcgtgtgctggcggcagcccgcgccgcctccgagcaataaccgcgccgccaccgctgctgccgccggccctgagggagccggccccggccctcccgcgccccgagtccccactgccctccgcatgtcaacggcgcccgccccgctgccgccccatccacgttgagacgcgaacaaaacccagacggccaggtccaagcttcccaagctttatttattgccaaatttgggcggcctcgcccgcacggcaccctccgagtccccgccgcgtctgcaccatcccgcgatggcgtttctcgtgtttttcttttctggatgatataaatattgaccgcacactcctgcttgctccgggttttctctggggtcccaagagcgcagtggccttgggggagaggtgagggtcctgccctccggccgggccgccaaagcggggtgacccgagagcgcaaaggcggccgcaacgtg

SEQ ID NO: 462646 - DNA, 403 bp, Homo sapiens
cggccgcttagtcgcagggcccgccacccgagggtcgcgcagcccactgggcccgatggagccgccgcgtgccgggcgcgtgcgcgagctcgcccgggcgggggccgcggggcgctaacggtcgcaggtccaagcttcccaagctttatttattgccaaatttgggcggcctcgcccgcacggcaccctccgagtccccgccgcgtctgcaccatcccgcgatggcgtttctcgtgtttttcttttctggatgatataaatattgaccgcacactcctgcttgctccgggttttctctggggtcccaagagcgcagtggccttgggggagaggtgagggtcctgccctccggccgggccgccaaagcggggtgacccgagagcgcaaaggcggccgcaacgtg

SEQ ID NO: 462647 - DNA, 1241 bp, Homo sapiens
tttcctgggggcttccaagggagggggccccgccgtctgcagtccagcatggaggcaccctgcttaataagcaggcgccacagctcagggtcaatgcaagacgcatcccctgcaaaacacactggctcattttaaagctctcaccttccaaggcccgcccgagtcccaagtcccacccgcgtccaccctccctgatccagaggcgggatggccggccgggtagggggcgcggggctcggcggggctctgacggcgcggcctggcttgcaggctagaggcggccgaggcagcgggaggagcgagccccgattcccccccggagcgcggcgcgggcagcgcggggcctgagcagcagcagccgccactggagccggacgccgagcgggacgcgggccccgagcaggcccagaccagctaccgcgacctgtggagcctgcgcgcctcgcttgagctgcatgcggccgcctcggaccacagcagcagcggcaacgaccgcgactcggtgcgcagcggcgacagctcgggctcaggctccgggggcgcggcgcccgccttcccgccgccctccccgcccgcgccgcggcccaaggacggcgaggcgcgccggctgctgcagatggacagtggctacgccagcatcgagggccgcggcgcaggcgacgacaccgagccacctgccgcgcccgcccggccccgcagcccgcgcgcctggccccgccgcccgcgccgcgactacagcatcgacgagaagacggacgcgctgttccacgagttcctgcgccacgacccgcacttcgacgacacgccggctgccgcgcgacaccgcgcccgcgcgcacccgcacgcccgcaaacagtggcagcgtggccggcagcacagcgaccccggcgcccgcgcggccccggccctggccggaaccccggcaccgcctgccggcgcggcccgacccgcgcgtgcgcccttgcggcgcggcgacagcgtggacggcccgcccgacggtcgcaccctgggcggcgccggcgacgaccccgccatccccgtcatcgaggaggagccgggcggcggggggtgccccggctcgggcctgtgcgtcctaccatccgggtcggtgctggacaagctggcggctggcctcgacgagagactctttccgccgcgcctcgccgagcccgtcgtggcgactcccgcgttggtcgccgccgcccccacgtcccccgaccacagcccggcctaagtcccgc

SEQ ID NO: 462648 - DNA, 2792 bp, Homo sapiens
tgggccgggggcggggctcggccgccgcggcgggtgcggggggcggctccgcgtgcggagtgggcgcccgggagcgcaggctccgccccccgccccgccggaagggaaggggaggcggtggccggcgcggagccagccagacccagcggcgagcgcagcgggggcggcgggccggggaccgggcagcaccgggcgcgcggagcgggcgcgccgccaacgcggtcacgtgcgcggcccctcctctcgcgccggcctcccccgcgccgcgctctccattcataaattctccgcctgctccgcggccaccgggcgccggagccagccgcgagcgccacgcagccgcccgccgccagcccgccgcccatgggccgctcgtcccggcgctgaggtaggcgcggcgggctcggggctgcggggggcggacgggggacaggccggggatcgcagccggctgtgggctaagcggccggagggagggcgcggaggagtccggcgggcgtggggaccgagatccgggccttgcgccccccacccggctgcctccagagggacccccgctcaggccccgccccagcctcagtttctccctgtgaggtcgggcgaggacgatggcgtctcggctcagccctggccgtaaggcggccggggatgctccgggcgcccgggctgggcacggcggggaggcggccgcggccatcttgcggcttcgcgcccgcccccccgaggccgccgcccccccccaggccgccgcccccgcgccccctccccgccgctccctggcaacccgcccccccagccgcggcctgctccgcacactcagcaccggggagacctccacctcccggagtcgtgacccgggagcacgcgcccagcccctgcaccctccctggcgcgcaggcagcgggaggtctccctctacccaaccatggccgggtgggccctgccagggtgtagctgaacttcttggggtgggggtagccccccacccccgtgatggggcggacagggcgtctggagtccttctcgagccggctgcaccgccttggcgtccccattcctccgagtgcttgccctgcccagcgctgagctccagggcctggcgctaccttgcaggacaggccgcaccggctgtgtgcagttgtgatgggtacaggcgcaccctcagagggccaggcctcctcccccgccatggggatgggagatggaggtccagagagagcccccggggcccgctgggcagagccaagccgggtggaggctgcctccggctctgctacctctccatgagtcactgccccctgtgtgggctcctgctcctgcagggaagacccagcttgtctgcagtggctcctgcaggagaagtaggtctagctggagctgaccaggcttcctccccacagggccctcctccccagttcagaatgcagcccacagccaccatggccacagccgccaccaccaccaccaccaccactgccacagtagccctgacgacgtcgtgggacaatgccactggacgccccacggcagagccagaccccatcctggacaactacgtgctgctggtggtggtgatgtcgctgttcgtggggggcacgctggtggtgttgtctggcgtcctgctcctctgcaagcgctgctgggacgtccaccagcgcctcaacagggccatggaggaagcggagaagaccaccaccacctacctggacaacggcacccacccagcccaagaccccgacttccggggagaggaccccgagtgccaggatgcggagaccgaacgcttcctgtccaccagctccacgggccgccgggtctccttcaatgaggcggcgctgtttgagcagagccgcaagacgcaggacaagggtcgccggtacacactgacggagggggacttccaccacctgaagaatgcccggctcacgcacctgcacctgccgcccctcaagattgtcaccatccacgagtgtgactcaggcgaggccagctcagccaccacgccccacccggccacctctcccaaggccactctggccatcttccagcccccggggaaggccctcaccggccgctctgtgggccccagctccgccctgccaggtgacccctacaactcagccgcgggcgccactgacttcgcagagatcagcccctcggcatctagcgactctggggaaggcacctcgttggatgccggtaccaggagcaccaaggctggagggcccggggctgcagcagggcctggggaggcgggcccgggatccggggcaggtaccgttctgcagttcctcacccgcctgcgccgccatgccagcctggatggggccagcccctatttcaaggtcaagaagtggaagctggagcccagccagcgggcagccagtctggacacgagaggttcccccaagcggcaccacttccagcggcagcgggcagccagtgagagcacggagcaggaggagggggatgcccccccatccacgttgagacgcgaacaaaacccagacggccaggtccaagcttcccaagctttatttattgccaaatttgggcggcctcgcccgcacggcaccctccgagtccccgccgcgtctgcaccatcccgcgatggcgtttctcgtgtttttcttttctggatgatataaatattgaccgcacactcctgcttgctccgggttttctctggggtcccaagagcgcagtggccttgggggagaggtgagggtcctgccctccggccgggccgccaaagcggggtgacccgagagcgcaaaggcggccgcaacgtg

SEQ ID NO: 462649 - DNA, 3546 bp, Homo sapiens
tgggccgggggcggggctcggccgccgcggcgggtgcggggggcggctccgcgtgcggagtgggcgcccgggagcgcaggctccgccccccgccccgccggaagggaaggggaggcggtggccggcgcggagccagccagacccagcggcgagcgcagcgggggcggcgggccggggaccgggcagcaccgggcgcgcggagcgggcgcgccgccaacgcggtcacgtgcgcggcccctcctctcgcgccggcctcccccgcgccgcgctctccattcataaattctccgcctgctccgcggccaccgggcgccggagccagccgcgagcgccacgcagccgcccgccgccagcccgccgcccatgggccgctcgtcccggcgctgaggtaggcgcggcgggctcggggctgcggggggcggacgggggacaggccggggatcgcagccggctgtgggctaagcggccggagggagggcgcggaggagtccggcgggcgtggggaccgagatccgggccttgcgccccccacccggctgcctccagagggacccccgctcaggccccgccccagcctcagtttctccctgtgaggtcgggcgaggacgatggcgtctcggctcagccctggccgtaaggcggccggggatgctccgggcgcccgggctgggcacggcggggaggcggccgcggccatcttgcggcttcgcgcccgcccccccgaggccgccgcccccccccaggccgccgcccccgcgccccctccccgccgctccctggcaacccgcccccccagccgcggcctgctccgcacactcagcaccggggagacctccacctcccggagtcgtgacccgggagcacgcgcccagcccctgcaccctccctggcgcgcaggcagcgggaggtctccctctacccaaccatggccgggtgggccctgccagggtgtagctgaacttcttggggtgggggtagccccccacccccgtgatggggcggacagggcgtctggagtccttctcgagccggctgcaccgccttggcgtccccattcctccgagtgcttgccctgcccagcgctgagctccagggcctggcgctaccttgcaggacaggccgcaccggctgtgtgcagttgtgatgggtacaggcgcaccctcagagggccaggcctcctcccccgccatggggatgggagatggaggtccagagagagcccccggggcccgctgggcagagccaagccgggtggaggctgcctccggctctgctacctctccatgagtcactgccccctgtgtgggctcctgctcctgcagggaagacccagcttgtctgcagtggctcctgcaggagaagtaggtctagctggagctgaccaggcttcctccccacagggccctcctccccagttcagaatgcagcccacagccaccatggccacagccgccaccaccaccaccaccaccactgccacagtagccctgacgacgtcgtgggacaatgccactggacgccccacggcagagccagaccccatcctggacaactacgtgctgctggtggtggtgatgtcgctgttcgtggggggcacgctggtggtgttgtctggcgtcctgctcctctgcaagcgctgctgggacgtccaccagcgcctcaacagggccatggaggaagcggagaagaccaccaccacctacctggacaacggcacccacccagcccaagaccccgacttccggggagaggaccccgagtgccaggatgcggagaccgaacgcttcctgtccaccagctccacgggccgccgggtctccttcaatgaggcggcgctgtttgagcagagccgcaagacgcaggacaagggtcgccggtacacactgacggagggggacttccaccacctgaagaatgcccggctcacgcacctgcacctgccgcccctcaagattgtcaccatccacgagtgtgactcaggcgaggccagctcagccaccacgccccacccggccacctctcccaaggccactctggccatcttccagcccccggggaaggccctcaccggccgctctgtgggccccagctccgccctgccaggtgacccctacaactcagccgcgggcgccactgacttcgcagagatcagcccctcggcatctagcgactctggggaaggcacctcgttggatgccggtaccaggagcaccaaggctggagggcccggggctgcagcagggcctggggaggcgggcccgggatccggggcaggtaccgttctgcagttcctcacccgcctgcgccgccatgccagcctggatggggccagcccctatttcaaggtcaagaagtggaagctggagcccagccagcgggcagccagtctggacacgagaggttcccccaagcggcaccacttccagcggcagcgggcagccagtgagagcacggagcaggaggagggggatgccccccaggaggacttcatccagtacattgcccgggcgggcgacgccgtggccttcccgcacccccgcccctttctggccagcccgccccctgctctcggcaggctagaggcggccgaggcagcgggaggagcgagccccgattcccccccggagcgcggcgcgggcagcgcggggcctgagcagcagcagccgccactggagccggacgccgagcgggacgcgggccccgagcaggcccagaccagctaccgcgacctgtggagcctgcgcgcctcgcttgagctgcatgcggccgcctcggaccacagcagcagcggcaacgaccgcgactcggtgcgcagcggcgacagctcgggctcaggctccgggggcgcggcgcccgccttcccgccgccctccccgcccgcgccgcggcccaaggacggcgaggcgcgccggctgctgcagatggacagtggctacgccagcatcgagggccgcggcgcaggcgacgacaccgagccacctgccgcgcccgcccggccccgcagcccgcgcgcctggccccgccgcccgcgccgcgactacagcatcgacgagaagacggacgcgctgttccacgagttcctgcgccacgacccgcacttcgacgacacgccggctgccgcgcgacaccgcgcccgcgcgcacccgcacgcccgcaaacagtggcagcgtggccggcagcacagcgaccccggcgcccgcgcggccccggccctggccggaaccccggcaccgcctgccggcgcggcccgacccgcgcgtgcgcccttgcggcgcggcgacagcgtggacggcccgcccgacggtcgcaccctgggcggcgccggcgacgaccccgccatccccgtcatcgaggaggagccgggcggcggggggtgccccggctcgggcctgtgcgtcctaccatccgggtcggtgctggacaagctggcggctggcctcgacgagagactctttccgccgcgcctcgccgagcccgtcgtggcgactcccgcgttggtcgccgccgcccccacgtcccccgaccacagcccggcctaagtcccgc

SEQ ID NO: 462650 - DNA, 901 bp, Homo sapiens
  misc_feature (22)..(22): n is a, c, g, or t
ccttggagtagcaaaccaactnggtggatgggggtgaaaacaagagagagagagagagagagagatgaggggcccgcacatgccctgctcatctcaaaacttctcgagaagcaaatctaacttgcaggaactttgagaaaggcaggagaagcaaaaaagcaaaatgagattgttttcataacttaaagaggctgaaaatgatgaaactgggctgagatgtgttacaggagcctacacagctagaaggatagattcgaggtcatgctttgagcaaaagccattaaaatacataaataacattgtatcacacttttgcctctcaagttgagactgcctctaaattgactagcgttacaaatatcctaacagaaaactatccctaaaacctagaaagccatattatgctttggcaatcatctgaccatgtacaacaaatgtaatgaaaacggtaaacctgaaccaaggcaaacccaacagtttaatttaaaaacttgaagatactaagtattcccttcaactggacattcagaaacttcacgtggctacattgtatttccccccacgagttgcttcagggttgtgaaattcactggactgtggagggagccttaaacctttgtgggtgattgacgtctaaagtacctgagcttttctggttctgctgaccctcagtctcctggaccctagaagaagaatcagacccatccttcagtctcatctctagaagcccagaataaaatgaaaaaggtatgaacgagaagagagaaatcactgttgacaacacattttacctagcagtccaacattgtttatcagcataataaaatgtgccaatactcaccagcactctaaagtatgcactaataataaatagagatatagggcataatatgaccaatga

SEQ ID NO: 462651 - DNA, 1315 bp, Homo sapiens
ctggaaaagtgaaggtgacctaagaaagatgagcttctcaccatggctgtgtgctctggggaaacctctctccgctctgcttgtggcccggctccctcgaaggctggaggagagaagctgccccctgcctttctctgaacatccagtgtcgccagcagtctttgctgctccttggctttcaggatgtaactccaatccctgcctccatctccacatggctgtctccttcctgtgtgtgtctgtacccaaatgttcctcttctactgaggacatgggctacattgtgttagagtccactcgaacgaccgaccgcatcttcgctttattacatctacaaagactctatttccaaataaggtcacatgcacaggtacaggggttaggacatcaacttctctcttggaagaacagaattcaactgatacaacactggaggggtgaaaacaagacagagagagagagagagagagagagagagatgaggggcccgcacatgccctgctcatctcaaaacttctcgagaagcaaatctaacttgcaggaactttgagaaaggcaggagaagcaaaaaagcaaaatgagattgttttcataacttaaagaggctgaaaatgatgaaactgggctgagatgtgttacaggagcctacacagctagaaggatagattcgaggtcatgctttgagcaaaagccattaaaatacataaataacattgtatcacacttttgcctctcaagttgagactgcctctaaattgactagcgttacaaatatcctaacagaaaactatccctaaaacctagaaagccatattatgctttggcaatcatctgaccatgtacaacaaatgtaatgaaaacggtaaacctgaaccaaggcaaacccaacagtttaatttaaaaacttgaagatactaagtattcccttcaactggacattcagaaacttcacgtggctacattgtatttccccccacgagttgcttcagggttgtgaaattcactggactgtggagggagccttaaacctttgtgggtgattgacgtctaaagtacctgagcttttctggttctgctgaccctcagtctcctggaccctagaagaagaatcagacccatccttcagtctcatctctagaagcccagaataaaatgaaaaaggtatgaacgagaagagagaaatcactgttgacaacacattttacctagcagtccaacattgtttatcagcataataaaatgtgccaatactcaccagcactctaaagtatgcactaataataaatagagatatagggcataatatgaccaatga

SEQ ID NO: 462652 - DNA, 1139 bp, Homo sapiens
gacatctacactaataactctcgtccagttctctgccatgtatatggatttatatactagacctttaaatgtgttatttcaaacttaacagtcaaaacggagctcctgatcttccctcccaagggaggaactgtctccagtctcaattcctaacagctgctcaggccaaagccttggaattatccttaattcctgtttctctcatatctcacatccagtctatcggcaaatcttcccagctgttccacaaatatgcggcatctgaccacttctcaacccccactgccaccaccctgcccaagccccatcttctctctcctgaattagcacaacagtctcattactgggcctattgctttcaccctttctgtaacactcgccactgcggcccacggcttcattcctggaagcccgtgagaccaggaacccttcgatcgagaaaagaccttccattgggagaagacttctcgtcttatttccacctataatctcttcaaaacatagcagtcagagttacctgctgaactcataagtcactcatctgctcaaagcctcccagtggcttctcatctcacagaatccaagtcgaccttcctggagcctctatccactacttgttttgctcaacaagaacacacatcgtgttgactccatcttttatatgatgcctcaccacaatgttccattggccagtgcaagagaaaccaggatgcttcctcatactgcacatctttatctgagaaccaaaggacaaatatgggtgtcacatgccagctccttctacctccttctgaaaccagaggactggattggaaccaacagagatcatgctgtttacttcacagatttcaagaaaagtgaattctgagtaatcatttttttttagatcttcctatgtgtaaaaatctttggtgagatttaccatctcatttaaagttctttcacaatttttgtgaaaattgagtgatgtgtaataaataagttattttttttctttatagctgatgcttgaccttttttcccttggtaatatagcttacgaagcagatatatatgccaatacacccttgattttaagtctttcaaatagaagaacatagggataaactgacacatgagagatggataaatgtacggac

SEQ ID NO: 462653 - DNA, 1224 bp, Homo sapiens
gtgcagtgcacattcttatctaccaacatatacagcagtccttctgggaaggaaatttgggcaggaaagggaactcacagtgtcggaatgcctggagcatttcttctagtctggtggacagaatatgaaagtatctgcctggcagtgcagtaaatgaaaagagaagataaatgaataaaaaaaaaagttataaataacagtaggaaagagagagtgcaggtggaacgagcctatcctgtggtgaaatgacaacacattctgcagttttaaaatctaagaggctcattgacttttcttcattcatttaaattgatctccaagaaaactatgtattttaaagattccataaactgaatatatgaatgagaattaagaagagaggggctgcttcctaatctgtttatataaggtatagtatagtataatctgtttatataaggttagtagagaggagacaccaggtgctggccataaacctaagaagacattgaatcccattcactccttaacattccttaatatacattcatgagctacataacattttaatcatcaatgatggaccatataccatatacgatatggtggccccataagattataatggacctgaaaaattcctattgctagtgatgtggtcattgtaaagctgtagcacaacacattacccacgtttgtggtgacagtcatataaaagtatggtacatataattatgtacagtgcatacataatacttgataatatgttactggtttgtgtctttgctatgctttttatcattattttagggtatactacttaaaatgttaactgtaaaacagcttctgacaggtccttcaggaagtactccagaagaaggcattgttatcatagaaggtgacagcttcatgtgtgttattgcccctgaagaccttccagtggtacaagatgtggaggaggaagacagtgatactgaggattctgaccctgtgtaggcttaggctaatgtgtgtgtttatatcttagtttttcacaaaaaggtttttccaatgttaaaaaaaatatataaaaaagcttatagaataaggatataaagaaatattttgtacagctgtacaataagctaagcattattaccaaagagtcaaaaagttttaagaaattaaagtttataaaccaaatgttcattgtgagccaaggttaatttattgaagaaataaaacatttttaatgaaaaaaatgta

SEQ ID NO: 462654 - DNA, 3429 bp, Homo sapiens
ggtttgcgggtcaaattggtcccaatggcttaggatgcatttcaagggtgaacctgttgatgcatgttcagatgtgtctggagtttcttccttcttgtgggttcatggtcttgctgacttccggagtgaagccacagaccttcgcagagtgaaactgcagacattcacagtgagtgttacagctcttaaaggtggcgcgtccagagttgtttgttcctcctggtgggttcgtggtctcactgactttaggagtgaagccacaggccttcgcagtgtgttacagctcttaaaggtggcccatctggagttgtttgttcctcccggtgggcgagtggtctcactgactaaaggaatgaagcctcagacctccgcagtgagtgttacagctcataagggtagtgtgggcccaaagaaaggaatggaaatcaagaatgtgattcatatgttaagtgtgaaatgtctgttaagacacctgtttttgtctgctagcgttgacataacaatataacacagactgggtagtataaacaacagaaatttatttttctcacagttaggaggctgaaagtccaggatgaagggttatatatgtttctgtagtttgtggagccaaacagatgatctggttacccacagtatcaaaatgtaacaagttttattttcttacacattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggctgtgtggaacatgagaaggataccagtcattgacatcacctaagatggtgacaagacctagaaagaaagatcaagtcaagcatagaagttttcatcaatgttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataaatcaaagatgtttgaatggtgtcttattctgaaataacctgacctaagacaggtatttagattattttggatacattttgaaaagggatagcataaatattttaagtaaaaagacctttattttaaataatagtggatattttaatgctggaaattagcattatagttgatatgccagaaattatatctttggttgtgatttaaacttatgctataaactaaattaatgatgtaaatacatagttttaaacattcttttagggacatgtaacttttaagtatcacttcaataatacgtattattataggaacaaagatttgggaataattgattacaggtgaggaagtactggaattccagttcaaggagataccatttcatttaggactaaaaggacaagatacaagttcacatgatgggaaaaatcagaaaacctctcgcagacaaagggtatataatggatatgaggcatcaaaaagcatggtatagtcagtgatggggaatagtccagaaaggctgaaacacagcatgtgatgcgagtcaaggtagttgatgcccaactgtgaagggccgttctaatctagcatggaggtagacagtgtttccttaatatggctgcatatcagaattacctaggtcaggacgaggcatggagatgctactttaataggccctgccgcagatcttccaaaccagaatcttaatcctggagtctaggaatctttatttttcacacaactcatccaagtggttctgataaaatcagtccagcacttttagaacccactgataacagacttattcctggagacagcatttgaggaggaattgaagatttttctaatgaaaagaaaaagggtcacatgaacagatgttgcagtgtacctgtgccagggatttcatgtgtacactttataggagaataagcaagagcttagttttcttgagttataatttgccaaccataaaattcattcatttaatgtatgatttaataaacttttgtagagttctagaattgcacaactatgatcacaacctaattctagatcatttctatcatactaaaaagaaatcttacacccatttacaatcactctccattctcacccccagccctatgcaaccatgattctattttctatttctatatgtttgcctttctgggatatttcatataaatggaataatatgatatgtgttcttttctgtcaggccctttcattgagatatttttaaagtttggaggttcctccacactgtagcatgtacagtcctatttttcctttttagtgatgaatagtattccattgtatgaatgcatcacattttatctattcatccagtgacagacatttggatgtgaattgtttgtgcttttgggatgtttgtattattactgttacagacattcctgtatagatctgtgtgtggacatatattttcatgggtagatacataggaacagaactgctgagtcataagataaacctgtttaactttttaaaaactgctagcctgttttgcagatgtttgcattattatacattcccaacacaatgtataaagttcctattttaccacaaccttatcaacacttgttattgtctgtcttattagttatagccattttagtgtgtgaaaatttgatctagtgattttgatttgtatttccctaatgactaatgatgacaacctttccatgtgcttataagccatttgtatatttctttggaagaatgtctattcaagtcctctgcccattttttagttttttaaaattattattaatgagttttaaggattctttatatattctggacataagtcccttattgaatatatgatttgcaaatattttatcacagtctgtgggttgactcttcactttcttgatggtgtctctaaagcacaaaagtttttaactttgagcaaatctcttttgaactcttaatggagaac

SEQ ID NO: 462655 - DNA, 650 bp, Homo sapiens
cggccaccgctcgcttcaatatggctgcccccagggagagacgaggctaccatgaaggagccgagcgcagaccctgagtccgtcacccatggatcgcagcgcggagttcaggaaatggaaggcgcaatgtttgagcaaagcggacctcagccggaagggcagtgttgacgaggatgtggtagagcttgtgcagtttctgaacatgcgagatcagtttttcaccaccagctcctgcgctggccgcatcctactccttgaccgggtgaggcccctttgcgcctgtccatcgcctgccttctagtgcgaaactttaggagccctgttcccatccagtgacgaccggatccagcatgtctgtgtttgctcctctgaggggtggtctctgtttctttatatgtgaaatttaggggattagatcagtgcttctaaaagtttaacgtggctattaatcagctgagcatcttttaaaatacagatcccgattctttaagtgtagggtagggcctgatactgtgcatttctaacaagtgcccaaatgatgttgaaactgctgacctgggaactatcttgtgtggcaaagtttagaaaatttgattttattatatgaatactaagggaatctaaagactttgtagcttgctaaggtattg

SEQ ID NO: 462656 - DNA, 3080 bp, Homo sapiens
tcggagagaaaaaccttacggctaggtacgaggctgggtgttgcgcagaccctgagtccgtcacccatggatcgcagcgcggagttcaggaaatggaaggcgcaatgtttgagcaaagcggacctcagccggaagggcagtgttgacgaggatgtggtagagcttgtgcagtttctgaacatgcgagatcagtttttcaccaccagctcctgcgctggccgcatcctactccttgaccggggtataaatggttttgaggttcagaaacaaaactgttgctggctactggttacacacaaactttgtgtaaaagatgatgtgattgtagctctgaagaaagcaaatggtgatgccactttgaaatttgaaccatttgttcttcatgtgcagtgtcgacaattgcaggatgcacagattctgcattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataaatcaaagatgtttgaatggtgtcttattctgaaataacctgacctaagacaggtatttagattattttggatacattttgaaaagggatagcataaatattttaagtaaaaagacctttattttaaataatagtggatattttaatgctggaaattagcattatagttgatatgccagaaattatatctttggttgtgatttaaacttatgctataaactaaattaatgatgtaaatacatagttttaaacattcttttagggacatgtaacttttaagtatcacttcaataatacgtattattataggaacaaagatttgggaataattgattacaggtgaggaagtactggaattccagttcaaggagataccatttcatttaggactaaaaggacaagatacaagttcacatgatgggaaaaatcagaaaacctctcgcagacaaagggtatataatggatatgaggcatcaaaaagcatggtatagtcagtgatggggaatagtccagaaaggctgaaacacagcatgtgatgcgagtcaaggtagttgatgcccaactgtgaagggccgttctaatctagcatggaggtagacagtgtttccttaatatggctgcatatcagaattacctaggtcaggacgaggcatggagatgctactttaataggccctgccgcagatcttccaaaccagaatcttaatcctggagtctaggaatctttatttttcacacaactcatccaagtggttctgataaaatcagtccagcacttttagaacccactgataacagacttattcctggagacagcatttgaggaggaattgaagatttttctaatgaaaagaaaaagggtcacatgaacagatgttgcagtgtacctgtgccagggatttcatgtgtacactttataggagaataagcaagagcttagttttcttgagttataatttgccaaccataaaattcattcatttaatgtatgatttaataaacttttgtagagttctagaattgcacaactatgatcacaacctaattctagatcatttctatcatactaaaaagaaatcttacacccatttacaatcactctccattctcacccccagccctatgcaaccatgattctattttctatttctatatgtttgcctttctgggatatttcatataaatggaataatatgatatgtgttcttttctgtcaggccctttcattgagatatttttaaagtttggaggttcctccacactgtagcatgtacagtcctatttttcctttttagtgatgaatagtattccattgtatgaatgcatcacattttatctattcatccagtgacagacatttggatgtgaattgtttgtgcttttgggatgtttgtattattactgttacagacattcctgtatagatctgtgtgtggacatatattttcatgggtagatacataggaacagaactgctgagtcataagataaacctgtttaactttttaaaaactgctagcctgttttgcagatgtttgcattattatacattcccaacacaatgtataaagttcctattttaccacaaccttatcaacacttgttattgtctgtcttattagttatagccattttagtgtgtgaaaatttgatctagtgattttgatttgtatttccctaatgactaatgatgacaacctttccatgtgcttataagccatttgtatatttctttggaagaatgtctattcaagtcctctgcccattttttagttttttaaaattattattaatgagttttaaggattctttatatattctggacataagtcccttattgaatatatgatttgcaaatattttatcacagtctgtgggttgactcttcactttcttgatggtgtctctaaagcacaaaagtttttaactttgagcaaatctcttttgaactcttaatggagaac

SEQ ID NO: 462657 - DNA, 1203 bp, Homo sapiens
  misc_feature (1179)..(1179): n is a, c, g, or t
  misc_feature (1182)..(1182): n is a, c, g, or t
cggccaccgctcgcttcaatatggctgcccccagggagagacgaggctaccatgaaggagccgagcgcagaccctgagtccgtcacccatggatcgcagcgcggagttcaggaaatggaaggcgcaatgtttgagcaaagcggacctcagccggaagggcagtgttgacgaggatgtggtagagcttgtgcagtttctgaacatgcgagatcagtttttcaccaccagctcctgcgctggccgcatcctactccttgaccggggtataaatggttttgaggttcagaaacaaaactgttgctggctactggttacacacaaactttgtgtaaaagatgatgtgattgtagctctgaagaaagcaaatggtgatgccactttgaaatttgaaccatttgttcttcatgtgcagtgtcgacaattgcaggatgcacagattctgcattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataagtaagtttcctggcaagattggccaatgttatttgacaantcntttgaaactcgtatcgcgtac

SEQ ID NO: 462658 - DNA, 1307 bp, Homo sapiens
cggccaccgctcgcttcaatatggctgcccccagggagagacgaggctaccatgaaggagccgagcgcagaccctgagtccgtcacccatggatcgcagcgcggagttcaggaaatggaaggcgcaatgtttgagcaaagcggacctcagccggaagggcagtgttgacgaggatgtggtagagcttgtgcagtttctgaacatgcgagatcagtttttcaccaccagctcctgcgctggccgcatcctactccttgaccggggtataaatggttttgaggttcagaaacaaaactgttgctggctactggttacacacaaactttgtgtaaaagatgatgtgattgtagctctgaagaaagcaaatggtgatgccactttgaaatttgaaccatttgttcttcatgtgcagtgtcgacaattgcaggatgcacagattctgcattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctacttctgacaggtccttcaggaagtactccagaagaaggcattgttatcatagaaggtgacagcttcatgtgtgttattgcccctgaagaccttccagtggtacaagatgtggaggaggaagacagtgatactgaggattctgaccctgtgtaggcttaggctaatgtgtgtgtttatatcttagtttttcacaaaaaggtttttccaatgttaaaaaaaatatataaaaaagcttatagaataaggatataaagaaatattttgtacagctgtacaataagctaagcattattaccaaagagtcaaaaagttttaagaaattaaagtttataaaccaaatgttcattgtgagccaaggttaatttattgaagaaataaaacatttttaatgaaaaaaatgta

SEQ ID NO: 462659 - DNA, 3215 bp, Homo sapiens
cggccaccgctcgcttcaatatggctgcccccagggagagacgaggctaccatgaaggagccgagcgcagaccctgagtccgtcacccatggatcgcagcgcggagttcaggaaatggaaggcgcaatgtttgagcaaagcggacctcagccggaagggcagtgttgacgaggatgtggtagagcttgtgcagtttctgaacatgcgagatcagtttttcaccaccagctcctgcgctggccgcatcctactccttgaccgggtgaggcccctttgcgcctgtccatcgcctgccttctagtgcgaaactttaggagccctgttcccatccagtgacgaccggatccagcatgtctgtgtttgctcctctgagggggtataaatggttttgaggttcagaaacaaaactgttgctggctactggttacacacaaactttgtgtaaaagatgatgtgattgtagctctgaagaaagcaaatggtgatgccactttgaaatttgaaccatttgttcttcatgtgcagtgtcgacaattgcaggatgcacagattctgcattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataaatcaaagatgtttgaatggtgtcttattctgaaataacctgacctaagacaggtatttagattattttggatacattttgaaaagggatagcataaatattttaagtaaaaagacctttattttaaataatagtggatattttaatgctggaaattagcattatagttgatatgccagaaattatatctttggttgtgatttaaacttatgctataaactaaattaatgatgtaaatacatagttttaaacattcttttagggacatgtaacttttaagtatcacttcaataatacgtattattataggaacaaagatttgggaataattgattacaggtgaggaagtactggaattccagttcaaggagataccatttcatttaggactaaaaggacaagatacaagttcacatgatgggaaaaatcagaaaacctctcgcagacaaagggtatataatggatatgaggcatcaaaaagcatggtatagtcagtgatggggaatagtccagaaaggctgaaacacagcatgtgatgcgagtcaaggtagttgatgcccaactgtgaagggccgttctaatctagcatggaggtagacagtgtttccttaatatggctgcatatcagaattacctaggtcaggacgaggcatggagatgctactttaataggccctgccgcagatcttccaaaccagaatcttaatcctggagtctaggaatctttatttttcacacaactcatccaagtggttctgataaaatcagtccagcacttttagaacccactgataacagacttattcctggagacagcatttgaggaggaattgaagatttttctaatgaaaagaaaaagggtcacatgaacagatgttgcagtgtacctgtgccagggatttcatgtgtacactttataggagaataagcaagagcttagttttcttgagttataatttgccaaccataaaattcattcatttaatgtatgatttaataaacttttgtagagttctagaattgcacaactatgatcacaacctaattctagatcatttctatcatactaaaaagaaatcttacacccatttacaatcactctccattctcacccccagccctatgcaaccatgattctattttctatttctatatgtttgcctttctgggatatttcatataaatggaataatatgatatgtgttcttttctgtcaggccctttcattgagatatttttaaagtttggaggttcctccacactgtagcatgtacagtcctatttttcctttttagtgatgaatagtattccattgtatgaatgcatcacattttatctattcatccagtgacagacatttggatgtgaattgtttgtgcttttgggatgtttgtattattactgttacagacattcctgtatagatctgtgtgtggacatatattttcatgggtagatacataggaacagaactgctgagtcataagataaacctgtttaactttttaaaaactgctagcctgttttgcagatgtttgcattattatacattcccaacacaatgtataaagttcctattttaccacaaccttatcaacacttgttattgtctgtcttattagttatagccattttagtgtgtgaaaatttgatctagtgattttgatttgtatttccctaatgactaatgatgacaacctttccatgtgcttataagccatttgtatatttctttggaagaatgtctattcaagtcctctgcccattttttagttttttaaaattattattaatgagttttaaggattctttatatattctggacataagtcccttattgaatatatgatttgcaaatattttatcacagtctgtgggttgactcttcactttcttgatggtgtctctaaagcacaaaagtttttaactttgagcaaatctcttttgaactcttaatggagaac

SEQ ID NO: 462660 - DNA, 3193 bp, Homo sapiens
atttttttttcatttttaaatactgtgctagccaaatagctagagtacaactcaggtgctgctagtattatcccttatactaatccctttttttcttgcaaaatcatgaccatatttcagaagatgtttatcaagtagttttacctttcacataattttctacctcaagttatttgggctcattcttattctgggttaacattacccaaaaacataccgaattgtttttattaatacttaaaatcctgacttgggattattaatttaagaaagcctacaatatactatgcattatgcttattatttttgtaaaatattatatgaaacttaaattatgttattttttattttagggtataaatggttttgaggttcagaaacaaaactgttgctggctactggttacacacaaactttgtgtaaaagatgatgtgattgtagctctgaagaaagcaaatggtgatgccactttgaaatttgaaccatttgttcttcatgtgcagtgtcgacaattgcaggatgcacagattctgcattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataaatcaaagatgtttgaatggtgtcttattctgaaataacctgacctaagacaggtatttagattattttggatacattttgaaaagggatagcataaatattttaagtaaaaagacctttattttaaataatagtggatattttaatgctggaaattagcattatagttgatatgccagaaattatatctttggttgtgatttaaacttatgctataaactaaattaatgatgtaaatacatagttttaaacattcttttagggacatgtaacttttaagtatcacttcaataatacgtattattataggaacaaagatttgggaataattgattacaggtgaggaagtactggaattccagttcaaggagataccatttcatttaggactaaaaggacaagatacaagttcacatgatgggaaaaatcagaaaacctctcgcagacaaagggtatataatggatatgaggcatcaaaaagcatggtatagtcagtgatggggaatagtccagaaaggctgaaacacagcatgtgatgcgagtcaaggtagttgatgcccaactgtgaagggccgttctaatctagcatggaggtagacagtgtttccttaatatggctgcatatcagaattacctaggtcaggacgaggcatggagatgctactttaataggccctgccgcagatcttccaaaccagaatcttaatcctggagtctaggaatctttatttttcacacaactcatccaagtggttctgataaaatcagtccagcacttttagaacccactgataacagacttattcctggagacagcatttgaggaggaattgaagatttttctaatgaaaagaaaaagggtcacatgaacagatgttgcagtgtacctgtgccagggatttcatgtgtacactttataggagaataagcaagagcttagttttcttgagttataatttgccaaccataaaattcattcatttaatgtatgatttaataaacttttgtagagttctagaattgcacaactatgatcacaacctaattctagatcatttctatcatactaaaaagaaatcttacacccatttacaatcactctccattctcacccccagccctatgcaaccatgattctattttctatttctatatgtttgcctttctgggatatttcatataaatggaataatatgatatgtgttcttttctgtcaggccctttcattgagatatttttaaagtttggaggttcctccacactgtagcatgtacagtcctatttttcctttttagtgatgaatagtattccattgtatgaatgcatcacattttatctattcatccagtgacagacatttggatgtgaattgtttgtgcttttgggatgtttgtattattactgttacagacattcctgtatagatctgtgtgtggacatatattttcatgggtagatacataggaacagaactgctgagtcataagataaacctgtttaactttttaaaaactgctagcctgttttgcagatgtttgcattattatacattcccaacacaatgtataaagttcctattttaccacaaccttatcaacacttgttattgtctgtcttattagttatagccattttagtgtgtgaaaatttgatctagtgattttgatttgtatttccctaatgactaatgatgacaacctttccatgtgcttataagccatttgtatatttctttggaagaatgtctattcaagtcctctgcccattttttagttttttaaaattattattaatgagttttaaggattctttatatattctggacataagtcccttattgaatatatgatttgcaaatattttatcacagtctgtgggttgactcttcactttcttgatggtgtctctaaagcacaaaagtttttaactttgagcaaatctcttttgaactcttaatggagaac

SEQ ID NO: 462661 - DNA, 895 bp, Homo sapiens
agcggccgctcgcgatctagaaccccactcgtccgcccacgcgtccggagaggggctgcttcctaatctgtttatataaggtatagtatagtataatctgtttatataaggttagtagagaggagacaccaggtgctggccataaacctaagaagacattgaatcccattcactccttaacattccttaatatacattcatgagctacataacattttaatcatcaatgatggaccatataccatatacgatatggtggccccataagattataatggacctgaaaaattcctattgctagtgatgtggtcattgtaaagctgtagcacaacacattacccacgtttgtggtgacagtcatataaaagtatggtacatataattatgtacagtgcatacataatacttgataatatgttactggtttgtgtctttgctatgctttttatcattattttagggtatactacttaaaatgttaactgtaaaacagcttctgacaggtccttcaggaagtactccagaagaaggcattgttatcatagaaggtgacagcttcatgtgtgttattgcccctgaagaccttccagtggtacaagatgtggaggaggaagacagtgatactgaggattctgaccctgtgtaggcttaggctaatgtgtgtgtttatatcttagtttttcacaaaaaggtttttccaatgttaaaaaaaatatataaaaaagcttatagaataaggatataaagaaatattttgtacagctgtacaataagctaagcattattaccaaagagtcaaaaagttttaagaaattaaagtttataaaccaaatgttcattgtgagccaaggttaatttattgaagaaataaaacatttttaatgaaaaaaatgta

SEQ ID NO: 462662 - DNA, 2780 bp, Homo sapiens
ttcttaaagatggtatgtccggagtttgttccttcagatgttcagatgtgtccggagtttcttccttccagtgggttcgtggtcttgctgacttcaggagtgaagctgcagaccttcgcacattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataaatcaaagatgtttgaatggtgtcttattctgaaataacctgacctaagacaggtatttagattattttggatacattttgaaaagggatagcataaatattttaagtaaaaagacctttattttaaataatagtggatattttaatgctggaaattagcattatagttgatatgccagaaattatatctttggttgtgatttaaacttatgctataaactaaattaatgatgtaaatacatagttttaaacattcttttagggacatgtaacttttaagtatcacttcaataatacgtattattataggaacaaagatttgggaataattgattacaggtgaggaagtactggaattccagttcaaggagataccatttcatttaggactaaaaggacaagatacaagttcacatgatgggaaaaatcagaaaacctctcgcagacaaagggtatataatggatatgaggcatcaaaaagcatggtatagtcagtgatggggaatagtccagaaaggctgaaacacagcatgtgatgcgagtcaaggtagttgatgcccaactgtgaagggccgttctaatctagcatggaggtagacagtgtttccttaatatggctgcatatcagaattacctaggtcaggacgaggcatggagatgctactttaataggccctgccgcagatcttccaaaccagaatcttaatcctggagtctaggaatctttatttttcacacaactcatccaagtggttctgataaaatcagtccagcacttttagaacccactgataacagacttattcctggagacagcatttgaggaggaattgaagatttttctaatgaaaagaaaaagggtcacatgaacagatgttgcagtgtacctgtgccagggatttcatgtgtacactttataggagaataagcaagagcttagttttcttgagttataatttgccaaccataaaattcattcatttaatgtatgatttaataaacttttgtagagttctagaattgcacaactatgatcacaacctaattctagatcatttctatcatactaaaaagaaatcttacacccatttacaatcactctccattctcacccccagccctatgcaaccatgattctattttctatttctatatgtttgcctttctgggatatttcatataaatggaataatatgatatgtgttcttttctgtcaggccctttcattgagatatttttaaagtttggaggttcctccacactgtagcatgtacagtcctatttttcctttttagtgatgaatagtattccattgtatgaatgcatcacattttatctattcatccagtgacagacatttggatgtgaattgtttgtgcttttgggatgtttgtattattactgttacagacattcctgtatagatctgtgtgtggacatatattttcatgggtagatacataggaacagaactgctgagtcataagataaacctgtttaactttttaaaaactgctagcctgttttgcagatgtttgcattattatacattcccaacacaatgtataaagttcctattttaccacaaccttatcaacacttgttattgtctgtcttattagttatagccattttagtgtgtgaaaatttgatctagtgattttgatttgtatttccctaatgactaatgatgacaacctttccatgtgcttataagccatttgtatatttctttggaagaatgtctattcaagtcctctgcccattttttagttttttaaaattattattaatgagttttaaggattctttatatattctggacataagtcccttattgaatatatgatttgcaaatattttatcacagtctgtgggttgactcttcactttcttgatggtgtctctaaagcacaaaagtttttaactttgagcaaatctcttttgaactcttaatggagaac

SEQ ID NO: 462663 - DNA, 1701 bp, Homo sapiens
tcttctcttttcatttactgcactgccaggcagatactttcatattctgtccaccagactagaagaaatgctccaggcattccgatactggaattccagttcaaggagataccatttcatttaggactaaaaggacaagatacaagttcacatgatgggaaaaatcagaaaacctctcgcagacaaagggtatataatggatatgaggcatcaaaaagcatggtatagtcagtgatggggaatagtccagaaaggctgaaacacagcatgtgatgcgagtcaaggtagttgatgcccaactgtgaagggccgttctaatctagcatggaggtagacagtgtttccttaatatggctgcatatcagaattacctaggtcaggacgaggcatggagatgctactttaataggccctgccgcagatcttccaaaccagaatcttaatcctggagtctaggaatctttatttttcacacaactcatccaagtggttctgataaaatcagtccagcacttttagaacccactgataacagacttattcctggagacagcatttgaggaggaattgaagatttttctaatgaaaagaaaaagggtcacatgaacagatgttgcagtgtacctgtgccagggatttcatgtgtacactttataggagaataagcaagagcttagttttcttgagttataatttgccaaccataaaattcattcatttaatgtatgatttaataaacttttgtagagttctagaattgcacaactatgatcacaacctaattctagatcatttctatcatactaaaaagaaatcttacacccatttacaatcactctccattctcacccccagccctatgcaaccatgattctattttctatttctatatgtttgcctttctgggatatttcatataaatggaataatatgatatgtgttcttttctgtcaggccctttcattgagatatttttaaagtttggaggttcctccacactgtagcatgtacagtcctatttttcctttttagtgatgaatagtattccattgtatgaatgcatcacattttatctattcatccagtgacagacatttggatgtgaattgtttgtgcttttgggatgtttgtattattactgttacagacattcctgtatagatctgtgtgtggacatatattttcatgggtagatacataggaacagaactgctgagtcataagataaacctgtttaactttttaaaaactgctagcctgttttgcagatgtttgcattattatacattcccaacacaatgtataaagttcctattttaccacaaccttatcaacacttgttattgtctgtcttattagttatagccattttagtgtgtgaaaatttgatctagtgattttgatttgtatttccctaatgactaatgatgacaacctttccatgtgcttataagccatttgtatatttctttggaagaatgtctattcaagtcctctgcccattttttagttttttaaaattattattaatgagttttaaggattctttatatattctggacataagtcccttattgaatatatgatttgcaaatattttatcacagtctgtgggttgactcttcactttcttgatggtgtctctaaagcacaaaagtttttaactttgagcaaatctcttttgaactcttaatggagaac

SEQ ID NO: 462664 - DNA, 3102 bp, Homo sapiens
cggccaccgctcgcttcaatatggctgcccccagggagagacgaggctaccatgaaggagccgagcgcagaccctgagtccgtcacccatggatcgcagcgcggagttcaggaaatggaaggcgcaatgtttgagcaaagcggacctcagccggaagggcagtgttgacgaggatgtggtagagcttgtgcagtttctgaacatgcgagatcagtttttcaccaccagctcctgcgctggccgcatcctactccttgaccggggtataaatggttttgaggttcagaaacaaaactgttgctggctactggttacacacaaactttgtgtaaaagatgatgtgattgtagctctgaagaaagcaaatggtgatgccactttgaaatttgaaccatttgttcttcatgtgcagtgtcgacaattgcaggatgcacagattctgcattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataaatcaaagatgtttgaatggtgtcttattctgaaataacctgacctaagacaggtatttagattattttggatacattttgaaaagggatagcataaatattttaagtaaaaagacctttattttaaataatagtggatattttaatgctggaaattagcattatagttgatatgccagaaattatatctttggttgtgatttaaacttatgctataaactaaattaatgatgtaaatacatagttttaaacattcttttagggacatgtaacttttaagtatcacttcaataatacgtattattataggaacaaagatttgggaataattgattacaggtgaggaagtactggaattccagttcaaggagataccatttcatttaggactaaaaggacaagatacaagttcacatgatgggaaaaatcagaaaacctctcgcagacaaagggtatataatggatatgaggcatcaaaaagcatggtatagtcagtgatggggaatagtccagaaaggctgaaacacagcatgtgatgcgagtcaaggtagttgatgcccaactgtgaagggccgttctaatctagcatggaggtagacagtgtttccttaatatggctgcatatcagaattacctaggtcaggacgaggcatggagatgctactttaataggccctgccgcagatcttccaaaccagaatcttaatcctggagtctaggaatctttatttttcacacaactcatccaagtggttctgataaaatcagtccagcacttttagaacccactgataacagacttattcctggagacagcatttgaggaggaattgaagatttttctaatgaaaagaaaaagggtcacatgaacagatgttgcagtgtacctgtgccagggatttcatgtgtacactttataggagaataagcaagagcttagttttcttgagttataatttgccaaccataaaattcattcatttaatgtatgatttaataaacttttgtagagttctagaattgcacaactatgatcacaacctaattctagatcatttctatcatactaaaaagaaatcttacacccatttacaatcactctccattctcacccccagccctatgcaaccatgattctattttctatttctatatgtttgcctttctgggatatttcatataaatggaataatatgatatgtgttcttttctgtcaggccctttcattgagatatttttaaagtttggaggttcctccacactgtagcatgtacagtcctatttttcctttttagtgatgaatagtattccattgtatgaatgcatcacattttatctattcatccagtgacagacatttggatgtgaattgtttgtgcttttgggatgtttgtattattactgttacagacattcctgtatagatctgtgtgtggacatatattttcatgggtagatacataggaacagaactgctgagtcataagataaacctgtttaactttttaaaaactgctagcctgttttgcagatgtttgcattattatacattcccaacacaatgtataaagttcctattttaccacaaccttatcaacacttgttattgtctgtcttattagttatagccattttagtgtgtgaaaatttgatctagtgattttgatttgtatttccctaatgactaatgatgacaacctttccatgtgcttataagccatttgtatatttctttggaagaatgtctattcaagtcctctgcccattttttagttttttaaaattattattaatgagttttaaggattctttatatattctggacataagtcccttattgaatatatgatttgcaaatattttatcacagtctgtgggttgactcttcactttcttgatggtgtctctaaagcacaaaagtttttaactttgagcaaatctcttttgaactcttaatggagaac

SEQ ID NO: 462665 - DNA, 1194 bp, Homo sapiens
cggccaccgctcgcttcaatatggctgcccccagggagagacgaggctaccatgaaggagccgagcgcagaccctgagtccgtcacccatggatcgcagcgcggagttcaggaaatggaaggcgcaatgtttgagcaaagcggacctcagccggaagggcagtgttgacgaggatgtggtagagcttgtgcagtttctgaacatgcgagatcagtttttcaccaccagctcctgcgctggccgcatcctactccttgaccggggtataaatggttttgaggttcagaaacaaaactgttgctggctactggttacacacaaactttgtgtaaaagatgatgtgattgtagctctgaagaaagcaaatggtgatgccactttgaaatttgaaccatttgttcttcatgtgcagtgtcgacaattgcaggatgcacagattctgcattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataatgcctgatgcgaccaacccgcgtgtttcctgcgtgcccatgacccgcgtctccaa

SEQ ID NO: 462666 - DNA, 1192 bp, Homo sapiens
cggccaccgctcgcttcaatatggctgcccccagggagagacgaggctaccatgaaggagccgagcgcagaccctgagtccgtcacccatggatcgcagcgcggagttcaggaaatggaaggcgcaatgtttgagcaaagcggacctcagccggaagggcagtgttgacgaggatgtggtagagcttgtgcagtttctgaacatgcgagatcagtttttcaccaccagctcctgcgctggccgcatcctactccttgaccggggtataaatggttttgaggttcagaaacaaaactgttgctggctactggttacacacaaactttgtgtaaaagatgatgtgattgtagctctgaagaaagcaaatggtgatgccactttgaaatttgaaccatttgttcttcatgtgcagtgtcgacaattgcaggatgcacagattctgcattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagataacgccgagaccgtatatactgcttgtttttttgttggtcttttctttttttttttcttttttttgtccttctttctt

SEQ ID NO: 462667 - DNA, 2697 bp, Homo sapiens
gccttgctggaacgactctcttaatttccaccgctaccattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataaatcaaagatgtttgaatggtgtcttattctgaaataacctgacctaagacaggtatttagattattttggatacattttgaaaagggatagcataaatattttaagtaaaaagacctttattttaaataatagtggatattttaatgctggaaattagcattatagttgatatgccagaaattatatctttggttgtgatttaaacttatgctataaactaaattaatgatgtaaatacatagttttaaacattcttttagggacatgtaacttttaagtatcacttcaataatacgtattattataggaacaaagatttgggaataattgattacaggtgaggaagtactggaattccagttcaaggagataccatttcatttaggactaaaaggacaagatacaagttcacatgatgggaaaaatcagaaaacctctcgcagacaaagggtatataatggatatgaggcatcaaaaagcatggtatagtcagtgatggggaatagtccagaaaggctgaaacacagcatgtgatgcgagtcaaggtagttgatgcccaactgtgaagggccgttctaatctagcatggaggtagacagtgtttccttaatatggctgcatatcagaattacctaggtcaggacgaggcatggagatgctactttaataggccctgccgcagatcttccaaaccagaatcttaatcctggagtctaggaatctttatttttcacacaactcatccaagtggttctgataaaatcagtccagcacttttagaacccactgataacagacttattcctggagacagcatttgaggaggaattgaagatttttctaatgaaaagaaaaagggtcacatgaacagatgttgcagtgtacctgtgccagggatttcatgtgtacactttataggagaataagcaagagcttagttttcttgagttataatttgccaaccataaaattcattcatttaatgtatgatttaataaacttttgtagagttctagaattgcacaactatgatcacaacctaattctagatcatttctatcatactaaaaagaaatcttacacccatttacaatcactctccattctcacccccagccctatgcaaccatgattctattttctatttctatatgtttgcctttctgggatatttcatataaatggaataatatgatatgtgttcttttctgtcaggccctttcattgagatatttttaaagtttggaggttcctccacactgtagcatgtacagtcctatttttcctttttagtgatgaatagtattccattgtatgaatgcatcacattttatctattcatccagtgacagacatttggatgtgaattgtttgtgcttttgggatgtttgtattattactgttacagacattcctgtatagatctgtgtgtggacatatattttcatgggtagatacataggaacagaactgctgagtcataagataaacctgtttaactttttaaaaactgctagcctgttttgcagatgtttgcattattatacattcccaacacaatgtataaagttcctattttaccacaaccttatcaacacttgttattgtctgtcttattagttatagccattttagtgtgtgaaaatttgatctagtgattttgatttgtatttccctaatgactaatgatgacaacctttccatgtgcttataagccatttgtatatttctttggaagaatgtctattcaagtcctctgcccattttttagttttttaaaattattattaatgagttttaaggattctttatatattctggacataagtcccttattgaatatatgatttgcaaatattttatcacagtctgtgggttgactcttcactttcttgatggtgtctctaaagcacaaaagtttttaactttgagcaaatctcttttgaactcttaatggagaac

SEQ ID NO: 462668 - DNA, 3273 bp, Homo sapiens
ggtttgcgggtcaaattggtcccaatggcttaggatgcatttcaagggtgaacctgttgatgcatgttcagatgtgtctggagtttcttccttcttgtgggttcatggtcttgctgacttccggagtgaagccacagaccttcgcagagtgaaactgcagacattcacagtgagtgttacagctcttaaaggtggcgcgtccagagttgtttgttcctcctggtgggttcgtggtctcactgactttaggagtgaagccacaggccttcgcagtgtgttacagctcttaaaggtggcccatctggagttgtttgttcctcccggtgggcgagtggtctcactgactaaaggaatgaagcctcagacctccgcagtgagtgttacagctcataagggtagtgtgggcccaaagaaaggaatggaaatcaagaatgtgattcatatgttaagtgtgaaatgtctgttaagacacctgtttttgtctgctagcgttgacataacaatataacacagactgggtagtataaacaacagaaatttatttttctcacagttaggaggctgaaagtccaggatgaagggttatatatgtttctgtagtttgtggagccaaacagatgatctggttacccacagtatcaaaatgtaacaagttttattttcttacacattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaaattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataaatcaaagatgtttgaatggtgtcttattctgaaataacctgacctaagacaggtatttagattattttggatacattttgaaaagggatagcataaatattttaagtaaaaagacctttattttaaataatagtggatattttaatgctggaaattagcattatagttgatatgccagaaattatatctttggttgtgatttaaacttatgctataaactaaattaatgatgtaaatacatagttttaaacattcttttagggacatgtaacttttaagtatcacttcaataatacgtattattataggaacaaagatttgggaataattgattacaggtgaggaagtactggaattccagttcaaggagataccatttcatttaggactaaaaggacaagatacaagttcacatgatgggaaaaatcagaaaacctctcgcagacaaagggtatataatggatatgaggcatcaaaaagcatggtatagtcagtgatggggaatagtccagaaaggctgaaacacagcatgtgatgcgagtcaaggtagttgatgcccaactgtgaagggccgttctaatctagcatggaggtagacagtgtttccttaatatggctgcatatcagaattacctaggtcaggacgaggcatggagatgctactttaataggccctgccgcagatcttccaaaccagaatcttaatcctggagtctaggaatctttatttttcacacaactcatccaagtggttctgataaaatcagtccagcacttttagaacccactgataacagacttattcctggagacagcatttgaggaggaattgaagatttttctaatgaaaagaaaaagggtcacatgaacagatgttgcagtgtacctgtgccagggatttcatgtgtacactttataggagaataagcaagagcttagttttcttgagttataatttgccaaccataaaattcattcatttaatgtatgatttaataaacttttgtagagttctagaattgcacaactatgatcacaacctaattctagatcatttctatcatactaaaaagaaatcttacacccatttacaatcactctccattctcacccccagccctatgcaaccatgattctattttctatttctatatgtttgcctttctgggatatttcatataaatggaataatatgatatgtgttcttttctgtcaggccctttcattgagatatttttaaagtttggaggttcctccacactgtagcatgtacagtcctatttttcctttttagtgatgaatagtattccattgtatgaatgcatcacattttatctattcatccagtgacagacatttggatgtgaattgtttgtgcttttgggatgtttgtattattactgttacagacattcctgtatagatctgtgtgtggacatatattttcatgggtagatacataggaacagaactgctgagtcataagataaacctgtttaactttttaaaaactgctagcctgttttgcagatgtttgcattattatacattcccaacacaatgtataaagttcctattttaccacaaccttatcaacacttgttattgtctgtcttattagttatagccattttagtgtgtgaaaatttgatctagtgattttgatttgtatttccctaatgactaatgatgacaacctttccatgtgcttataagccatttgtatatttctttggaagaatgtctattcaagtcctctgcccattttttagttttttaaaattattattaatgagttttaaggattctttatatattctggacataagtcccttattgaatatatgatttgcaaatattttatcacagtctgtgggttgactcttcactttcttgatggtgtctctaaagcacaaaagtttttaactttgagcaaatctcttttgaactcttaatggagaac

SEQ ID NO: 462669 - DNA, 339 bp, Homo sapiens
tcgggagccttcagggatgcgctgccagctgcgcccgggcgtttctccggacctgttgtgccagatcggaaagcgggttggctgtgcgcgggaccaagggggtggccttcggggagaacccccgagccgcaggcacctgctcccagtcccccttcttcccggtggctccacctcccggtgtaaggctttgggttctgtgccctgacaggttcacaggcgcctttcttctgagaacgaccctggccttgaacgtcagagccggggacgaaggcccccggaggctgctgcgagctccgcgcgttccttcgcgcccttccgcgccgctcgcgccggcgccgg

SEQ ID NO: 462670 - DNA, 2711 bp, Homo sapiens
caacttcgcggacagcggagctcgcccagcatggatgttccaggttcacaggcgcctttcttctgagaacgaccctggccttgaacgtcagagccggggacgaaggcccccggaggctgctgcgagctccgcgcgttccttcgcgcccttccgcgccgctcgcgccggcgccggcctccacccccgcgcgccgcctcccaccagtcccgatgcaggcgcccggccgggggccactcgggctgcggctgatgatgcccgggcgccggggggcgctgcgcgagccgggcggctgcggatcctgcctgggggtggcgctggccctgctgttgctgctactgcccgcctgctgccccgtgcgggcgcagaacgacacggagcccatcgtgctggagggcaagtgcctggtggtgtgcgactccagcccgtcggcggacggcgccgtcacctcctccctaggcatctccgtgcgctccggcagcgccaaggtggccttctccgccacgcggagcaccaaccacgagccgtccgagatgagcaaccgcaccatgaccatctatttcgaccaggtcagccgtcggcctgcccaccccgcccccagcccggggagaggggcggggacctgcgcgcgcgggctggggttcaggcttcttggacgtggagttcccaggctctgtcctccccctctgccctgctagtctctttcctcccgtttcatagaacgcactcctactctttcccttttccacattttggctttttaaaaacttttaaatgatcagctaacttggcacttggatgactgagagtcccttaaggctgtctaagctttctaagagttccaatgctgaggatgctgaatttgtgttcccagccgctgatgaaggaggcagtgttgctggttatccaaggatgatgaaaacatacaccgaggaggggcttgccattgtgtgctgtgttccctcttctttttcagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagccccctagatggtgggggaatggcaaactggacccaggactccgccctttaaaacaccctgaacttactggaattggacaccttgtttccaacctccgtcagactgttgcagtagaagaatgatttcctttgaaacctccagtacttttgtttttgttttttggaatactgacaattcctcgggaacctggcctctaattagttttagatgacaaggtcttaaggagaaatgaaattatcgatttgagcaatttgtacctgtgattgtaaagtcaatatcggattttattgttgggaccatggacctcttttgtttgtatgttgtattgtcgtcccaacggaaggagagctcctgactccaggatgggctgcaggttgcagtcagggcttgaagtaggagcccagcaaagaaccacctgctggacagtccttgacatgtgttctgtgtgtgtctgtatagccttaagaaaaagaatggcttcactttcattctgtattcttccccccaccatgtggctgggaggacttgggagggggatggggacattggggaacctgtcaagaagtgctttatccagagaagcaaattttgcacgattgggactgcaatttttgttttgtattgtttgtgttttttcttgaaaagctttacttttctttccacactcagctctccctcctcaaccccacttttatttttcttgctggggttgaggagagaaaatatagaattcctggataagaccaaacaaaacaaaacattaaaatacctgtatgttttgttttagacgagaccaaactaaacaaaaagtatctgtttatcaaagtaaaagtaacacaatggacaattctgcttattctctcaaagagattctaagatgcacctttagaactattaatagcaacctgcatttttttttaatttatacttcagaatcctttaagaacctggtgttcctgagtggtcctgaatcatataagttggtaatggaagctgtaatgaccaagtcccctaaacatactatgtctttgccacgtgtgctgtgacttctctgtgggtgatttaatttatttggatccacctctgatcttagcaagaggcaaccaatataaataatgataattttccatgaaaaacacaacaataaagatggggttttagattgtcatatttggtgttttcccatgtctgcatgcatgagtttgtgtgtttgttcctactatttttttccctccttgtgttttacttctggacaatatttattaaaatatttttaaatccctggttcttattttgactatgttgaattaactgatgagtctatgaaaggcatttttcatctgtttctatttttcattttaatatttttatttgaggctttattataagttttctgtgatgaaattacccctatgatctattacagatatatccatagactccaaccagacactgaatctgcc

SEQ ID NO: 462671 - DNA, 1324 bp, Homo sapiens
cgtcccttctctgcagatcagacgggcaggtcagacagctggcgtctgcagaatctcagggagtcgcacgcacctccccttggcggcccacagatggcgctggctccacgcgctgcagcggcgggaagccggaggtgggaaaacccaagctttagccccctcccctgtctggctgctgggatggggaaactgaggctcaggaaggcgatgcggctcacccaggttcatagagccagaaaatggcaaggctgggatcggagacaccaggcctgctgctgttgcccaacctcaaaaaacgaaaacgggaagtttttgtcaacaggagcgtgggaaccggaaatccttgcttccgataccggaagtcagagaccacacatttgcagggagcgaaattgaggtcccagtgcgggggcctgcagaaatccaggaataggactcagggatctagggctgggatgttggtggttctgagcgcccaggaaataggagagacaggatcatctggtttagctgctcattataattatcctgtgaaagaagatgtacaaatactactgtataaagaagtacaaggcttgtacattgaaaattatgaaacattgttggaagaagttaaagatctaaagaaatggaaagacatcccatgttcatgaattgggaggcttagtattcataagatagaagtactccccaacatgatgaatttaacatagtccctaccacaagcccagttaacttttttgcgtaaattgacaggatgaccctaaaatttatgtggaatggtagaggattcacaatagtcaaagaatcttggaaaagaagaaccaacttgaagactcacatttcctgattttaaaacttactacaaagctacagtaatcaagacagtgtggtatgggcataaggattagacatatagcccgatgaaatagaatcaagagtacagaaataaactcttacatttatggtctatagattttcaacaaggatgtgaagacaattcactggggagaaagaatggtctatttaagaaatgtttctgggacaactgtatttcagcatgcaaaagaatgaagttaagcttctgcttggggcctggaagggtgatgtggctgtggcatcgccggcctcgctatgtctgccattttcaatattcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgaagtatgctgtatagtaa

SEQ ID NO: 462672 - DNA, 1192 bp, Homo sapiens
ccttaccacattgtttacactcataaggtttctctccagtgtgagtcctttcatgtattcgaatggaactggaacaactaaacgccttaccacactgtttacattcatagggtttctccccagtgtgagtcctttcatgcattcgaaaggaactggaacaactgaaggctttaccacattgtttacattcatagggtttctctccagtgtgagtcctttcatgcatccgaaaggaactagaaaaactaaaggctttaccacactgtttacattcatagggtttctctccagtgtgaattctttcatgcattcgaaaggaactggaacaactgaaggctttaccacactgtttacattcatagggtttctctccagtgtgagtcctttcatgtattcgaacagaactggaacaactgaaggctttaccacattgtttacattcatggggtttctctccagtgtgagttctttcatgcattcgaaaggaactggaacaactgaaggctttaccacactgtttacattcatagggtttctctccagtgtgagttcgttcatggatttgaaaagaactaggacaatcaaaggctttcccacattccttgcatttataaggtccatttccagtgtgcattatcatatgtcttcgatagcttggaagagaaatgaatgctttcccacattccttacaatcatagggtttctctcctgtatgaattctttcatgttttctaaaggaactaggaaaactgaaggctttcccacattttttacatttatagggtttttctccagtgtgaatcctttcatgacttcgaaaggatgtgggacaactaagagctttaccacattgcttacactgatagggtttttccccagtgtgagtcctttcatgtatttgaaaagtttggtaatatctgaaagcttttccacattgtttacattcatagggtttctctccagagtgagttctttcatgatttcgaaaagaactgggatgactgaacgttttcccgcattctttacatttatagggtttctctccagtatgagttctttcatgtatttgaaaggaactgggccaactgaaagccttaccacactgtttacatttatagggtttctctccagtgtgagttctttcatgtattcgaaatgaacttcgaaagctgaatcttttcccacattcctt

SEQ ID NO: 462673 - DNA, 2665 bp, Homo sapiens
atggtagccctccgtaatccttgaagcatacgttccaagactcacagtggatgcctgaagctgctgatagcgcggaccccagccccctcctcggcgcggacttcaacctcagtccgggcttctaccccgacccggacaccgactccactccggaccccgactccggtccggactcggacccccatccggaccctgactccagtcctgactccgtctccagccgggacttcccctctggtcctgactcctgctccagcccagattcccactctggtccccactcccgctctggcccggatcccccgtctggttccgcctcctgctccggcctggatccctactccggtgccgactcccgttcccgtccggaacccaactccggtcccgactccggctcggaccctgactcctccaggattcgggccgcgctccccgtcttggactcctacctggccccggccctacctttggatccgcccccggaacctgctccggagctgcctttgttgcccgaggaggaccctgagccggcgccgagcctgaagctcatcccgtcggtctccagcgaggccgggcccgccccggggccccttcccacgcgcaccccgctggccgcgaactcacccgggcccaccctggacttcaccttcagggcagacccgtcggccatcgggctggcggatccccccattcccagtcctgtcccctcgcccatcctggggaccatcccgtcggccatctccttacagaattgtacggaaaccttcccctcctccagcgagaacttcgcgctggacaagagggtcctgattcgagtgacctactgtacattctactgaaaaagagcctggagcagcaatttccgaatcacctactctttaggggtgatggctttgtgaacgagtccaggctgcagaaaattgtgagcgttatcgatgaggaaatcaagaaaaggtagccggcaaggggtggagctggaggagtctcagctggatgatgagaagggctgaaatgttgccaagtcaggtccttttctgatggtggctggggctggggtgagctcagggaggggaagaggagaatacatgcagagtcagcacccctgtgtccagtctgactgtgtctgctgtcgccacactcacctctgaggtctgtggaagtcacctgatattctggccccaggggtgggagggaggggagcttggaaggctagtcctgtagctccagtcctctgtctggcctccactcctcttgctcctgagggcagtttgtttcttttgtggattcgtcatttcccatgccctggttccagatacattttgaaaaccttccatcttattggcattttctggggttgtgagggaaacggggatggcagtcagactcaaacccgtgacactccaaactcgattatgctccagggcccactttctaaacctgtaagatctatgttccagcctgcgcaacatagtgagaccccaactctacaaaaaataaaaaattagccaggtgtggtggtgtgtgcctgtggtcccagctatttgggaggctgaggcaggaggatggcttgagcccaggaggctgcagtgagccatgattatgccactgtattgcagcctggacaacagagtgagatcctgtttcaagaaaaaaaaaaaaaaggaaaaaaacccataggttttagaatgccagtgttgtagggagcgtctctgtgacctggggctggaggagaggcattttcacattcattggacatttatgggctccgtactctgcacctggcatggtggggtcagtggtcacatgccaggaggtcaagggcaaaggcagggggggctcagactttaccacttagttgctgtgtgaccaccaccaagggacgccacctctctgagcctccatttcctcctccataaaatagacgtcatagcactatttaacttgtggaatttttgtgataattacatactaaattatgcttgggaaaggattagcagaaggcttatcacagaattagtaagtttcagttagtagtagatttcagttaagagtgcttttgcctactagtaacagcagacttgactgccaatggctcacacagcagacttgactgccaatggctcacacagtagaaaacacaaattctgttttgtttgttttttgagatggagtctggctctgtcacccaggctggagtgcaatagcacaatcttggcttactgtaacctctgcctccctgggtttaagcaattctcctgcctcagcttcccgaatagctgggattacaggcatgcaccaccacacccacctaatttttgtatttttagtagagatggggttttgccatgttggacaggctgatctcgaacgcctgacctcaagtgatccgcccacctcagcctcactgctgggattagaggcgtgagccacctcaggcctgatgttttcaacacctgacaggataatgtgctggccctgtacatacaaatgatatgctggtgtgagtaggaaataagttatctatcatgcctgctaagacagagtgctggagggtaggggaaagtcccaaaacatatatggggtttgtctcagtgaaatctgtatgtgtcaagcagtataaaacatgagaggatatttcctatgtgaaagatactttccaccccct

SEQ ID NO: 462674 - DNA, 1258 bp, Homo sapiens
cctaaataaatgacagtaccattaataaaagaagcagcatttaggattgcggcctccgaaggccaggaactattcaaggctgagacccagcatccagttaaaaggaagcttccctgtttcttccagctgtccttccatcattttgttcttttccgtcattcccaagcccctgctgctgtggggcccatcactgcttctccacctctattgcgagctccaagaattactgggcacacacagttttgcccctttacaaacgcctcctgtggattatttgaggacttgcgtttcagatcagatgatgcttttcatgtatgtccagcagcaagagagtccttcactggtgaaaaatcacgggcctcagagcagattttagttcatctttcatttcaaagcactccttagatatctgcaaattaaatcccctaatttgcttttcagttaggaagtcagagagaaggaaagagaactatttccaattcaatcacgagcatgtctacgcaccactgaagacagacctttgtcctgttgctttccaaactttaaatgtgaatttttcttcttatgatgactggtgtactctgttattctgaaaaaagaaaaagccataagcaccctgaagtgaggctttcacctgatactaattttcttcttcgttataaggctattgtttgtttgaacaaagaaataggagccattggtggctgtttacattataggaatgagggcagcgatgggggaggaggaggggaccttttcattaatgagctggggacattgattatggggacacactaaagactaaaagggacacctatatttctacattctttccatgcaagtaatatatgatctttatcatctgttaaacaccactcacatatttcaggtggctgtaggttgattgctaacatttagattaaacaagcagttagagtctgatgtttaaaataaaataagacaagcccttgaactctgggaccaggtatgccccgttatctggtcgtacctgaacgagcctgtgttgagcacccaaggccgctgggcacgtctgtggatgtggggtttcaggctcaacccactcgaggagcagggggcttttgggaggtggcagcctcctatacaaaacgagctgccagtaaatatttatagaacaaagaaatgcatgaatttctcctgaattaaacatgatacatttgtacagagcatagttcactttcatttcagtgacccaaaatcctgctgaaagtgttcttcc

SEQ ID NO: 462675 - DNA, 1129 bp, Homo sapiens
acgtgggagcatcccgtaggggacttgcgtttcagatcagatgatgcttttcatgtatgtccagcagcaagagagtccttcactggtgaaaaatcacgggcctcagagcagattttagttcatctttcatttcaaagcactccttagatatctgcaaattaaatcccctaatttggtgaggacgcccagcttcccaaataacaaggcttttcctttgattctaaccaagtgagccggccctgcaaaagccggggtgcgtgttctggctccaggcttctgagcagcctttctccccacgctgcagcttttcagttaggaagtcagagagaaggaaagagaactatttccaattcaatcacgagcatgtctacgcaccactgaagacagacctttgtcctgttgctttccaaactttaaatgtgaatttttcttcttatgatgactggtgtactctgttattctgaaaaaagaaaaagccataagcaccctgaagtgaggctttcacctgatactaattttcttcttcgttataaggctattgtttgtttgaacaaagaaataggagccattggtggctgtttacattataggaatgagggcagcgatgggggaggaggaggggaccttttcattaatgagctggggacattgattatggggacacactaaagactaaaagggacacctatatttctacattctttccatgcaagtaatatatgatctttatcatctgttaaacaccactcacatatttcaggtggctgtaggttgattgctaacatttagattaaacaagcagttagagtctgatgtttaaaataaaataagacaagcccttgaactctgggaccaggtatgccccgttatctggtcgtacctgaacgagcctgtgttgagcacccaaggccgctgggcacgtctgtggatgtggggtttcaggctcaacccactcgaggagcagggggcttttgggaggtggcagcctcctatacaaaacgagctgccagtaaatatttatagaacaaagaaatgcatgaatttctcctgaattaaacatgatacatttgtacagagcatagttcactttcatttcagtgacccaaaatcctgctgaaagtgttcttcc

SEQ ID NO: 462676 - DNA, 653 bp, Homo sapiens
gaagtattcctatccatccactatgcttcacagtgggaatctctcactgttcatcaccgctgccctagcagctcgcagggattcttcacccatggttgcttaggtttataagcaaggaagctgaatgaagtccctttcctctctggatgagcccctgggtttctggaagagtcttaaaatcacccctaaatggcttccaagcactgaagcccgagatgttagctggcctgtgtgaggccttgagacagaatgccacagccacaccccaaggatgctgaaggggatttccctcctctgtggtttttctcctttcttcccgcagcactcctcctacgtgctaacatcttctagtcaaacaactctccttttcaaagggaccaggcacagtttctgcttatccctgagtagcagtgttcagtttcctgccagcctgtggagtttttcaaacaagccaatcacctcctcctgtgggaactgagaagcaccccaccctctcgatactacaaagcccctgcttgttccctagtgcaactcccatgtggtcctgtggagcatatggtatcttcctcttctgggcagtgagcatatgtgactaataaactatctatctcatctgttcagtgccaggtgtcatttgttctgccatcccatga

SEQ ID NO: 462677 - DNA, 995 bp, Homo sapiens
cagagctgcttcacatgaatgtaatggttcccattcagaaccctgtgacctctgctttagtaacccaggactcaccagtgttcctcaaagctcactatgacttttcattaagtcaagcttctgcatgtgctattttctctgccttgcaaaccctttcccttgctaggcaaattcacacttgttcccacataaaagatgatctcctctgtgaagcctttgccaatgccagtgctttgtaccacatgccctgctttggtgtacaatttgaaatgccgaaagcactcactgaaaacttaagccaatccacaaaatatggctctgagaatccttcccataatggattcagttatagtttcatcattctaggacttataaaccccagtgactatattgctgggaggactgagctgactttcgaaaggattcttcacccatggttgcttaggtttataagcaaggaagctgaatgaagtccctttcctctctggatgagcccctgggtttctggaagagtcttaaaatcacccctaaatggcttccaagcactgaagcccgagatgttagctggcctgtgtgaggccttgagacagaatgccacagccacaccccaaggatgctgaaggggatttccctcctctgtggtttttctcctttcttcccgcagcactcctcctacgtgctaacatcttctagtcaaacaactctccttttcaaagggaccaggcacagtttctgcttatccctgagtagcagtgttcagtttcctgccagcctgtggagtttttcaaacaagccaatcacctcctcctgtgggaactgagaagcaccccaccctctcgatactacaaagcccctgcttgttccctagtgcaactcccatgtggtcctgtggagcatatggtatcttcctcttctgggcagtgagcatatgtgactaataaactatctatctcatctgttcagtgccaggtgtcatttgttctgccatcccatga

SEQ ID NO: 462678 - DNA, 1231 bp, Homo sapiens
tgccatgattctgaggcttccccagccatgtgaaactccatttgcaccagacctggattcctagcgtctccatctggagtgcggctggtggggggcctccaccgctgtgaagggcgggtggaggtggaacagaaaggccagtggggcaccgtgtgtgatgacggctgggacattaaggacgtggctgtgttgtgccgggagctgggctgtggagctgccagcggaacccctagtggtattttgtatgagccaccagcagaaaaagagcaaaaggtcctcatccaatcagtcagttgcacaggaacagaagatacattggctcagtgtgagcaagaagaagtttatgattgttcacatgatgaagatgctggggcatcgtgtgagaacccagagagctctttctccccagtcccagagggtgtcaggctggctgacggccctgggcattgcaagggacgcgtggaagtgaagcaccagaaccagtggtataccgtgtgccagacaggctggagcctccgggccgcaaaggtggtgtgccggcagctgggatgtgggagggctgtactgactcaaaaacgctgcaacaagcatgcctatggccgaaaacccatctggctgagccagatgtcatgctcaggacgagaagcaacccttcaggattgcccttctgggccttgggggaagaacacctgcaaccatgatgaagacacgtgggtcgaatgtgaagatccctttgacttgagactagtaggaggagacaacctctgctctgggcgactggaggtgctgcacaagggcgtatggggctctgtctgtgatgacaactggggagaaaaggaggaccaggtggtatgcaagcaactgggctgtgggaagtccctctctccctccttcagagaccggaaatgctatggccctggggttggccgcatctggctggataatgttcgttgctcaggggaggagcagtccctggagcagtgccagcacagattttgggggtttcacgactgcacccaccaggaagatgtggctgtcatctgctcaggatagtatcctggtgttgcttgacctggcccccctggccccgcctgccctctgcttgttctcctgagccctgattatcctcatactcattctggggctcaggcttgagccactactccctcatcccctcaggagtctgaacactgggcttatgccttactctcagggacaagcagcccccatt

SEQ ID NO: 462679 - DNA, 1315 bp, Homo sapiens
ggaatcactccacccaactctgtggacacaatgggctgtcagatggcggggaggggcgggggcagttctacactctccttggagccaaaccttctgctccctgaacagaacagaggcacattgagactaacaacccgtctctttgcagcgtctccatctggagtgcggctggtggggggcctccaccgctgtgaagggcgggtggaggtggaacagaaaggccagtggggcaccgtgtgtgatgacggctgggacattaaggacgtggctgtgttgtgccgggagctgggctgtggagctgccagcggaacccctagtggtattttgtatgagccaccagcagaaaaagagcaaaaggtcctcatccaatcagtcagttgcacaggaacagaagatacattggctcagtgtgagcaagaagaagtttatgattgttcacatgatgaagatgctggggcatcgtgtgagaacccagagagctctttctccccagtcccagagggtgtcaggctggctgacggccctgggcattgcaagggacgcgtggaagtgaagcaccagaaccagtggtataccgtgtgccagacaggctggagcctccgggccgcaaaggtggtgtgccggcagctgggatgtgggagggctgtactgactcaaaaacgctgcaacaagcatgcctatggccgaaaacccatctggctgagccagatgtcatgctcaggacgagaagcaacccttcaggattgcccttctgggccttgggggaagaacacctgcaaccatgatgaagacacgtgggtcgaatgtgaagatccctttgacttgagactagtaggaggagacaacctctgctctgggcgactggaggtgctgcacaagggcgtatggggctctgtctgtgatgacaactggggagaaaaggaggaccaggtggtatgcaagcaactgggctgtgggaagtccctctctccctccttcagagaccggaaatgctatggccctggggttggccgcatctggctggataatgttcgttgctcaggggaggagcagtccctggagcagtgccagcacagattttgggggtttcacgactgcacccaccaggaagatgtggctgtcatctgctcaggatagtatcctggtgttgcttgacctggcccccctggccccgcctgccctctgcttgttctcctgagccctgattatcctcatactcattctggggctcaggcttgagccactactccctcatcccctcaggagtctgaacactgggcttatgccttactctcagggacaagcagcccccatt

SEQ ID NO: 462680 - DNA, 984 bp, Homo sapiens
ttctctctgtgacgtcacaaaggccccgccatgcctctggctttgacccttctgctgctctcgggcttgggcgcccccggaggctggggctgcctgcagtgcgaccccttggtgctggaggccctgggtcacctgcgctccgccctcatccccagtcgcttccagttggagcagctgcaggcgcgcgccggggccgtgctgatgggcatggaggggcctttcttccgggactacgcgctgaacgtgtttgtggggaaagtggagacaaatcaactggaccttgtggcgtcctttgtcaagaaccaaacgcagcacttaatgggtaactctctgaaagatgagcctctgctggaagagctggtgaccctcagggcgaatgtgatcaaggaattcaagaaagttttaatttcatatgaattaaaagcctgcaaccccaaactttgccgcttgctaaaagaagaggtgttggactgtttacattgccagaggatcactcccaagtgtatccacaaaaagtactgctttgtcgaccggcaaccccgcgtggccctgcagtaccagatggacagcaaatacccgaggaaccaggcgctgttgggcatcctcatttctgtgtctctggctgtctttgtcttcgtggtcatcgtggtctcggcttgtacatacagacaaaaccgaaaactcctgctgcagtaggacggtggtttgggggtaaggagaaaggaaaataaatttaataaaattggtgacaaatccatcaatgtctctgtccatttcctggggaccctccccctagttggtgtccaactctgtttctctacctgactgggtgctcctcaaaggctgggaccagatcccactcatctgtagacacccattatcctaattcaaggtagaagtgacttggaccttcaaaaaggatggacagcatattgtaagggtttgaagtgacaaccacttatcctctgggaaggaaatgcatcc

SEQ ID NO: 462681 - DNA, 488 bp, Homo sapiens
atgaaatttaggagaagccaagggaccccatctcctctttctccttcttcctttccacccttgccggtcctctgatatctgcccttgtcttacttctccctttccccttgcctaggcttgctaaaagaagaggtgttggactgtttacattgccagaggatcactcccaagtgtatccacaaaaagtactgctttggtaagcttctgggggtgggggaagacatgggacaggcgtgcaagagatgaagacagccatgacccactagatatgggtttcgaggctcccacatgcagcctcgaatcctgccctaaccatttgcttagagtgtggcccagaagttgctcctgtattctgaaattcactttcctccatctgttaaatggaaagactccctggaactttagaatgcccctagctccagaatggcaggtgctagaaaaagattttattcttagccattgctatacctggggaatttggaaggatg

SEQ ID NO: 462682 - DNA, 572 bp, Homo sapiens
cagggaacaagcaggaagagaagaagagagagcgccccacccccacccctgccccaggctgctgaatgaacaggtggggtgggtatggggctaaggaggggtggtgacgtggaggtcggggctgtttccccacccgccccagtcgaccggcaaccccgcgtggccctgcagtaccagatggacagcaaatacccgaggaaccaggcgctgttgggcatcctcatttctgtgtctctggctgtctttgtcttcgtggtcatcgtggtctcgtgagtcatccttgccccctcctcagtcccccgtggaacccactgggcccctcaaaaatggcgactcccctggatgggtcactgtgtactttgggagtctcctcttcagtcactttagtctctgtctctctttttctctctgtctctctcctccctcttctccctcccgccccctgccccgtacctttctctcatcttatttctgtctttcttcctcattttcctttttctccacctctgggccacattacaactttcccgggtcctcagcacttttgcctttgtgggcctcttcttacatta

SEQ ID NO: 462683 - DNA, 763 bp, Homo sapiens
gcgggatccgggctccggctcgacgccggctctctttttgacgccccgccgccggggttgccatggttcatttcttgcacccgggccacacgccccggaacatcgtccctcctgacgctcagaaggatgccctgggctgctgcgtggtacaggaagaggcatctccctacactttggtcaacatctgcctgaatgtcctgattgctaacctggagaaattgtgttctgaaagacctgatggaacactgtgccttccggagcattggagtttccctcaggaagtagccgagcgatttctcagggtgatgacttggcaaggttgctggaggagccagtatgagtcagatttcagaagcactgagccgatacaggaacagatcatgttttgtgaaggaagccctccacaggctgttcacagagacattttcaatggaggtaaccatgcctgctattttaaagcttgtggctataggaatgaggaatcacccattggatttgcgagtgcagttcacagccagtgcttgcgctctcaacctaacacgccagggcctggccaaggggatgcctgttcgcctgttgtcagaggtcacctgtctacttttcaaggctctgaaaaatttcccccattaccagcaggcagaggaccctgcggccttccgcagtgtttgtgtccctgggtacttgagattagggagtggtgatgactcttaacgagcctgctgccttcaagcttctgtttagcaaagcacatcttgcaccgccc

SEQ ID NO: 462684 - DNA, 907 bp, Homo sapiens
ggcaacccccaagatggatccagtaagcggtgccaaactcccgcaaggaacaggcactaggacagaggccacggagacagggccactcaagcacacccacagcaaagagctggctctgcttgacaagtggcagtttccaaagctatcgtgctcagatgtaatccaaagacatgcaggagataaaagcacagcaggcagtgcctacagtctatgtggaaatctgggcttcgcagcccaggcttgccagccaggacccaaaaaccaggcgcgtcttccccttcacaagcactgcaatgcagcaaccattgacctaactatgcttccttctccaggtcatctcaagcagacccctcactctgaagcccccggatccaagcaggatgagctgccaactcagcttgctctgacttgacttggctcatgatccgtggaagacatccctacctgacccgtcgatcagcccgaaacttcaacatctttttggcagctccgtccccagtttggcagcctcagaggacccgccggccaccctgatcctaccatgcctctgagaaagatccttcagatcctgtgggcataagggttaaatgaagctcccgattcatctgctgttattgctgccgctgctgagaagctgagattgattgagcagttctcccttctcttcggtcagcctgcccagccttcttctgtgtggacaggagcataatgaatgaaggtcctctgcccctgtccctccgacttgctcccctcagacagcacggggttgctttccctccctgtgtggcagtcctaccgatgagaagcaagtcgaccagatgggcgtggatgctgtggaaccagagctggtggctaggatggggctgctcaggcaatattaaaggagagcttcctctcaaggcttgca

SEQ ID NO: 462685 - DNA, 898 bp, Homo sapiens
ggcaacccccaagatggatccagtaagcggtgccaaactcccgcaaggaacaggcactaggacagaggccacggagacagggccactcaagcacacccacagcaaagagctggctctgcttgacaagtggcagtttccaaagctatcgtgctcagatgtaatccaaagacatgcaggagataaaagcacagcaggcagtgcctacagtctatgtggaaatctgggcttcgcagcccaggcttgccagccaggacccaaaaaccaggcgcgtcttccccttcacaagcactgcaatgcagcaaccattgacctaactatgcttccttctccaggtcatctcaagcagacccctcactctgaagcccccggatccaagcaggatgagctgccaactcagcttgctctgacttgacttggctcatgatccgtggaagacatccctacctgacccgtcgatcagcccgaaacttcaacatctttttggcagctccgtccccagtttggcagcctcagaggacccgccggccaccctgatcctaccatgcctctgagaagtaagtcctctggtccaactcgtaaggctgtggcagagatgcagagtgattggtggcagagtctctagcagttctccctcctcctggctctggctctggagaaccaggagggcactctccttgggtggtggtaggggtcgcctaggtgccctagtaggcctgtggcttcctggtattcggccagaatgctactggtcagaggactggaggcagaataaacaaggaggggatgatatcctccccattcagcaccccaaggagaaaatgctgaaatggagagacaggcatacacggagcaggtgtagcactcccaggtagtccgacctcagtgagctaaggacgca

SEQ ID NO: 462686 - DNA, 4149 bp, Homo sapiens
aaaggtgtcattggctctaggccctggtgcctactctgctcgacagggtgtttgaagaaaccacagaaatgaaacggcgctgatgcccttgcctcttctggtggccacctgcactgcctggctggtggtcctgtcttctgtcttccaagcatattactctgatttctgcttccgtcgtcacatcacctttcctcttacaaagactctggtgaagaaccaggcctgcctgggtacacaggatcatctccccacctcgagctccttcacacagtcccatctgcaaagtcccttttgccacctaagaaatggtgtttggcacctagcaaatcagccggggaaagtacaaaaggccctgcatctcataaaagatgcatttagcacaggtttctatttcagagctaatggcattagctgttttgtagaaagtaagaaagcacaattaccctgttttaataacatggttgacagcacagctctaatcctgggggattctgggtttacattttgaggtttctgtagcaagcgagttcttagtaccaagctagcgtgtagccttatgtgccagtttgcctaaaacactcctggcttatacctcatgtttattaatagcaccctctttcaccttctagtgtcccagtttgggcaataaatgacacaatcaccttagtgacacaaaactgagaacgctaagcccatgcttgatggagcagctccccaccagctccttagagaaatccatccctagcaaaaaaagaattcaccaaatctcagactgtgccccttcacccattaatgtttgaggccatggacagtggttggggaatagaaaaccttccggtgaaagcgaatatattgctccaattcagtgtttaattgtttaaaaaattacaactgtacaagtttgttttggacaattcaaaggaataatggcaatgctctcagttgtcctactgctttaggttaaattctagaatcatcttgtcaatgtttacagaaaatctgcttaaattttgatctgattaaatgtgtagattaatttgggagaattgaagtttttacaacattgagtcatcaaactatgactcagtggtgcatgtcttcatttgtttaggttcctttcctttctgcccgtctcatagatttctgtagagtggtcttaagggctttttgttagatttattccttgttatttgatatattttgatgttaatgttatagtttcttaaagtttattttgttccacatccagtaatataatttacattttaacgtgtaccttatgcttatgtagcaacattgctaagtttattctaataatttatctgtatacttttcttttgggattttctaccacaatcatgccaactgcaaatagtgacaattctatttttctatttcaaacctcaaatcttgtctcttttacttccagtataatgttgtatagaaatgatgatagtggccattcttgtctcattcctcatcttaagaggaagctttcaatatttcatgaatgttgtgaaggatgttttctgtaggctttttaatacaaattatttatcagattaaaaaaattctctttattcttatgacactttttgagatgtgaattaaggtttggcaaagggacaatttttgtaatgttctctgtgttttttttttttttctgaagagaatgtatacgctgtacttgtcaggcacaactgatccattatatatgtctgttagtcaatatgttaattgtgttcaatttttctgtattgcttgctttttgtttagtttttcacttctgggtttagttttttgcagtttgtcaattttttgctcatgtttggaggcttgttaaattgatcattttgttattatgaaggatgtttttgattgctagaactgggtttttttttttttaatttttaagtctactttgtctgatagcaacatagtatactagctttctttacaattcttttttctctcctttcctgatatcttttggattgattatttttatactcattttcccttcctattagtatggtgattttgtacgcttttataaactttcagtggttatacaagagattgtagtatgtatcctcgacttattaatgtctaatataaattaatccttctatttttccctggacaatgcaaggaccttagaacattttaattccattgttcttctttcaacttctaagctatttttgctctgtattttatttctatatatactttaaatcctacagtgtatcactgacctgttaatataagataaattaatgttaaccattagtaattatgaattcatagtcaacattaagttatatttaatttagacttagccacaattaaccttttcacagctctttgttcgtttccatggctctgagcttccacttggcttcatttttctcctccttgaagaaactccctttagtgtcttcttgatgtgtctgctggtattaaattttcctagatttctttggtctgaaaatttctttatttcacctacattattgaaggatattttcaatgcatatagagttccacatggcaattattctctttgagcactttgaaggtctcattcactgacttctggtttccctagttggcgttgaagtcagatgtgggtctctgttgttgtactgaaagttctttgttttctcctcatcctgacttctacagctgcttttaagactttctctgttattggttttcagcttattactatgataagcctaggtatgattttctttttatttatcctatttagggttcattgagctttttaagtgttaatttacacagttgcaaagctgtattgatcaaggttcttcagaaaaacagcgccaatcggatatatatagacatagaagaggagattgattatgggtcttggtttgcatgattacagaagccgagtagccccatgatctgctgtctgcaagctgaagacccaggaaagctggcggtgtcattccgtctgagtccaaaggcctgaggacaaggggagctaatgttatatcccagtccaaggttgaaggcctgagaactgcggtgggggctgctagtgtaagtcctggagtctgaaggcccaagaaccaggagccccagtctccaagagaaggcaaagatgaatgccccagctcctcaagaagacacagagagagggagtttactttcctctctcttttttttgttctattcaggcctcaacatattggatgatgttcacccaacataggtgagggtggaccttctttactcagttgctgatgcagacactgacctcttccagaaccaccctcaccaacacacccagaagtaaccagctatctgagtatcctttaaccccttcaaaagcttcttgcaagaggagatttgatctgactcctgaaaggggttgagttttgggtcctttcttttttgaagggcacggatactgcctagagtctgtcccattgccccttcatccttgcagatgctctggatggagcatgttttaagggtcagctgagtttgcagaagcatcatatcctgtcacccatgtgccaggttcacaatgcgtgttcactcctgacgtccctgccaaccctgccagaaagggacctgctgaattgtatagtcttaaccctgtcatgttgacacatacaattcaccatccgaggtattaacagtttctcctgatattgcttctactccttttctcctacttcttttcttcatcctctctttcttatttgtcctccctttctgggatgacagttaaacccatgtcagaccttttaactgaatccctatgtctcgtcctttcctctatctttcctatcctgttgtctgtgcttcactctgactttcttctgactgatctaccatttcactaattctttccacctgtgtctaatatcgatttggtaaatttttatagttttttcccccaaatcctgtaccttgctccatttccctaaccatgttaagcaaacttattgtggactgtgtctgatatctggattgctagtggtccttccttcctgccttccctccctttcttccttctccttccttccttccttcattccatcctttcttccttccttctttccttcctccctccctccctccctgcctccctccctcccttccttc

SEQ ID NO: 462687 - DNA, 1533 bp, Homo sapiens
  misc_feature (1)..(3): n is a, c, g, or t
  misc_feature (5)..(6): n is a, c, g, or t
  misc_feature (8)..(10): n is a, c, g, or t
nnncnntnnnagatacatcagctacatggaagcaggaaaccaaacaggatttttagagtttatccttctcggactctctgaggatccagaactacagccgttcatatttgggctgttcctgtccatgtacctggtgacggtgctgggaaacctgctcatcatcctggccatcagctctgactcccacctccacacccccatgtacttcttcctctccaacctgtcctgggttgacatctgtttcagcacttgcatcgtccccaagatgctggtgaacatccagaccgagaacaaagccatctcctacatggactgcctcacacaggtctatttctccatgttttttcctattctggacacgctactcctgaccgtgatggcctatgaccggtttgtggctgtctgccaccctctgcactatatgatcatcatgaacccccacctctgtggcctcctggtttttgtcacctggctcattggtgtcatgacatccctcctccatatttctctgatgatgcatctaatcttctgtaaagattttgaaattccacattttttctgcgaactgacgtacatcctccagctggcctgctctgataccttcctgaacagcacgttgatatactttatgacgggtgtgctgggcgtttttcccctccttgggatcattttctcttattcacgaattgcttcatccataaggaagatgtcctcatctgggggaaaacaaaaagcactttccacctgtgggtctcacctctccgtcgtttctttattttatgggacaggcattggggtccacttcacttctgcggtgactcactcttcccagaaaatctccgtggcctcggtgatgtacactgtggtcacccccatgttgaaccccttcatctacagcctgaggaacaaggatgtgaagggagccctggggagtctcctcagcagggcagcctcttgtttgtgatggatcccttggccccaggactaagaagttttgtgagcaccaatggcaaaaatgttttattttgaaattcttactctttaaaattaaaaacatttttttatactttgagagtacaaatgcagatttcttaacatgcatttgcataagggtgaagtctgagcttttggctcaccaaagttcattatattgttcatatccctttgtgtcctcatagcttagctcccacttataactgagaacatacgatatgttcatatggatcttatgtatgttggttgaacatacaaacaagtccaggtttttcattcctgagttacttcacctagagtaatgacctccagttccatccaagttgctacaaaagacattatttggttcctttttatggataagtagtattccatgctgtacatataccacaatctttatcactcattggttgatgggcacttagaatatcagtcctattagatcagggcctgacccttatgatttcagtaaactttaattacctccctgaggaccctgtatctaaagacagtcatcatattgggggtgaggacttcact

SEQ ID NO: 462688 - DNA, 4620 bp, Homo sapiens
ccccaggagctggggaccccgagttgggggcggggcggctggggctacgcccgtgaagctgccccgccggctttcccggaccgcgagggggacagtgaggccgggaccccctccgcgcctttgcaccagccgtgaccccttgcaacgggggtacccagcggagctgcgcgctctcggcgcccccggagcctgcgccccgggccccttgcgcattttgcacgggggagactgaggctaggagtgcgaccctcagcccggggtcacacctcgtctggggcacggccaggtgggtggtagcctcagcctgcgagaccccctacccccgccccgtggtttcccgcaccgtggggccctgctctgaccacagactccgatggcagcggcggcgctgcgggaccccgcgcagggctgcgtgacctttgaggacgtgaccatttacttctcccaggaggagtgggtgctcctcgatgaggctcagagactcctgtactgcgatgtgatgctggaaaactttgcacttatagcctcgctgggacttatatctttcaggtcccacatcgtttcccagttggagatggggaaagagccctgggtgcctgacagtgtggatatgacatcagccatggccagaggggcttatggcaggcctggctctgatttttgccatggaacagagggcaaggacttaccttctgagcataacgtttctgtagaaggagtggcacaggacaggagtcccgaggcaactctgtgcccccagaagacctgcccctgtgacatatgtggcctacgtttgaaagacattttgcatttggctgaacaccagacaacacatcccaggcagaaaccatttgtgtgtgaggcatatgtgaaaggctctgagttcagtgcaaaccttccccggaaacaggtgcagcagaacgtacacaaccctatcagaacggaggagggccaggcttcccctgtaaagacctgcagagaccacacatcagatcagctttccacctgcagggagggtgggaaggactttgtggccacagcagggtttctgcagtgtgaggtcactcccagcgatggggagccgcacgaggccaccgaaggtgtggtggattttcacattgcactaaggcataacaagtgctgtgaatctggggatgccttcaataacaaatccactcttgttcagcaccagagaatccacagcagagaaaggccttatgaatgcagcaaatgtggaatcttcttcacttacgccgctgacctcactcaacaccagaaagttcacaatagaggaaaaccgtatgagtgctgtgaatgtggaaaattcttcagccagcactccagccttgttaaacatcgcagggttcacaccggtgaaagccctcacgtgtgtggtgactgtgggaaattcttcagccgaagctccaacctcattcagcataagagggttcacactggtgaaaagccatatgagtgcagcgactgtgggaagttcttcagccagcgttccaacctcattcatcataagagggttcatacgggcagaagtgcccatgagtgcagtgaatgtgggaaatctttcaactgcaactccagcctaattaaacattggagagttcacactggagaaagaccttacaagtgtaacgaatgtgggaaattcttcagccacattgccagcctcattcaacatcagatagttcacactggcgagcggcctcacgggtgtggtgagtgtgggaaagccttcagccgaagctctgacctcatgaaacatcagcgagttcacactggtgagcggccttatgaatgcaatgaatgtgggaagttatttagccagagctccagcctcaatagccatcggagacttcacactggtgaacggccttaccagtgcagtgaatgtgggaaattctttaaccaaagctccagcctcaataaccaccggagacttcacaccggcgagcggccttatgagtgcagcgaatgtgggaaaaccttcaggcagaggtccaatctgaggcagcacctgaaagttcacaaaccagacaggccttacgaatgcagcgaatgtgggaaagccttcaaccaaaggcctaccctcattcggcatcagaagattcacatcagagaaaggagcatggagaatgtgctccttccctgttcacagcacacaccagagataagctctgagaacagaccttatcagggcgctgtcaactacaagttgaaacttgttcatccaagtacccaccctggggaggttccctaggaatgctagctgtgttggaagctttctggagacaagttacattctcttactgtagagtttatcagcgttttttcactgctggggttgtgatagaagccatgtcagcaccacacactgcagctctccaaagagtgtgtccaccactccactgtgctcagggaaggcagacctctcctctctctttccaatccctaaagggaattaggagtagtctgaagccttgggaagatgtcattcccgccctgtatggctggtttagccatggacatgaccagcttttggctgtgaagacctgagcagggttttgccaacagcttgttctagagaaggtttccctttttctgggacattgttggtctcatgttatgcctgtgaaggatttgtccagccttcatgttactctacacaacaacttatctcctgtgtattgccctggttcatgtgatgataatggccttatgataaagccgcctttagtcttccatgttctgatcactgtgtggggtggttcaagagcagagttaagatctaccaaactgaaggggtctccagattatcttggaggggacaggaggatggcagagaaacaactgtcaatccagatttgacctcatttgcattgccaccaaggcctcctaggaaaaattgtaggaatttatgggtataatattgtggtctgaatggcgtgaatttttatcccgaggagggggcagttgtgacaacctccagtgcatgtgggaacagcatgaattgggtcccttattcccagggggtgccccatattccccaatactgtaaagcagatgctgtttagcacctgccaaggagccatatgccctgaagttcagcattaggcaggtatctcttaactgtaagacataccaggcccagctgggaccataatttgtacagaaacactggatgtgattaatagggagtaggcgagattatagcaaaccagcagaaatggaactctgctaaatgtgcatccgtgaatgctcccttgaatgtggctgtgcaggattcagggtttgcagaaattctcaggacctcagacctctgtcctatgactaatgttactggcagagcaaataatctaaaggttttggttttgtggattaccatctccgtgctgtgcatctgaaggccagtgctgtgctggcaggaaaatagggactgagaaaaagcagatcctatactatagggactgtagtatctatgacgtagccagccattctttgctcccaaggcaagaagaaagagatgacagagtcaatatagggttgccaaatcggattttctaaaatgagtaggaagttggatttttatgtgcaacagtttcttttaatgctttgttgatatgtgattgtcatgcaataattattcatatttggtaagttttgtacatatattatgtacactcagggaaccaataccataatcatgataatgaacgtatccatcacctgcaaagctacctcatgcccctttacattccctccttgccttccctaggaaaccgttgatttacattttttactttagatttgtttgccttttctagaattaacacaattggaatcataaagtatttatactctcttttggtctggtttctttcatgcagcataattatcttgagaatcatccatgctgtgtgtatatatagttcattccttttactactgagtagtgctatactgggtgagtgcaccatagttttttatggtttatttaaaaatgttaaaaaaatctgatgaaatatacttaacatgaaatttactatcctaaccatttttagtgtatacttcaatggtattaagtagattcgtattgttatgtaaccatcaccaccattcgtctccagaactcttcaatcttgcaaaactgaaattctgtacctgtcaagcaataacttcccattttcccttccccagcccctcaaaaccaccattctacttcctgtctgtatgaatttgaccactctaggtacctcatataagtagaataataagtatttgtctttttgtagctagcttatttcacacttagcataatattctcaaggttcatcaatgttggagcatatgtcagaatttcctttttagggctgattagtatttccttgtatgtgctgcattttgcttctctatcatgtgtcaatggatacttggggtgcctccaccttttgcctatttcgaataatgctgctctgaacctgagtgcacaacaaatatctattcaagaccctactttcaactcttttgggtatatgctcagaagtagaattactagatgatatagtaaatctatttttagttttttgaggacctgacatacactgtttt

SEQ ID NO: 462689 - DNA, 2553 bp, Homo sapiens
ttcctgcttggttcttcctgaggtctgagcaccttctagactacatccagatctgttttccctgcagattcatgaagatgagcatccggattccacccagactcctggagcttgcgggcggagcctgctgagggaccaagccttggccgtctccaccctggaggagctgcccacggaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggcttgatgcactgcttacccaaggggttcgtcccaggagatggaaacttcaagtgctggatttacaggatgtctgtgagaacttctggatggtttggtctgaagctatggcccatgggtgcttcctcaatgccaagaggaacaaaacaccagtgcaggactgtccaaggatgagagaacggcagcccttgactgtgtttgtagaactttggctcaagaacaggactctggatgaatacctcacctgcctccttctatgggtcaagcagaggagagatttactacacctgtgctgtaagaagctgaaaattttgggaatgcccttccgcaatatcagaagcatcctgaaaatggtgaacctagactgtatccaggaggtggaagtgaattgcaagtggatactgcccatcctgacacagtttaccccatacctgggccacttgaggaatcttcagaagctcgttctctcccacatggatgtctctcgctacgtttccccagagcagaagaaggagattgttacccagttcaccactcagttcctcaagctgcgctgcctccaaaagctttatatgaactctgtttctttcctcgaaggccacctggaccagctgctcagctgtctgaagacctcgttaaaggtcctcacaataactaactgtgtgcttttggaatcagacttgaagcatctctcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctgcatggccaccctggagaacctgctgagccacacaatcatactcaaaaacttatgcctggagctgtatcctgccccgcaggaaagttatggtgctgatggtactctctgctggagcagatttgctcaaattagggctgagctgatgaagaaagtgaggcacttaaggcaccccaagaggatcttgttctgtactgacaactgccctgaccatggcgacaggtcattttatgacctggaggcagatcaatactgctgttgaatgcctgcctatttggatggcgtctttcaccgctagccagatgctgagaccctgcccactccctgtgagtctccacatgcttccagaagccttagttggtggatgtcagcttcactgcacaaggagccagtctcttcccgctgccctggaaggggatgtccatattgtatattagctggagactctgggcagcaccaacccttgcttgttcccctgatgaccagcagcccttcttgaattaaacttgttgtagccagtaaagacagccacattccctttaagtaaaatactaaaactatacaggcatgtaacactttttaaatatttccatctgacattttaaaagttacatctttttggggagctaggtcagattgatgagagattttctcataacaccttccctctctccctatgaaggaagtgactagtgcagcatgttctggaatctgacatcatcaaagggtggataacgatcaagtgcctgtgggtgatgagtgaccttccctgtggtgaggaagcctgcatagtgggcacccaagtgaaggatcctgctgtgtactcaggggctggtgttgctgtcagggatgttagcctagagcctcagcttcctgtaaaatgaggatgatgatatccaacagcttatgggaccttgaagtcccagcatttttcatctttcaatctcacctccttttcctgataatagagaggcaacaagaactcagggcatgcaatggggctcaacttctactctctgccacaatttcatcatgattcccccaaagagcagagccccaggagccagcagggggcagggtgggcatttctggactggattcattcataataagatcaaaatttccaatccgtatgtctcgggtgccatctgctgatagatcggaccagatggatcagcacccacaccagcacagagcattcgtcacaatcaatgagccacagggacacatcattatcacccaatgtccatagttcacatgggggatcattgctggttttgtacattctatggattttaacaaagggat

SEQ ID NO: 462690 - DNA, 1069 bp, Homo sapiens
gggaaggagaaaggccgggaggaaggctggcaaatggcacagccgctgtgccgggacgcagagcgcgatgacgtagggatcctgcacgtgggcccactcgaaggtgaccacctggaagcccccgctctcgccgtgcgcgccgccgggctccacctcgacgcccccggcccgcgccagcccgcccagcgccagcgccagcagcagcccccggtcggggccccgggccccgagtccccacattgccgcctgctcagcgcagggctgggacgcgcatgtcgcggggggtcccggctgggctgggccgacgcgcggggctgggacccggcgaggacccggcgcgctccggtgccggtaccggctacagtccgatccccgcccgccggggtggcctttaatcccgcggccccctcccgccccggggcggagcctgcccgcccccgccgcgcactcgcgagcgcagacaccgccgcagctcccggcacgcccgccccgcccgcgcacgcccaccccgcgctccctggtgcccaccctcccccggagcccgcggcctggaggtccgggaggtcgcggcaagagcgagcccgggactgcgcggccgccttcctggggcgtggggagcacagcgcggggcagcgggacaggcggttccgcgcagctcctgggatgcccgggcagctgtgggtgcgctcgccccaaccctccttcataaacgcagggcctggggctgcgcagaccccacagggcggcccaagggtgcacaggggccccaggtgtgtcttcacacagcccctcgctattgtcttcagcaggaacctgcattccacagccggaccggccacttaccagaactcgggggcgcccaggccttgcgtggtgcgctggaaggccaaatttccaccagaccagtgtgttccatgatgcccactggacctccggccaccccaccccccaaccagcctgtcctaagagccgacaacctttctccacaaagctgttcaaagggcagaagagcagtgtcactgcctggaaggacaaatccagaacagacaccagtgccaggcgctggcca

SEQ ID NO: 462691 - DNA, 3577 bp, Homo sapiens
ttggacacatggacacacccaaggagctctggcggatgatcactgggaacatggccctcatccaggtgcaggccacggtggtgggcttcctggcgtccatcgcagccgtcgtctttggctggatccctgatggccacttcagtattccgcacgccttcctgctctgtgctagcagcgtggccacagccttcattgcctccctggtactgggtatgatcatgattggagtcatcattggctctcgcaagattgggatcaacccagacaatgtggccacacccattgctgccagcctgggcgacctcatcaccttggcgctgctctcaggcatcagctggggactctacctggaactgaatcactggcgatacatctacccactggtgtgtgctttctttgtggccctgctgcctgtctgggtggtgctggcccgacgaagtccagccacaagggaggtgttgtactcgggctgggagcctgttatcattgccatggccatcagcagtgtgggaggcctcatcttggacaagactgtctcagaccccaactttgctgggatggctgtcttcacgcctgtgattaatggtgttgggggcaatctggtggcagtgcaggccagccgcatctccaccttcctgcacatgaatggaatgcccggagagaactctgagcaagctcctcgccgctgtcccagtccttgtaccaccttcttcagccctgatgtgaattctcgctcagcccgggtcctcttcctcctcgtggtcccaggacacctggtgttcctctacaccatcagctgtatgcagggcgggcacaccaccctcacactcatcttcatcatcttctatatgacagctgcactgctccaggtgctgattctcctgtacatcgcagactggatggtgcactggatgtggggccggggcctggacccggacaacttctccatcccatacttgactgctctgggggacctgcttggcactgggctcctagcactcagcttccatgttctctggctcataggggaccgagacacggatgtcggggactagcttggtcactcaacattttccccatccctctgcactttctatttgaaatttttcttttgttcccctgtccctcctccaccccacactcccacctctttctaggacttcactttgataccaaattctcattattttcaatgggaatttttatacattgagccaagtttgtatagcaagaatttgggaaacacagatggcctgagataagcagtacaagtaggtttttgagacaatcaccaagtgcagtttcatggtgggtgcctccaggtgatgtggactggagcaggggagttttgtctggaatctggggacatggggtttggctttagcaacctgtcttggccctaatgagaaaccctttgtaagtgggctctggatttttggttttgttttctttttatctgttttgttttatttttggttttggttgaacagagggacagaagaataagtaacactcccaaacacagacatacttttgtagaagtggaccaacttcaaagctctggacaggagacacctgctccaggcccctgtgatcccagttctgttctcttgccctctggacctaagcgttcccactcgcagaaagagtaaggtggactgacttttcaatttgtgcacatgcctcttgttcaatggcctggtcaacatcaacaacccctccctctgatcatttccagttgattgtcatatccaggaaaaaatggaacagtgcactcttctccctgttgacccatgtccacctattggttccccaaaatccacattctccctgggcccagatgactttgtctccctgggcccagattctttgtctctcttcaaccttcatctcaaattgtctctaagcactaccttccccagagcttgccaggttgggttttgagattagggtcaggtcatgggtatgtggagaatggtttggaggttgaggacaaccacaggtgtctcattgctgccatttctcctgaggacataatcacttggtcaccttggaccctgtcacttcctaaaattactcgttctgtcatgccatagaggtcagttttcctctttcttggcttctacccacaaacattcaccaatcatttattcgttcatttagcaaatatgcagcctccgcaagatgagctctcctgcagacaagcatggtctgaaacattctttgagcaatatttattgagtgcctactatgtgttaggtactgtgccaggcactgataagccagtggtaagggaaacacagctctaacctcacctcattctccaggttacaaaggccatgtgcccctttgaatctggcagagaaagtttcctcgttgtaagtatttgcatctacttcaagccagattcttctgcctctttctcctttccagacccctactctgtgcagtgctgaccacagctagagccaccgccccattgctcaaccagtatttatttccctaaacgacccttcctcatattcccttccctccacctctccttaccaagcacccaaaagaggatttagaactagcagggtggacatcatctggttgtttctacttttctctgcctagcacaaaattgggagaaaactggagcctccatccgcagtcacacgtgtacagatctggggatttggatgtaggctttttctaacttctctctcagaagcttctacagaaacccttccatctgtagcctcaagggcccacctccaagggaaggcttaggcaatgatcctgtttctaccaacactgcaccttatcccaggaacctgccctagacctccagagaccatattttctctccctccatttctacccagacctccaggcctccttctggaatcatagaaccgtagaattggaaggaattttagaggttttctagttggagttgtgtccaacagaattcattaacaccagcctgggcttgtttttcctcctccctctggacttttttcatcttttcctccacctcaaaaaatacttacacacagattcttcttgtacaggcatcaaaaccaactcctctgcccctaaggctgtgtccctgtggtctccagccacccctaccccagtcactcgccccttcctcatctctggaatttggccaggcagtcccagaagactctggagtgacctcctttgcctaaaaagcagacagataggcatgccccaggccctgagtgagcagaggaggactgtagggtgagagggaaagaaaatgaaggtgactttcatggaagtttcatttcttttccccgattgtaccaactgcatgtacttttggcctggctgcaaggagcaatattggtttactctcgtatccttaaaaagttacagaactgtgtcttaagagaattatttatagttactataactgaattgacaaatgtcaacttaactgataaattatatttggtaaaataaagaggacgtttatttagatggttggtgtttcctgtatgtctcatcaaaaagcagcttcaactgttgtcttgggcccctctgtaggccttaccctctcctc

SEQ ID NO: 462692 - DNA, 1592 bp, Homo sapiens
ggcagtgaatcgagctcggtaccgtagcttggttgggttttgagattagggtcaggtcatgggtatgtggagaatggtttggaggttgaggacaaccacaggtgtctcattgctgccatttctcctgaggacataatcacttggtcaccttggaccctgtcacttcctaaaattactcgttctgtcatgccatagaggtcagttttcctctttcttggcttctacccacaaacattcaccaatcatttattcgttcatttagcaaatatgcagcctccgcaagatgagctctcctgcagacaagcatggtctgaaacattctttgagcaatatttattgagtgcctactatgtgttaggtactgtgccaggcactgataagccagtggtaagggaaacacagctctaacctcacctcattctccaggttacaaaggccatgtgcccctttgaatctggcagagaaagtttcctcgttgtaagtatttgcatctacttcaagccagattcttctgcctctttctcctttccagacccctactctgtgcagtgctgaccacagctagagccaccgccccattgctcaaccagtatttatttccctaaacgacccttcctcatattcccttccctccacctctccttaccaagcacccaaaagaggatttagaactagcagggtggacatcatctggttgtttctacttttctctgcctagcacaaaattgggagaaaactggagcctccatccgcagtcacacgtgtacagatctggggatttggatgtaggctttttctaacttctctctcagaagcttctacagaaacccttccatctgtagcctcaagggcccacctccaagggaaggcttaggcaatgatcctgtttctaccaacactgcaccttatcccaggaacctgccctagacctccagagaccatattttctctccctccatttctacccagacctccaggcctccttctggaatcatagaaccgtagaattggaaggaattttagaggttttctagttggagttgtgtccaacagaattcattaacaccagcctgggcttgtttttcctcctccctctggacttttttcatcttttcctccacctcaaaaaatacttacacacagattcttcttgtacaggcatcaaaaccaactcctctgcccctaaggctgtgtccctgtggtctccagccacccctaccccagtcactcgccccttcctcatctctggaatttggccaggcagtcccagaagactctggagtgacctcctttgcctaaaaagcagacagataggcatgccccaggccctgagtgagcagaggaggactgtagggtgagagggaaagaaaatgaaggtgactttcatggaagtttcatttcttttccccgattgtaccaactgcatgtacttttggcctggctgcaaggagcaatattggtttactctcgtatccttaaaaagttacagaactgtgtcttaagagaattatttatagttactataactgaattgacaaatgtcaacttaactgataaattatatttggtaaaataaagaggacgtttattta

SEQ ID NO: 462693 - DNA, 3094 bp, Homo sapiens
ttggacacatggacacacccaaggagctctggcggatgatcactgggaacatggccctcatccaggtgcaggccacggtggtgggcttcctggcgtccatcgcagccgtcgtctttggctggatccctgatggccacttcagtattccgcacgccttcctgctctgtgctagcagcgtggccacagccttcattgcctccctggtactgggtatgatcatgattggagtcatcattggctctcgcaagattgggatcaacccagacaatgtggccacacccattgctgccagcctgggcgacctcatcaccttggcgctgctctcaggcatcagctggggactctacctggaactgaatcactggcgatacatctacccactggtgtgtgctttctttgtggccctgctgcctgtctgggtggtgctggcccgacgaagtccagccacaagggaggtgttgtactcgggctgggagcctgttatcattgccatggccatcagcagtgtgggaggcctcatcttggacaagactgtctcagaccccaactttgctgggatggctgtcttcacgcctgtgattaatggtgttgggggcaatctggtggcagtgcaggccagccgcatctccaccttcctgcacatgaatggaatgcccggagagaactctgagcaagctcctcgccgctgtcccagtccttgtaccaccttcttcagccctgatgtgaattctcgctcagcccgggtcctcttcctcctcgtggtcccaggacacctggtgttcctctacaccatcagctgtatgcagggcgggcacaccaccctcacactcatcttcatcatcttctatatgacagctgcactgctccaggtgctgattctcctgtacatcgcagactggatggtgcactggatgtggggccggggcctggacccggacaacttctccatcccatacttgactgctctgggggacctgcttggcactgggctcctagcactcagcttccatgttctctggctcataggggaccgagacacggatgtcggggactagcttggtcactcaacattttccccatccctctgcactttctatttgaaatttttcttttgttcccctgtccctcctccaccccacactcccacctctttctaggacttcactttgataccaaattctcattattttcaatgggaatttttatacattgagccaagtttgtatagcaagaatttgggaaacacagatggcctgagataagcagtacaagtaggtttttgagacaatcaccaagtgcagtttcatggtgggtgcctccaggtgatgtggactggagcaggggagttttgtctggaatctggggacatggggtttggctttagcaacctgtcttggccctaatgagaaaccctttgtaagtgggctctggatttttggttttgttttctttttatctgttttgttttatttttggttttggttgaacagagggacagaagaataagtaacactcccaaacacagacatacttttgtagaagtggaccaacttcaaagctctggacaggagacacctgctccaggcccctgtgatcccagttctgttctcttgccctctggacctaagcgttcccactcgcagaaagagtaaggtggactgacttttcaatttgtgcacatgcctcttgttcaatggcctggtcaacatcaacaacccctccctctgatcatttccagttgattgtcatatccaggaaaaaatggaacagtgcactcttctccctgttgacccatgtccacctattggttccccaaaatccacattctccctgggcccagatgactttgtctccctgggcccagattctttgtctctcttcaaccttcatctcaaattgtctctaagcactaccttccccagagcttgccaggttgggttttgagattagggtcaggtcatgggtatgtggagaatggtttggaggttgaggacaaccacaggtgtctcattgctgccatttctcctgaggacataatcacttggtcaccttggaccctgtcacttcctaaaattactcgttctgtcatgccatagaggtcagttttcctctttcttggcttctacccacaaacattcaccaatcatttattcgttcatttagcaaatatgcagcctccgcaagatgagctctcctgcagacaagcatggtctgaaacattctttgagcaatatttattgagtgcctactatgtgttaggtactgtgccaggcactgataagccagtggtaagggaaacacagctctaacctcacctcattctccaggttacaaaggccatgtgcccctttgaatctggcagagaaagtttcctcgttgtaagtatttgcatctacttcaagccagattcttctgcctctttctcctttccagacccctactctgtgcagtgctgaccacagctagagccaccgccccattgctcaaccagtatttatttccctaaacgacccttcctcatattcccttccctccacctctccttaccaagcacccaaaagaggatttagaactagcagggtggacatcatctggttgtttctacttttctctgcctagcacaaaattgggagaaaactggagcctccatccgcagtcacacgtgtacagatctggggatttggatgtaggctttttctaacttctctctcagaagcttctacagaaacccttccatctgtagcctcaagggcccacctccaagggaaggcttaggcaatgatcctgtttctaccaacactgcaccttatcccaggaacctgccctagacctccagagaccatattttctctccctccatttctacccagacctccaggcctccttctggaatcatagaaccgtagaattggaaggaattttagaggttttctagttggagttgtgtccaacagaattcattaacaccagcctgggcttgtttttcctcctccctctggacttttttcatcttttcctccacctcaaaaaatacttacacacagattcttcttgtaggaagccgggatcactctagagtcacctcagcatcacc

SEQ ID NO: 462694 - DNA, 3493 bp, Homo sapiens
ttggacacatggacacacccaaggagctctggcggatgatcactgggaacatggccctcatccaggtgcaggccacggtggtgggcttcctggcgtccatcgcagccgtcgtctttggctggatccctgatggccacttcagtattccgcacgccttcctgctctgtgctagcagcgtggccacagccttcattgcctccctggtactgggtatgatcatgattggagtcatcattggctctcgcaagattgggatcaacccagacaatgtggccacacccattgctgccagcctgggcgacctcatcaccttggcgctgctctcaggcatcagctggggactctacctggaactgaatcactggcgatacatctacccactggtgtgtgctttctttgtggccctgctgcctgtctgggtggtgctggcccgacgaagtccagccacaagggaggtgttgtactcgggctgggagcctgttatcattgccatggccatcagcagtgtgggaggcctcatcttggacaagactgtctcagaccccaactttgctgggatggctgtcttcacgcctgtgattaatggtgttgggggcaatctggtggcagtgcaggccagccgcatctccaccttcctgcacatgaatggaatgcccggagagaactctgagcaagctcctcgccgctgtcccagtccttgtaccaccttcttcagccctgatgtgaattctcgctcagcccgggtcctcttcctcctcgtggtcccaggacacctggtgttcctctacaccatcagctgtatgcagggcgggcacaccaccctcacactcatcttcatcatcttctatatgacagctgcactgctccaggtgctgattctcctgtacatcgcagactggatggtgcactggatgtggggccggggcctggacccggacaacttctccatcccatacttgactgctctgggggacctgcttggcactgggctcctagcactcagcttccatgttctctggctcataggggaccgagacacggatgtcggggactagcttggtcactcaacattttccccatccctctgcactttctatttgaaatttttcttttgttcccctgtccctcctccaccccacactcccacctctttctaggacttcactttgataccaaattctcattattttcaatgggaatttttatacattgagccaagtttgtatagcaagaatttgggaaacacagatggcctgagataagcagtacaagtaggtttttgagacaatcaccaagtgcagtttcatggtgggtgcctccaggtgatgtggactggagcaggggagttttgtctggaatctggggacatggggtttggctttagcaacctgtcttggccctaatgagaaaccctttgtaagtgggctctggatttttggttttgttttctttttatctgttttgttttatttttggttttggttgaacagagggacagaagaataagtaacactcccaaacacagacatacttttgtagaagtggaccaacttcaaagctctggacaggagacacctgctccaggcccctgtgatcccagttctgttctcttgccctctggacctaagcgttcccactcgcagaaagagtaaggtggactgacttttcaatttgtgcacatgcctcttgttcaatggcctggtcaacatcaacaacccctccctctgatcatttccagttgattgtcatatccaggaaaaaatggaacagtgcactcttctccctgttgacccatgtccacctattggttccccaaaatccacattctccctgggcccagatgactttgtctccctgggcccagattctttgtctctcttcaaccttcatctcaaattgtctctaagcactaccttccccagagcttgccaggttgggttttgagattagggtcaggtcatgggtatgtggagaatggtttggaggttgaggacaaccacaggtgtctcattgctgccatttctcctgaggacataatcacttggtcaccttggaccctgtcacttcctaaaattactcgttctgtcatgccatagaggtcagttttcctctttcttggcttctacccacaaacattcaccaatcatttattcgttcatttagcaaatatgcagcctccgcaagatgagctctcctgcagacaagcatggtctgaaacattctttgagcaatatttattgagtgcctactatgtgttaggtactgtgccaggcactgataagccagtggtaagggaaacacagctctaacctcacctcattctccaggttacaaaggccatgtgcccctttgaatctggcagagaaagtttcctcgttgtaagtatttgcatctacttcaagccagattcttctgcctctttctcctttccagacccctactctgtgcagtgctgaccacagctagagccaccgccccattgctcaaccagtatttatttccctaaacgacccttcctcatattcccttccctccacctctccttaccaagcacccaaaagaggatttagaactagcagggtggacatcatctggttgtttctacttttctctgcctagcacaaaattgggagaaaactggagcctccatccgcagtcacacgtgtacagatctggggatttggatgtaggctttttctaacttctctctcagaagcttctacagaaacccttccatctgtagcctcaagggcccacctccaagggaaggcttaggcaatgatcctgtttctaccaacactgcaccttatcccaggaacctgccctagacctccagagaccatattttctctccctccatttctacccagacctccaggcctccttctggaatcatagaaccgtagaattggaaggaattttagaggttttctagttggagttgtgtccaacagaattcattaacaccagcctgggcttgtttttcctcctccctctggacttttttcatcttttcctccacctcaaaaaatacttacacacagattcttcttgtacaggcatcaaaaccaactcctctgcccctaaggctgtgtccctgtggtctccagccacccctaccccagtcactcgccccttcctcatctctggaatttggccaggcagtcccagaagactctggagtgacctcctttgcctaaaaagcagacagataggcatgccccaggccctgagtgagcagaggaggactgtagggtgagagggaaagaaaatgaaggtgactttcatggaagtttcatttcttttccccgattgtaccaactgcatgtacttttggcctggctgcaaggagcaatattggtttactctcgtatccttaaaaagttacagaactgtgtcttaagagaattatttatagttactataactgaattgacaaatgtcaacttaactgataaattatatttggtaaaataaagaggacgtttattta

SEQ ID NO: 462695 - DNA, 1838 bp, Homo sapiens
agtgaacaagttctgggcctgagtccacctatgagccgggcctgtcctgctagtgagtttcttagaggcatagtgtgcaccccacttgtttctggtatttttcccaagacgtccgggctccagcccgttttggcagtgggaatcctgtgccaatacatccaagtcttcatggacggtggaaacaaaacgtgaaacctgcagatgtgtctgggatcgtccctcctggtgcctgacgtcggttaacttccggaggctataaaaacaggaatctccagggcagcgccatcttccacgaaggccaagaaccttctggaaagctgtttaaagtgtagtttatgcatcagttctttgaggaaagtaaaaatcatgagctaaatataaacgcatccaggctcaacggagacagaggcgtaactgcagcgctgttcctccgcaggcatgggggacgcgctctgccgatgtgggtgtcctgggagccggcactgcggcctctcagcttcctttcccaccaggagtatccagggcggaccgcaccacagacatcccagtggagccaggcagcaacgcctctttgctctcaaacatctaaattcaaaaacgactagttccccaagatagtgtcctgtggccacactgtgggcacacctgaaatggaattctagccttagctgctccggggcctcggaaacaatgccctgaatttgttcctctgaggttggcgtcgacacggggctcatgccgtcagataagaagacagacccttgcagcctccgtgcggtgtttccgagagcgcattcccctgagcagagcagggtctgcgctgtgtgatgggggtgcggggctctgatgaggggtttgtgggctcttcccaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctggggtggctctcattcgaggggatgttgctcttctacacagacttcatgggcgaggtggtgtttcagggggaccccaaggccccgcacacatcagaggcgtatcagaagtacaacagcggcgtgaccatgggctgctggggcatgtgtatctacgccttcagtgctgccttctactcagctatcctggagaagctggaggagttcctcagcgtccgcaccctctacttcatcgcctatctcgccttcggcctggggaccgggcttgccaccctctccaggaacctctacgtggtcctgtcgctctgcataacctacgggattttattttccaccctgtgcaccttgccttactcgctgctctgcgattactatcagagtaagaagtttgcagggtccagtgcggacggcacccggcggggcatgggcgtggacatctctctgctgagctgccagtacttcctggctcagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggacacgcgcctgcacctgggggtctggagcaggccgaccagtgaggaccaaagggccttgttggacagggggacaggctgcctactggaatgtaaatatgtgataaaataataaatgacagcggcaaagcctatggtttct

SEQ ID NO: 462696 - DNA, 1158 bp, Homo sapiens
  misc_feature (37)..(38): n is a, c, g, or t
  misc_feature (41)..(41): n is a, c, g, or t
  misc_feature (70)..(70): n is a, c, g, or t
  misc_feature (162)..(163): n is a, c, g, or t
  misc_feature (189)..(189): n is a, c, g, or t
aagaacgggcccaccgcgttcggggttctcctcccgnngangggaacccaaaccctgtctctttccccangtttcggaggaggctttggatacgtcctcggcggaatccactgggataaaacgggcttcgggagggccctggggggacagttccgagtcatnnacctcttcactgcggtcaccctgagngtcaccaccgtcctgaccctggtcagcatccctgagaggccgctgcggccgccgagtgagaagcgggcagccatgaagagccccagcctcccgctgcccccgtccccgcccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccaaggtcatcagggattctgaagagacctcagaccttggccatcccggacgcagccggaggagggggtcccgaaaccagcaggagaaggaatgtgaccttcagtcagcaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctggggtggctctcattcgaggggatgttgctcttctacacagacttcatgggcgaggtggtgtttcagggggaccccaaggccccgcacacatcagaggcgtatcagaagtacaacagcggcgtgaccatgggctgctggggcatgtgtatctacgccttcagtgctgccttctactcagctgtgctgaatgagatagaaacagccccc

SEQ ID NO: 462697 - DNA, 1764 bp, Homo sapiens
  misc_feature (37)..(38): n is a, c, g, or t
  misc_feature (41)..(41): n is a, c, g, or t
  misc_feature (70)..(70): n is a, c, g, or t
  misc_feature (162)..(163): n is a, c, g, or t
  misc_feature (189)..(189): n is a, c, g, or t
aagaacgggcccaccgcgttcggggttctcctcccgnngangggaacccaaaccctgtctctttccccangtttcggaggaggctttggatacgtcctcggcggaatccactgggataaaacgggcttcgggagggccctggggggacagttccgagtcatnnacctcttcactgcggtcaccctgagngtcaccaccgtcctgaccctggtcagcatccctgagaggccgctgcggccgccgagtgagaagcgggcagccatgaagagccccagcctcccgctgcccccgtccccgcccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccaaggtcatcagggattctgaagagacctcagaccttggccatcccggacgcagccggaggagggggtcccgaaaccagcaggagaaggaatgtgaccttcagtcagcaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctggggtggctctcattcgaggggatgttgctcttctacacagacttcatgggcgaggtggtgtttcagggggaccccaaggccccgcacacatcagaggcgtatcagaagtacaacagcggcgtgaccatgggctgctggggcatgtgtatctacgccttcagtgctgccttctactcagctatcctggagaagctggaggagttcctcagcgtccgcaccctctacttcatcgcctatctcgccttcggcctggggaccgggcttgccaccctctccaggaacctctacgtggtcctgtcgctctgcataacctacgggattttattttccaccctgtgcaccttgccttactcgctgctctgcgattactatcagagtaagaagtttgcagggtccagtgcggacggcacccggcggggcatgggcgtggacatctctctgctgagctgccagtacttcctggctcagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggacacgcgcctgcacctgggggtctggagcaggccgaccagtgaggaccaaagggccttgttggacagggggacaggctgcctactggaatgtaaatatgtgataaaataataaatgacagcggcaaagcctatggtttct

SEQ ID NO: 462698 - DNA, 3122 bp, Homo sapiens
gcggccggagctccaggtctcgtcctcactactctgtgtcttctgcttttaggggcgcagcctctgtggccctgtgacctgccccctggaagcctagaaatgggactgttgacatttagggatgtggccatagaattctctctggaggagtggcagtgcctggacactgcacagaagaatttatataggaatgtgatgttagagaactacagaaacctggccttcctgggtattgctgtctctaagccagacctcatcatctgtctggagaaagaaaaagagccctggaatatgaagcgagatgagatggtggatgaacccccaggtaggtgagagtgaatacaacagatgacctggatgagaggtccaacgtcaagaagaaagccagtctttaaagtgatttggaaagctgcattccaaaggaaaccgtttctggaaagcctgaaatttaaaaaaaaatatactctcagataggggcatcttctgcttatgcttataaaatctctaagaattctactctcccttcaatgatcttccttaacgtttacagtgacagccaaagtactgttcatggcatataaaagagtgtacaatctgactttttttttcttgtttttgtggacagatagatatctgcatagttttgagacactctatgttaaaatttttttttgttttagaaggagtttcgcttttgtggcccatgctggagttgcaatgagctgagatcatgccactgtactttagcctgggcggcagagcaagactctctctcgatgtatatatatatagtttgaaattataaagtataatgtccttctgctttgttctttttcctcaagattgctttggctattcaaaatttattgtggtttcgtgtacattttaggattgtaattttcattactgtgaaaaactggaattttgacagggagtttattgagtctagagatcaccttagataatatggcagtttcacaatacttattctttcaatagaaataaaatatttttaaatttatttgtggagctggaactgagtcatggaactgcttcagggaccacaggaaaggccaaggtctgaggcctgccatcatggctataaatggaggtcttcctccaggcctctggaagggcaggacccacgctgcccattggctcccaagactgtggctgtgaagagtttgggatggttacagataatactaagaagatttgaaaaatgtggacatgagaatttacagttaagaaaaggttgtaaaagtgtggatgagtgtaaggtacacaaagaaggttataatggacttaaccagtgtttcacaactacccagggcaaagcttctcaatgtggtaaatatttgaaagtcttttataaatttataaatttaaacagatataagataagacatactagaaagaaacctttcaaatgtaaaaattgtgtcaaatcattttgcatgttttcacacaaaacccagcataaaagcatatatactacagagaagtcctacaaatgtaaagaatgtggaaaaacctttaattggtcctcaacccttactaatcataagaaaactcatactgaagaaaagccctacaaatgtgaagaatatggcaaagcttttaatcaatcctcaaattatactacacataaggtaactcatactggagagaagccttacaagtgtgaagaatgtggcaaagcatttagccaatcctcaacactaaccatacataagaggatacatactggagagaaaccctgcaaatgtgaagaatgtggcaaagcatttagccaaccctcagcactaaccatacataagaggatgcacattggagagaaaccctacaaatgtgaagaatgtggcaaagcatttgtttggtcctcaaccctaactagacataagaggctgcacagtggagagaaaccctacaaatgtgaagaatgtgccaaagcttttagccaattcggacaccttactacacataggataattcatactggagagaaaccctacaaatgtgaagaatgtggcaaagcatttatatggccctcaaccctaactaaacataagaggattcacactggagagaaaccctacaaatgtgaagaatgtggcaaagcttttcatcgatcctcaaatcttactaaacataagataattcatactggagagaaaccttacaagtgtgaagaatgcggcaaagcgtttatatggtcctcaaaccttactgaacataagaaaattcatactagagagaaaccctacaaatgtgaagaatgtagtaaagcatttagccgatcctcagccctaactacacataagaggatgcacactggagagaaaccctacaaatgtgaagaatgtggcaaagcttttagccagtcctcaacccttactgcacataagataattcatactggagagaaaccctacaaatgtgaagaatgtggcaaagcatttatattgtcctcgaccctatctaaacataagaggattcacactggagagaaaccctacaaatgtgaagaatgtggcaaaacttttaatcaatcctcaaatcttagtacacataagataattcatactggagagaaaccttacaagtgtgaagaatgtggaaaagcgtttaatcgatcctcaaatcttagtacgcataagataattcatactggagagaaaccttacaagtgtgacgaatgtggcaaatcatttatctggtcctcaaccctttttaagcataagaggattcatacttgagagaaaccttaaaaagggtaaagaatgtggcaaagcatttatatggtcctcaacgctaaacataagaggatgcacactggagagaaaccctacaaatgtgaagaatgtgaaaaagcttttaatcctcaaatcttactaaacattagataattcacactggagagaaaccttacaagtgtgaagaatgtgggaaagcttttaatcattctcaaatcttactacacataagataattcatactggaaataaaccctacaaatgtgaaaaatgtggcaaagcatatggtccacacccctaagtagacataagaggatgcacactggagagaaaccttacaaatgtgaggaatgtggcaaagccttt

SEQ ID NO: 462699 - DNA, 758 bp, Homo sapiens
gcggccggagctccaggtctcgtcctcactactctgtgtcttctgcttttaggggcgcagcctctgtggccctgtgacctgccccctggaagcctagaaatgggactgttgacatttagggatgtggccatagaattctctctggaggagtggcagtgcctggacactgcacagaagaatttatataggaatgtgatgttagagaactacagaaacctggccttcctgggtattgctgtctctaagccagacctcatcatctgtctggagaaagaaaaagagccctggaatatgaagcgagatgagatggtggatgaacccccaggtaggtgagagtgaatacaacagatgacctggatgagaggtccaacgtcaagaagaaagccagtctttaaagtgatttggaaagctgcattccaaaggaaaccgtttctggaaagcctgaaatttaaaaaaaaatatactctcagataggggcatcttctgcttatgcttataaaatctctaagaattctactctcccttcaatgatcttccttaacgtttacagtgacagccaaagtactgttcatggcatataaaagagtgtacaatctgactttttttttcttgtttttgtggacagatagatatctgcatagttttgagacactctatgttaaaatttttttttgttttagaaggagtttcgcttttgtggcccatgctggagtgcaatggtgcgatctcggctcactgcaaccggatcctgcctccca

SEQ ID NO: 462700 - DNA, 2514 bp, Homo sapiens
atactaaaaataaaaaaattagctgggctcagtggtgggcacctgtaatcccagctgctcgggtggctgaggcaggagaattgcttgaacccaggagccagaggttgcaatgagctgagatcatgccactgtactttagcctgggcggcagagcaagactctctctcgatgtatatatatatagtttgaaattataaagtataatgtccttctgctttgttctttttcctcaagattgctttggctattcaaaatttattgtggtttcgtgtacattttaggattgtaattttcattactgtgaaaaactggaattttgacagggagtttattgagtctagagatcaccttagataatatggcagtttcacaatacttattctttcaatagaaataaaatatttttaaatttatttgtggagctggaactgagtcatggaactgcttcagggaccacaggaaaggccaaggtctgaggcctgccatcatggctataaatggaggtcttcctccaggcctctggaagggcaggacccacgctgcccattggctcccaagactgtggctgtgaagagtttgggatggttacagataatactaagaagatttgaaaaatgtggacatgagaatttacagttaagaaaaggttgtaaaagtgtggatgagtgtaaggtacacaaagaaggttataatggacttaaccagtgtttcacaactacccagggcaaagcttctcaatgtggtaaatatttgaaagtcttttataaatttataaatttaaacagatataagataagacatactagaaagaaacctttcaaatgtaaaaattgtgtcaaatcattttgcatgttttcacacaaaacccagcataaaagcatatatactacagagaagtcctacaaatgtaaagaatgtggaaaaacctttaattggtcctcaacccttactaatcataagaaaactcatactgaagaaaagccctacaaatgtgaagaatatggcaaagcttttaatcaatcctcaaattatactacacataaggtaactcatactggagagaagccttacaagtgtgaagaatgtggcaaagcatttagccaatcctcaacactaaccatacataagaggatacatactggagagaaaccctgcaaatgtgaagaatgtggcaaagcatttagccaaccctcagcactaaccatacataagaggatgcacattggagagaaaccctacaaatgtgaagaatgtggcaaagcatttgtttggtcctcaaccctaactagacataagaggctgcacagtggagagaaaccctacaaatgtgaagaatgtgccaaagcttttagccaattcggacaccttactacacataggataattcatactggagagaaaccctacaaatgtgaagaatgtggcaaagcatttatatggccctcaaccctaactaaacataagaggattcacactggagagaaaccctacaaatgtgaagaatgtggcaaagcttttcatcgatcctcaaatcttactaaacataagataattcatactggagagaaaccttacaagtgtgaagaatgcggcaaagcgtttatatggtcctcaaaccttactgaacataagaaaattcatactagagagaaaccctacaaatgtgaagaatgtagtaaagcatttagccgatcctcagccctaactacacataagaggatgcacactggagagaaaccctacaaatgtgaagaatgtggcaaagcttttagccagtcctcaacccttactgcacataagataattcatactggagagaaaccctacaaatgtgaagaatgtggcaaagcatttatattgtcctcgaccctatctaaacataagaggattcacactggagagaaaccctacaaatgtgaagaatgtggcaaaacttttaatcaatcctcaaatcttagtacacataagataattcatactggagagaaaccttacaagtgtgaagaatgtggaaaagcgtttaatcgatcctcaaatcttagtacgcataagataattcatactggagagaaaccttacaagtgtgacgaatgtggcaaatcatttatctggtcctcaaccctttttaagcataagaggattcatacttgagagaaaccttaaaaagggtaaagaatgtggcaaagcatttatatggtcctcaacgctaaacataagaggatgcacactggagagaaaccctacaaatgtgaagaatgtgaaaaagcttttaatcctcaaatcttactaaacattagataattcacactggagagaaaccttacaagtgtgaagaatgtgggaaagcttttaatcattctcaaatcttactacacataagataattcatactggaaataaaccctacaaatgtgaaaaatgtggcaaagcatatggtccacacccctaagtagacataagaggatgcacactggagagaaaccttacaaatgtgaggaatgtggcaaagccttt

SEQ ID NO: 462701 - DNA, 767 bp, Homo sapiens
gcggccggagctccaggtctcgtcctcactactctgtgtcttctgcttttaggggcgcagcctctgtggccctgtgacctgccccctggaagcctagaaatgggactgttgacatttagggatgtggccatagaattctctctggaggagtggcagtgcctggacactgcacagaagaatttatataggaatgtgatgttagagaactacagaaacctggccttcctgggtattgctgtctctaagccagacctcatcatctgtctggagaaagaaaaagagccctggaatatgaagcgagatgagatggtggatgaacccccagatggagtctcgctctgtcacccaggctggagtgcagtggcgtgatcttggctcactgcaacctccgcctcccaggttcaagccattctcctgcctcagcctcctgagtagctgggactataggtgccgacaccgcgcttggctaattttttgtatttttagtagaaacggggtttcaccgtgctctcgatctcctgatctcgtgatctgcccgcctcggcctcccaaagtgctgggattacagatgccagtaatttaaaatgcctgccttccatgaatgcacagttacagtcaaacattgcagttatctagacaaattatttgttaatgtacataaatgttgccaactagttgtaatgagtaaacatttctgttattgtgttgcagttttatattagtgttttttgtagtgtaagtttcctaacatcagtttattgtgccta

SEQ ID NO: 462702 - DNA, 4024 bp, Homo sapiens
ttcttttctctctctctctctattcagtattttggctaccatcttcagagaagcatgggagggagtaaaagaaattggatcccctttacccacatctatacagtcttcttgctgaccctgattacaagtgtttgggccagtgcagcagaactcaagccaccgggggtcagagcagacgcagagtgtccaggcatgctggagtctgctgaacagctgctggtggaggacctgtacaaccgcgtcagggagaagatggatgacaccagcctctataatacgccctgtgtcctggacctacagcgggccctggttcaggatcgccaagaggcgccctggaatgaggtggatgaggtctggcccaatgtcttcatagctgagaaatacagaagcattcatcttacggtcactaagaacccaggcatcgccaggagtgtggctgtgaacaaggggaggctgaagaggctgggaatcacccacattctgaatgctgcgcatggcaccggcgtttacactggccccgaattctacactggcctggagatccagtacctgggtgtagaggtggatgactttcctgaggtggacatttcccagcatttccggaaggcgtctgagttcctggatgaggcgctgctgacttacagagggaaagtcctggtcagcagcgaaatgggcatcagccggtcagcagtgctggtggtcgcctacctgatgatcttccacaacatggccatcctggaggctttgatgaccgtgcgtaagaagcgggccatctaccccaatgagggcttcctgaagcagctgcgggagctcaatgagaagttgatggaggagagagaagaggactatggccgggaggggggatcagctgaggctgaggagggcgagggcactgggagcatgctcggggccagagtgcacgccctgacggtggaagaggaggacgacagcgccagccacctgagtggctcctccctggggaaggccacccaggcctccaagcccctcaccctcatagacgaggaggaggaggagaaactgtacgagcagtggaagaaggggcagggcctcctctcagacaaggtcccccaggatggaggtggctggcgctcagcctcctctggccagggtggggaggagctcgaggacgaggacgtggagaggatcatccaggagtggcagagccgaaacgagaggtaccaagcagaagggtaccggaggtggggaagggaggaggagaaggaggaggagagcgacgctggctcctcggtggggaggcggcggcgcaccctgagcgagagcagcgcctgggagagcgtgagcagccacgacatctgggtcctgaagcagcagctggagctgaaccgcccggaccacggcaggaggcgccgcgcagactcgatgtcctcggagagcacctgggacgcatggaacgagaggctgctggagattgagaaggaggcttcccggaggtaccacgccaagagcaagagagaggaggcggcagacaggagctcagaagcagggagcagggtgcgggaggatgatgaggacagcgtgggctctgaggccagttccttctacaacttctgcagcaggaacaaggacaagctcactgccctggaaagatggaagatcaagagaatccaatttggatttcacaagaaagacttgggagcgggagacagcagcggtgagcccggtgcagaggaggcagtaggggagaagaacccctccgacgtcagcctgacagcctaccaggcctggaagctgaaacaccagaagaaggtgggcagtgagaacaaggaggaggtggtggagctcagcaagggggaggactcggccttggctaagaagagacaacggaggctggagctgctggagagaagccggcagacgctggaggagagccagtctatggcaagctgggaggcggacagctccacggccagcgggagcattcccctgtctgcgttctggtctgcagacccctcagtcagcgctgatggggacacgacgtcagtactgagcacccagagccaccgctcccacctgtctcaggctgcaagcaacatagcggggtgttcaacctccaaccccaccacacccctgcctaacctgccagtggggcctggagacaccatttccattgccagtatccagaactggattgccaatgtagtcagtgagacccttgctcagaagcaaaatgaaatgctgctgttgtcccgctcaccgtctgttgcaagcatgaaggcagtaccagcggctagctgcctgggggatgaccaagtctccatgcttagtggacacagcagctcctccttgggtggctgcctgttgcctcagagccaggcaagacccagctctgacatgcagtctgtgctgtcctgcaacaccacactgagctcacccgcggaaagttgcagaagcaaagtgagggggaccagcaagcccatcttcagcctctttgctgacaatgtggacctaaaggaacttggccggaaggagaaggagatgcagatggagcttagggagaagatgtctgagtacaaaatggaaaagctggcctcagacaacaaacgcagctccctcttcaagaagaagaaggtcaaggaagatgaggatgatggtgtgggtgatggggatgaggacactgacagtgccatagggagcttccgatattcttcccgcagtaattcccagaaacctgaaacagacacatgctcctccctggctgtctgtgatcactatgcaagtggcagcagagttggcaaagagatggatagcagtattaataagtggctcagtggcctcaggacggaggaaaaacctcctttccaaagtgactggtctggaagttccagagggaagtacaccagatcgtccctgctcagggagacagagtctaaatcctccagttacaagttttccaaatcccagtcagaggaacaggacacctcctcctaccacgaggcaaatggcaactctgtaagaagcacttcacggttctcatcttcctccaccagggagggcagagagatgcacaagttctccaggtccacgtacaacgagacctcaagttcccgagaggagagcccagagccctacttcttccgccggaccccagagtcctcagaaagggaagagtccccagaaccacagcgcccaaattgggccaggtccagggactgggaagatgtggaagagtcatccaagtcagacttctctgaatttggagccaagaggaagttcacccagagctttatgaggtctgaagaagagggagagaaagagaggacagaaaacagagaagaagggaggtttgcatctggacggcggtcccagtatcggagaagcactgacagggaggaagaggaagaaatggacgatgaagccatcattgctgcttggagacgccggcaagaagaaaccaggaccaagctgcagaaaaggagggaggactgagctggggaaaatctgagaacactgaaagaaaccactcacgttagcatagggctcagggcacacgttgccaccactcatcgcaggatgaggatacagagaggatcttccagaggggcagagccaaaatgagaggtaccaagcataagggcagcagaggtggagtagggaggaggcaaggagggggagaaccatcaatacgaatacgaggtccgaatgcggaccaactgataccattttctgttgctcagcgccctctaagctttggtgtttcacttaatgtatttgacagtgttcatcacaggctagagaggtgagcttggaaaagcactgtagtttgtcagagactccagtttacatccagaaaggccatgaacataggacacgcttctgtctgtagaggcttcatatgagacccagaaagtctatcctatggcaagtctgacctctcctggcaatgctcagttctgattttttttttttaatgttttgagtctccattaaaaatggtatgttggcaaatagttcttctttattctggtcatgtttaactttttgg

SEQ ID NO: 462703 - DNA, 738 bp, Homo sapiens
gagagcacagtctacgggccaatgccggggcaccccttcccaattagccagagcctcatccctgaaaacatcttcagcctgctggcgagtgcagcctggtgtgatgctatacccatattccctagcttgtatggttacctgactgccaagagccagcatcctattggtctagcactgaagaagcagagggagttggtcacaaagagaaagaaggatgagaggactttggagcaaagaaaggaggactttgccaagagcaaacctgaaacattcctttgggttcagttcaatcgcctgcaagtcacgtttccacacaaacatgtccccaggactgaggatgcaaggcactgttcaaggcgtctcttggatgaagacatggcaaaagctaccaccaccatgcagctctgtgattcttctactagtgtcttccattggctgaactcagctgaacactacagggtaaagaagcccagatgatgctgtctgttgaagtcagtttcttgaagcacaaagcaggtaaggggaaaggtgaaaagtggatctggaggaacaaacaggatataccctgcaaaatcattgatattactatttctaaaatagaaaaaatacacaaatttaaaaagtgatggcatttgaaacttacttctgtcatcaaatgtgataaaaataattcccatctaataaaattattgggtaaccttgaaaatcaacaatgtctgttaactttttgtccttatt

SEQ ID NO: 462704 - DNA, 1504 bp, Homo sapiens
agggtcccagactgcgccaaagcttcaggagacctctccttgtctgtgcacggactggtggctgactctggagcccagactgttgctggtgaatccttcatagtctggtgtccgagctacacagagccacagaatctcacaggtgtctcagaattcctcctcctgggactctcagaggatccagaactgcagccggtcctcgctgggctgttcctgtccatgtacctggtcacggtgctggggaacctgctcatcatcctggctgtcagctctgactcccacctccacacccccatgtacttcttcctctccaacctgtccttggctgacatcggtttcacctccaccacggtccccaagatgattgtggacatgcaaactcacagcagagtcatctcctatgaaggctgcctgactcagatgtctttttttgtcctttttgcatgtatggatgacatgctcctgagtgtgatggcctatgaccggtttgtggccatctgtcaccccctgcactaccgaatcatcatgaacccacgcctctgtggcttcttaatcttgttgtctttttttattagtcttttggactcccagttgcacaatttgattatgttacagctcacctgcttcaaggatgtggacatttctaatttcttctgtgacccttctcaactcctccaccttaggtgttccgacaccttcatcaatgaaatggtcatatatttcatgggtgccatatttggctgtctccctatctcagggatccttttctcttactataaaattgtttcccccattctgagagttccaacatcagatgggaagtataaagccttctccacctgtggctctcacctggcagttgtttgcttattttatggaacagggcttgtagggtacctcagttcagctgtgttaccatcccccaggaagagtatggtggcttcagtgatgtacactgtggtcacccccatgctgaaccccttcatctacagcctgaggaacaaggacattcaaagtgccctgtgcaggctgcatggcagaatcatcaaatctcatcatctccatcctttttgttatatgggatagaaatggcagcaaaatttaacacctaggcctgcaaattctgcctccttggtcacattattttggttgcttgatggctttcattcctctctgggtttcgtatgtgaatattgcttgctttgttttgtctttaattgcaatgggtgagtattctggtatcctttgttcatcatacacatcatgaatgattccaatatacctagacagcctcctttagtatctgtgcaatgaccttgatatccaggtgcaatcacaatcttttctgatagacttgaaatcctcacttaactttgtcaagaggtttttggaaactgcaactttaaaaaaaaagcgcagcaggtcctgaaataagttcattttgttcaatgttgtttagttttaattttggtgagaaatgaataaattggtttcatggttcaaa

SEQ ID NO: 462705 - DNA, 2201 bp, Homo sapiens
ggctggcagtagggtgccaggttcaaagagcccgcggcgtcttcacgcccctgcgctcagctctagactcagtcgctcgctgagagacgccctggaacgtctgtgtagcctcagtcgctgagagacgccctggaacgtctgtggcagcctctgtcacagtgggacccgcactggcagcgggaggcagagggaggaccctggaacatcccggaagccgggaaatggacgcagtggcctttgaggatgtggctgtgaacttcacccaggaggaatgggctttgctgggtccatcacagaagaatttatacagatatgtgatgcaagaaaccatcaggaacctggactgtataagaatgatatgggaagaacagaatactgaagatcagtacaaaaatcctaggagaaatctaagatgtcatatggtagagagattcagtgaaagtaaagacagtagtcagtgtggagaaacatttagcctcattcgagatagtattgtgaacaacagcatttgtcctggagaagatccatgtcaaagcgctgagtgtgaagaagtcataatgggtcatttatcccttaatagccacatcagagttgattctggacacaaaccacatgagtatcaggaatatggagagaagccacatacacataaacaacgtgggaaagccttcagttaccatcactcctttcagtcgcgtggaaggcctcacactggaaagaaacgctatgagtgtaaggaatgtggaaaaaccttcagttctcgtagaaaccttcgaagacacatggtagtgcaaggtggaaatagaccttataaatgtaagttgtgtgggaaagcttttttttggcccagtttattacgtatgcatgaaagaactcacactggagagaaaccgtatgaatgtaagcagtgttctaaagcctttcctttttacagttcctatcgaagacatgagagaatgcacactggggagaaaccgtatgaatgtaagcagtgttctaaagccttgcctgattccagttcctatataagacatgaaagaactcacactggagagaaaccatatacatgtaaacagtgtgggaaagccttcagtgtttccagttcccttcgaagacatgaaaccactcacagtgcagagaaaccctatgagtgtaagcaatgcgggaaaacatttcatcatcttggaagctttcagatacacatgaaaaggcacactggagatcgacctcataaatgtaagatatgtgggaaaggctttgatcgtcccagtttagttcgatatcatgaacgaattcacactggagagaaaccctatgaatgcaagcagtgtgggaaaacgttatctcatagctcaagctttcgaagacacatgataatgcacactggaggtggacctcataaatgcaagatatgtgggaaagcttttgtttatcctagtgtatgtcaaagacacgaaaagtctcacagtggagagaaaccctatgaatgcaagcagtgtgggaaagcgttatctcatagctcaagctttcgaagacatatggtaatgcatacgggagatgggccgaataaatgcaaggtatgtgggaaagcctttgtttatcccagtgtatgtcaaagacatgaaaagactcactggagagaaacaatatgaatgtaaactattataaagccttctatatttccagttccctttgatatcatgaataaacttacactggacagaaaccctataaatgtaaatgtgggaaagcctttcataatttttattcctttcaaaatcatgaaatatctcacactggagagatgctgtatgatataaggaatgtgggaaagtgatcgatttttttttaacaccattgtcaacataaaacaactcacagagcagaaaaactctgttttctacttttgcttcatagaaatatggggaaaccctcatgttttcaaattcattccctaatgtttcggcttccgattggagcttttaagtcattaacatttaaagtcttgaaggaaagagtgtttctacactgtgcagaggagggcaagttgagctcccagagttaaatccttcaatgtctctccctcatcatcaggtgctgatccactctggggctccatttcaggagtcaagagtctggctctcaagctcgggaatctgtttaacttcctgaaagggggtttcctgcttacttccctgaac

SEQ ID NO: 462706 - DNA, 1891 bp, Homo sapiens
atctgatctgctttcgaaatgaattagtgaccagagttcctcactgggatctcaggctgctgtcttcaagactggcgcagaggacgcagtggcctttgaggatgtggctgtgaacttcacccaggaggaatgggctttgctgggtccatcacagaagaatttatacagatatgtgatgcaagaaaccatcaggaacctggactgtataagaatgatatgggaagaacagaatactgaagatcagtacaaaaatcctaggagaaatctaagccacatcagagttgattctggacacaaaccacatgagtatcaggaatatggagagaagccacatacacataaacaacgtgggaaagccttcagttaccatcactcctttcagtcgcgtggaaggcctcacactggaaagaaacgctatgagtgtaaggaatgtggaaaaaccttcagttctcgtagaaaccttcgaagacacatggtagtgcaaggtggaaatagaccttataaatgtaagttgtgtgggaaagcttttttttggcccagtttattacgtatgcatgaaagaactcacactggagagaaaccgtatgaatgtaagcagtgttctaaagcctttcctttttacagttcctatcgaagacatgagagaatgcacactggggagaaaccgtatgaatgtaagcagtgttctaaagccttgcctgattccagttcctatataagacatgaaagaactcacactggagagaaaccatatacatgtaaacagtgtgggaaagccttcagtgtttccagttcccttcgaagacatgaaaccactcacagtgcagagaaaccctatgagtgtaagcaatgcgggaaaacatttcatcatcttggaagctttcagatacacatgaaaaggcacactggagatcgacctcataaatgtaagatatgtgggaaaggctttgatcgtcccagtttagttcgatatcatgaacgaattcacactggagagaaaccctatgaatgcaagcagtgtgggaaaacgttatctcatagctcaagctttcgaagacacatgataatgcacactggaggtggacctcataaatgcaagatatgtgggaaagcttttgtttatcctagtgtatgtcaaagacacgaaaagtctcacagtggagagaaaccctatgaatgcaagcagtgtgggaaagcgttatctcatagctcaagctttcgaagacatatggtaatgcatacgggagatgggccgaataaatgcaaggtatgtgggaaagcctttgtttatcccagtgtatgtcaaagacatgaaaagactcactggagagaaacaatatgaatgtaaactattataaagccttctatatttccagttccctttgatatcatgaataaacttacactggacagaaaccctataaatgtaaatgtgggaaagcctttcataatttttattcctttcaaaatcatgaaatatctcacactggagagatgctgtatgatataaggaatgtgggaaagtgatcgatttttttttaacaccattgtcaacataaaacaactcacagagcagaaaaactctgttttctacttttgcttcatagaaatatggggaaaccctcatgttttcaaattcattccctaatgtttcggcttccgattggagcttttaagtcattaacatttaaagtcttgaaggaaagagtgtttctacactgtgcagaggagggcaagttgagctcccagagttaaatccttcaatgtctctccctcatcatcaggtgctgatccactctggggctccatttcaggagtcaagagtctggctctcaagctcgggaatctgtttaacttcctgaaagggggtttcctgcttacttccctgaac

SEQ ID NO: 462707 - DNA, 1856 bp, Homo sapiens
cctgttgtaataagcagaggagtgttgtgtgtgcattttaattgccagcagagccgtagtttggtgggcgccctgagctcggctccgggaaagagccctttgcagctttctttgtggcagtcatttgcaaaggggtttggctctcagctacggcggaggcagagggggcagcagcaccgcttccttctatgccgatcccgggcgcaggatgggagaaggaaatactctctttgcactgcattaagccaggaggattcatctaccgtttaactgatgtttctctgtttgagggaataccaaagatactccaggtcttaggagggaatgattccccagtaatattccctgccctgacccaaagtgctggttggcctccctcccagggaagactgcttcttgcgtaacgccggccacagaaagagactccgatggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgctcccccaaatctagattgcaccccaatcagtatgctgaatcatagtggtgtgggggctttccggccctttgcctccaccgaggaccgggagagctatcagtcagcctttacgccggccaagcgacttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatctagcccagaggatcggaatgacagatgtaagtactttggttccagccctcccttacccccagtaagccctgcctcaccgtgatgttcaacaggtcggtggcgttttgcatgctcctagtaataggaagggccaactacttccctttcactagctgtggagtgctaacctttgcttgtctcttatcagtgagcactgatagttcttgaaatatttttctgaaagtagccagaggcaagttggccccagcacagcctttctctccggaccctagtgggcttattctctgaggacttgagtgaagaggggtgccaccgacgtactgaagtgaatgtcatttcattaagaagtgtcggctcctagggaatttggggggcctaaagaaacatgtccacccctcctctctttgctgtcctcgttatgtttgtctgatctcagtgttattttttagcttttccattgtatcacatccagcagactccacgtgattctattttcacaactctcagcccttgtccacatcaggctatttttcagagaaggacaaaggtgtcgtcaatcaccataaagcatttcacacagctgtgttttccttgcgatcgcaaggctagaaagccgacttctcttgggatttcacaggtttgctggatgcttatcctggggctcacttttaggactagacacggttgacctgtgtgactgctccaaatttgatgttcacaactattattaatttctgcttatgaaacagctttttttcatgttctccaagtgccttgttgggctctggctacacttatagctggaactaaacctttatttggaacttgt

SEQ ID NO: 462708 - DNA, 2309 bp, Homo sapiens
agttgctgggagccatagacctcgaagctggggcgtctgacacctgaggcccgaagtaggtggccagcttcttagagggccaacccagggcattaacacaccaggatagtggccgcagttgtattatcttgtgcatttgtcaagagaggtcatccgaacgctgagataaaggcttgggattccattgtctcatctctttctgggagtgattttcctctcatctggaagtgcagagacagagtcttcatagggaactgagattacctccaaaaaacatttgtgaagtgagcaattcctagaaggctgttaatgttgattaatgaaattatacaaaaagaatcataagatagctggagaagaaaattatctgtgatgcctggaaaagatacgtcccagtgggaggtaagtacagaatcctgagttctgagatgtgaggaattcagttgaggtaatggttctactataattgtggctaccattaaatttttgtttcttcaaattatgatttatttctcttcctgataacattgaacaatcataaatgtggagggaaaggaatcattgagggttgatttagagagagtaaacaggtgtaaagccatggttcctgtgtgttttaacaaatactaactgagcacccgccctgttgcagatgcatttctagattctggaaagtgaggagcgtctctgcccggccgccatcccatctaggaagtgaggagcgcctcttcccggccgccatcccatctaggaagtgaggagtgtctctgcccggctgcccatcgtctgagatgtggggagcgcctctgccctgccgccccgtccgggatgtgaggagcgtctctgcccggccgccccgtctgagaagtgaggagaccctctgcctggcaaccgccccgtctgaaaagtgaggagcccctccgcccggcagccgccccgtctgagaagtgaggagcccctccgcccggcagccaccccgtctgggaagtgaggagcgtctccgcctggcagccaccccgtccgggagggaggtggggggggtcagtcccccgcccggccagccgccccgtccgggagggaggtgggggggtcagccccctgcccggccagccgccccatccgggaggcgtcttctgggggttggagtggaggtttcccttcaatggcccgggtaggatttcgttgtcttgggggtagatctgaagactcactcccactgcgatgggtggggagtcctgcctggacattgaggatggatccgagagagaagcgcagagcctgacggatcagacaccaccaccccttagcggcgacgaaaccgagcgggagagcgaggtgatccagaccagacagggaaccctgcggggcgtggcggggccgggggtgaagcttgcagaggtagttgcccgtgaagagcagcttgtgcgctgttggatccttggagtggagtgggaactccgaggtgaagcgcaccgtgttcagcccgatgccggtgagcggccgttggaacgcgtggcagagaaagcttgcgcgagcccagggcgcgaagaagtacaacaaagggccaacggggaggtccaacggtccgaccccagccggactcgagctcactcggttgcaggcgttaggctcccagcggctctcagccgttaagtggagaatgttcaggactgtcgaggcgcgctccgcacctggcctgaaagcgggagatttggcaaccagtagcatgggaggatgccgcctcctccaggaagctctctagcgcttttccgagtcctggagccaggcgggacttctctgtggtcgcctagaaggggcctttctcttcaaatggaccccagcagccaaccacacagctgcctcagcaagcgtaggagatggcacatcagagaccaacaattgtcagcacagcaaaactgggcatttcttttcttactgagctttgcagctacctacacagttgtgtgtggcatctcctcctgggtgcaaggacatgagatgacatcagttactgtgatctccagtaaaatgtttaatacaagtggagacaatagataaccttttccaactcctgatcggggggtggaaagtgctcagtgtgctattaacttaaggcttttatagatgtgctttatcatgtaaaggctgttccctccaattctttctatactgagaaattttttcaaagaggtgttaaattttttcaacccatgtcacaaatctgcatatgtactcccctaaacctaaaataaaagttggaaagaaaaataaaactattacttgaaacccatgttgtcatagaaaagatg

SEQ ID NO: 462709 - DNA, 781 bp, Homo sapiens
agttgctgggagccatagacctcgaagctggggcgtctgacacctgaggcccgaagtaggtggccagcttcttagagggccaacccagggcattaacacaccaggtcagaaaaagcaaaaacaaaaacaaacaaaaaatgataatctataccaaaatatgttattactttaacacaaaaatatgaaaactaggtgtttgaaattatctttccgtactgtttgcttttcgctacagaaatgctattatttaacagaatattaataggattaatagtggcaattagactaatcacgtgtgagaaaaatatatttctgtcctctgatacaggaattttaagtttctattaaatatttaaattttgtgggttctatctaagatgctaaatgtaagaccttttaaaaggagaatgtaaataaggctaatcaaacagatattaactatatgtaataggcatttatctttctgtcccatcatacgtttaggagatatttactctttctggttccttttccagtaacacctctctgtattagctgcctgtagcctttatggcattcttcttttggtttatgtaatgctaaaactgaatacaggcaaacgtgaaattcaccttgactgtcagctccgctttttgtttgttttgtttttgttttgttttgagacagggtctccctctgtcgctcagactggaatgcagtggcgctatctcggcttactgtaacctctgcctcccaggttcaagtgattctcccacctcggcctccagagtagctgagacta

SEQ ID NO: 462710 - DNA, 1413 bp, Homo sapiens
atgcgcagggccgactgcattcccacggcgacggcctcctggcccgcatcatgactgttgttttcctcgcggtggccatagcttttggattttacattcagattggttcaaggggctttttcctttctctgtttgaaggaagccaccctctcgatccccagtcagcgtggcgtcctctcagcaacccgctcctggtcttgctttgactcctgtgctcccgggctgccgagaacacgtctggagcttttaaatcaggcttttaggttcatctctgtgaataatcatcacaaatatttactgagcatccttcatctcctggaagcctcgtggattatcttgctgaatcctcaccacagcagcccgctgagggaggtgctatcatcgtccctgtttttcaagggagagaatcaaggtttgggcagggacaaggtcttgctatgttgcccaagctgatcttgaactcctggcctcaagcaatcccaatagttcggtctcccaaattgctgagattgtgggtacaagccactgcacctggacttcttctgacattataaagcaaagagcattttcaaaagctgatgctacttgtgcatattccatatttgctgagcgcttactgtgtccccattaagtgccaggcacagttttcagcactgctttaaagtgtctacaagcttagaaagggcataggcatctcttgaaatccagtgttctagggaaagtttttcctgtggttttgcacagaacccaccgcttcctgtccaaggtgacagctttagctgggagagaaattaaaaatgcctccttggaatagctatctgatgtgtctaaatatgattgctgatgttagcaataggacctgcctattagcaatggtttgggcaactgtatgtgtgaggcagggagagaaagaggaagaaaatacagctctcactattgtttccaaatggcaagactgcccccccctcctagatcgtcattgctgtgtaacaaattgtcatacatttagcagtttaaaataccacacatttactcacagcttccatgggccacgagtgtggggacgagtgactgggtcgtctgctcagggtctcttacaagactccatcagcgtttcagctggggctggggtctcatctgaggctcagggtcctcactccaggtcacagggcagaattcatttctttcaagctacggatctcatggcagcttgctttttcaaggccagcaagggagagagtgaatctgctgcttttagtgtctgacctctcgatcttcttttaaatggctcatctgattagggcagacccacccaggataatctctcttttgactaacttacagtcaactcattagagatcctaattacatctgcaaaaatcccctcacctttgcctgataatgtgacatcat

SEQ ID NO: 462711 - DNA, 2530 bp, Homo sapiens
ggtccctggaccctgctgatcggaatagttgcactcaccgacgcagcagcagaaacacttgttttcctcctagaccacaatgaggaccaagaaagattctgaattctatgtctgtcatttcaggctggttaagaaccattgttggggagctagtggactcgtttggaggtgctctgggccgtggggctcccttaaggaaaggctacagcagggagatatgccacagcctttctggaatggtccttcagaaggaagctcaccccacttccaccctggcccaagaacctctcagaggtcagctaaggccagtgcctcccggaggtgcatagagatccctggagcgtggccatctatggctgctctctgctggagctgcccagtgaacaaacgctcccaggctccatgctgtctgaaggcttgtctctgcctgctccctaggaagatcctccagacaattcataagtccatgggggatgtggggtcccctgtagcaaggatcccagaggttcatgacaagtgtgagtcatccttcattcacttctttcccaggaaccattcaggttcaggagctagctctagcattcaggaaatgaagaagttttctaagtactttaaaaaaggaaagagagattgactcttcatattttcaagaagtaattgggagagttatgtgaactggaagaggcctcagatgtgaaatgaactaggcttcatgtaaatgaaaggtataatgatggctaaaacacgtacaaatcagatagcacctgcctgaagtacttagaccggggaaagaaggagaagaaagaagatagtgttcaaaatgtttgcttagatattgattagaaggtgaaatgtcaactgggctttcttgctagactgggtacctagcaaacgcgatcccatgaaataggcaaaaagaagtaaagaatatgcacatcaactattttatgtgacatggtctcaagttagcgattgatatactaagagtgtttgcctttgagatgtttttccccagtaatagtatctagattgcttgaagaaattactttaagtgctttaagaaaccacttaaaatctgataaattcactagatgaatagaatagaatgaaagaccaatgaattatgcttttaatgaatttattgcaactttgttgtcattttctacttcacacttctttttaccacgtatattttatagcaaaaacacacaatttttccgtgtgggtgagaatttgagttatagccacaatattattgttgaagtatgtttttcaaagttgtaggtctctattttaaacatcttttctgagaagataagtagctatgtgatttgcaaaatgcacagcttgtaagtcttgtaactttaaaatatttcccttctactctctgcctgcagcccttcatctctccgtttcttggtcaccagttgagtacaaactctctggttttaaaatgttatctatgtaaattcttctgccacagctggacaagatgcattcaagagtttttctgtttcctgtgtggtgaagcagctttcccctaacgactatttcccatcagtaccacaaagacctaccttcttaaccactgtttcaacggtttcttaccacttccacctttctgtagaacatttcatttggaaggagagtcacaaatacttgttcactgggctgttcagactgataacgtctcttgggacttgaacattgatgcacaattctcatctggaaaaaaaattcaactgtcaaacattggcaaagaataccagaaatgaaaacaaactcttttctgtcttagtgtcaccataagataatttgttttgctctcttagagaataaaattctttaccttttttctaaaaatcaaagtaaaaacatttcattatttgtctattttgcttactttagcaaaaattttaatacatttggattctaagcatgtgttttactgataaatgcattaaattgttattagaaactttagacctaagaatagaaaatcaaatgagattgacaaacatggtaacataggcttaattttttaataaggaatgagagaattctagtactttattctaatacaataaataatgtcaagacttttctttacatgttcaagatttttcatctaaaaaaagacccatgttaattattaactgcagaaacaaattataagtattatgtctacatttcttataaagaaataatatcttaatatagcctttaaaaatcataattattttacctgctcatttgtaaaatactaaatgtatttgaattatttttcataaattaaggaattataaaagtttaactgtcatttgtatattatatcttgatcttttcattcatttttattttctggatttatggtctttgttcttatggttttcattctgttatatgtttccaagatattttcaaatagagttttaactgagtgatgctagattagaacattttctagttcaaaatatttgatgattcaataacataaattatgttatggctcaaaattacccctcccctc

SEQ ID NO: 462712 - DNA, 2038 bp, Homo sapiens
ttcctaggtcctctgggactgtaggtgtcccttggcctctaccttcagcttcagcatgatgccaagtgacctcacccaggtgactgaagtgctcgtcattgttgggaacggggagggcccgagctcggaggcggcacatccaggggggacgccaagggagcaggacggagccatggaccccgccaggaaagcaggtgcccaggccatgatctggactgcaggctggctgctgctgctgctgcttcgcggaggagcgcaggccctggagtgctacagctgcgtgcagaaagcagatgacggatgctccccgaacaagatgaagacagtgaagtgcgcgccgggcgtggacgtctgcaccgaggccgtgggggcggtggagaccatccacggacaattctcgctggcagtgcggggttgcggttcgggactccccggcaagaatgaccgcggcctggatcttcacgggcttctggcgttcatccagctgcagcaatgcgctcaggatcgctgcaacgccaagctcaacctcacctcgcgggcgctcgacccggcaggtaatgagagtgcatacccgcccaacggcgtggagtgctacagctgtgtgggcctgagccgggaggcgtgccagggtacatcgccgccggtcgtgagctgctacaacgccagcgatcatgtctacaagggctgcttcgacggcaacgtcaccttgacggcagctaatgtgactgtgtccttgcctgtccggggctgtgtccaggatgaattctgcactcgggatggagtaacaggcccagggttcacgctcagtggctcctgttgccaggggtcccgctgtaactctgacctccgcaacaagacctacttctcccctcgaatcccaccccttgtccggctgccccctccagagcccacgactgtggcctcaaccacatctgtcaccacttctacctcggccccagtgagacccacatccaccaccaaacccatgccagcgccaaccagtcagactccgagacagggagtagaacacgaggcctcccgggatgaggagcccaggttgactggaggcgccgctggccaccaggaccgcagcaattcagggcagtatcctgcaaaaggggggccccagcagccccataataaaggctgtgtggctcccacagctggattggcagcccttctgttggccgtggctgctggtgtcctactgtgagcttctccacctggaaatttccctctcacctacttctctggccctgggtacccctcttctcatcacttcctgttcccaccactggactgggctggcccagcccctgtttttccaacattccccagtatccccagcttctgctgcgctggtttgcggctttgggaaataaaataccgttgtatatattctgccaggggtgttctagctttttgaggacagctcctgtatccttctcatccttgtctctccgcttgtcctcttgtgatgttaggacagagtgagagaagtcagctgtcacggggaaggtgagagagaggatgctaagcttcctactcactttctcctagccagcctggactttggagcgtggggtgggtgggacaatggctccccactctaagcactgcctcccctactccccgcatctttggggaatcggttccccatatgtcttccttactagactgtgagctcctcgagggcagggaccgtgccttatgtctgtgtgtgatcagtttctggcacataaatgcctcaataaagatttaattactttgtatagtgctttaaaggagtcacttccaccttgtttctcgcaataaccgctctagctgagctagggtgggcatcataaagcctttaacgggagagatatgggacctagagccgcagtcctgggggaagtcacggttgaactttaatctcctgggtctatcctgcatgtgggtggtcccactgataagtcttagtaaagctgtttttttttttttttttagaagaaaatatctgtctcccttttaccctccccaccttttactttgctct

SEQ ID NO: 462713 - DNA, 2195 bp, Homo sapiens
ttcctaggtcctctgggactgtaggtgtcccttggcctctaccttcagcttcagcatgatgccaagtgacctcacccaggtgactgaagtgctcgtcattgttgggaacggggagggcccgagctcggaggcggcacatccaggggggacgccaagggagcaggacggagccatggaccccgccaggaaagcaggtgcccaggccatgatctggactgcaggctggctgctgctgctgctgcttcgcggaggagcgcaggccctggagtgctacagctgcgtgcagaaagcagatgacggatgctccccgaacaagatgaagacagtgaagtgcgcgccgggcgtggacgtctgcaccgaggccgtgggggcggtggagaccatccacggacaattctcgctggcagtgcggggttgcggttcgggactccccggcaagaatgaccgcggcctggatcttcacgggcttctggcgttcatccagctgcagcaatgcgctcaggatcgctgcaacgccaagctcaacctcacctcgcgggcgctcgacccggcaggtaatgagagtgcatacccgcccaacggcgtggagtgctacagctgtgtgggcctgagccgggaggcgtgccagggtacatcgccgccggtcgtgagctgctacaacgccagcgatcatgtctacaagggctgcttcgacggcaacgtcaccttgacggcagctaatgtgactgtgtccttgcctgtccggggctgtgtccaggatgaattctgcactcgggatggagtaacaggcccagggttcacgctcagtggctcctgttgccaggggtcccgctgtaactctgacctccgcaacaagacctacttctcccctcgaatcccaccccttgtccggctgccccctccagagcccacgactgtggcctcaaccacatctgtcaccacttctacctcggccccagtgagacccacatccaccaccaaacccatgccagcgccaaccagtcagactccgagacagggagtagaacacgaggcctcccgggatgaggagcccaggttgactggaggcgccgctggccaccaggaccgcagcaattcagggcagtatcctgcaaaaggggggccccagcagccccataataaaggctgtgtggctcccacagctggattggcagcccttctgttggccgtggctgctggtgtcctactgtgagcttctccacctggaaatttccctctcacctacttctctggccctgggtacccctcttctcatcacttcctgttcccaccactggactgggctggcccagcccctgtttttccaacattccccagtatccccagcttctgctgcgctggtttgcggctttgggaaataaaataccgttgtatatattctgccaggggtgttctagctttttgaggacagctcctgtatccttctcatccttgtctctccgcttgtcctcttgtgatgttaggacagagtgagagaagtcagctgtcacggggaaggtgagagagaggatgctaagcttcctactcactttctcctagccagcctggactttggagcgtggggtgggtgggacaatggctccccactctaagcactgcctcccctactccccgcatctttggggaatcggttccccatatgtcttccttactagactgtgagctcctcgagggcagggaccgtgccttatgtctgtgtgtgatcagtttctggcacataaatgcctcaataaagatttaattactttgtataggtggaaaaaaaaaaaacaaaaacacaaaaaaaaaaacaaaaaaaaaaaaacgcgaggggggcggggccccaaaaaattcccccgcgggggccccccacttctttcggcgtgccccccgcgtttttttgataccaaaaaggggggggccccccataaatggggggcgcaccgctttctaacacacgaccaaagtgcagctcctagcacccatagctatcaacaacaacggcccttcggatagtgggggaaaccacatccgcacactccgggggacaatcctttttcatgaacagcagccccatacaacatcagcggggggcacgagcactctacttgcggagcacacactccccaaaacgagcgttttacaagccgtcgcaggcggactatttcaaacatttcaccgggttatatacgggg

SEQ ID NO: 462714 - DNA, 1620 bp, Homo sapiens
cgagggggctggtacggctccggaggtacgggcccgctcctccctgcttcggtcgttctttccgctctgagcggctctttgggggcgtccatccgccaattcctgcctgtcggtcctgtggtgttggcctatttgaggccccgcccctcccagaccctacccaactctgggccacgccccatctgagaccacgcccacagctaatcccgcccttgtccctctccctagtccacggacaattctcgctggcagtgcggggttgcggttcgggactccccggcaagaatgaccgcggcctggatcttcacgggcttctggcgttcatccagctgcagcaatgcgctcaggatcgctgcaacgccaagctcaacctcacctcgcgggcgctcgacccggcaggtaatgagagtgcatacccgcccaacggcgtggagtgctacagctgtgtgggcctgagccgggaggcgtgccagggtacatcgccgccggtcgtgagctgctacaacgccagcgatcatgtctacaagggctgcttcgacggcaacgtcaccttgacggcagctaatgtgactgtgtccttgcctgtccggggctgtgtccaggatgaattctgcactcgggatggagtaacaggcccagggttcacgctcagtggctcctgttgccaggggtcccgctgtaactctgacctccgcaacaagacctacttctcccctcgaatcccaccccttgtccggctgccccctccagagcccacgactgtggcctcaaccacatctgtcaccacttctacctcggccccagtgagacccacatccaccaccaaacccatgccagcgccaaccagtcagactccgagacagggagtagaacacgaggcctcccgggatgaggagcccaggttgactggaggcgccgctggccaccaggaccgcagcaattcagggcagtatcctgcaaaaggggggccccagcagccccataataaaggctgtgtggctcccacagctggattggcagcccttctgttggccgtggctgctggtgtcctactgtgagcttctccacctggaaatttccctctcacctacttctctggccctgggtacccctcttctcatcacttcctgttcccaccactggactgggctggcccagcccctgtttttccaacattccccagtatccccagcttctgctgcgctggtttgcggctttgggaaataaaataccgttgtatatattctgccaggggtgttctagctttttgaggacagctcctgtatccttctcatccttgtctctccgcttgtcctcttgtgatgttaggacagagtgagagaagtcagctgtcacggggaaggtgagagagaggatgctaagcttcctactcactttctcctagccagcctggactttggagcgtggggtgggtgggacaatggctccccactctaagcactgcctcccctactccccgcatctttggggaatcggttccccatatgtcttccttactagactgtgagctcctcgagggcagggaccgtgccttatgtctgtgtgtgatcagtttctggcacataaatgcctcaataaagatttaattactttgtatag

SEQ ID NO: 462715 - DNA, 323 bp, Homo sapiens
cgtctgcaccgaggccgtgggggcggtggagaccagtgagtggggacccccgggccacgcacaccactgcaggctcctccggcccagccccgcctccttatagtcctttctggatctggccacgcccctttaacgcggccccacccctccctttcagcctggccgggaccctacgacacagccttgcaggccaggccttctctattaacaattacaagcgcgaggagcagagagttgagaactgggtggggcggacggggagagctcgggtttggaacgaggtcacgtcctatgcactttttctgctccaccaatgagacctc

SEQ ID NO: 462716 - DNA, 363 bp, Homo sapiens
tacagtgggcatacagggctgtcggaaggatgtgcccacagttggcatagtgggtgtgaaggaaaagggtccagtgattcccgtgcttccagatttgtggaaagcttttccctactcctgccctggaaaagtgtgtgcaataagactgtctaatcccgggacagagggcatgggaaggactatttctccttgggggtggacgctttagcaaggagggctcaggtctattcggctccgctcccccaggagcgcaggccctggagtgctacagctgcgtgcagaaagcagatgacggatgctccccgaacaagatgaagacagtgaagtgcgcgccgggcgtggacgtctgcaccgaggccgtgg

SEQ ID NO: 462717 - DNA, 1775 bp, Homo sapiens
ttcctaggtcctctgggactgtaggtgtcccttggcctctaccttcagcttcagcatgatgccaagtgacctcacccaggtgactgaagtgctcgtcattgttgggaacggggagggcccgagctcggaggcggcacatccaggggggacgccaagggagcaggacggagccatggaccccgccaggaaagcaggtgcccaggccatgatctggactgcaggctggctgctgctgctgctgcttcgcggaggagcgcaggccctggagtgctacagctgcgtgcagaaagcagatgacggatgctccccgaacaagatgaagacagtgaagtgcgcgccgggcgtggacgtctgcaccgaggccgtgggggcggtggagaccatccacggacaattctcgctggcagtgcggggttgcggttcgggactccccggcaagaatgaccgcggcctggatcttcacgggcttctggcgttcatccagctgcagcaatgcgctcaggatcgctgcaacgccaagctcaacctcacctcgcgggcgctcgacccggcaggtaatgagagtgcatacccgcccaacggcgtggagtgctacagctgtgtgggcctgagccgggaggcgtgccagggtacatcgccgccggtcgtgagctgctacaacgccagcgatcatgtctacaagggctgcttcgacggcaacgtcaccttgacggcagctaatgtgactgtgtccttgcctgtccggggctgtgtccaggatgaattctgcactcgggatggagtaacaggcccagggttcacgctcagtggctcctgttgccaggggtcccgctgtaactctgacctccgcaacaagacctacttctcccctcgaatcccaccccttgtccggctgccccctccagagcccacgactgtggcctcaaccacatctgtcaccacttctacctcggccccagtgagacccacatccaccaccaaacccatgccagcgccaaccagtcagactccgagacagggagtagaacacgaggcctcccgggatgaggagcccaggttgactggaggcgccgctggccaccaggaccgcagcaattcagggcagtatcctgcaaaaggggggccccagcagccccataataaaggctgtgtggctcccacagctggattggcagcccttctgttggccgtggctgctggtgtcctactgtgagcttctccacctggaaatttccctctcacctacttctctggccctgggtacccctcttctcatcacttcctgttcccaccactggactgggctggcccagcccctgtttttccaacattccccagtatccccagcttctgctgcgctggtttgcggctttgggaaataaaataccgttgtatatattctgccaggggtgttctagctttttgaggacagctcctgtatccttctcatccttgtctctccgcttgtcctcttgtgatgttaggacagagtgagagaagtcagctgtcacggggaaggtgagagagaggatgctaagcttcctactcactttctcctagccagcctggactttggagcgtggggtgggtgggacaatggctccccactctaagcactgcctcccctactccccgcatctttggggaatcggttccccatatgtcttccttactagactgtgagctcctcgagggcagggaccgtgccttatgtctgtgtgtgatcagtttctggcacataaatgcctcaataaagatttaattactttgtatag

SEQ ID NO: 462718 - DNA, 1253 bp, Homo sapiens
acaccttttcttcctctcggctcccctcgcaggtaatgagagtgcatacccgcccaacggcgtggagtgctacagctgtgtgggcctgagccgggaggcgtgccagggtacatcgccgccggtcgtgagctgctacaacgccagcgatcatgtctacaagggctgcttcgacggcaacgtcaccttgacggcagctaatgtgactgtgtccttgcctgtccggggctgtgtccaggatgaattctgcactcgggatggagtaacaggcccagggttcacgctcagtggctcctgttgccaggggtcccgctgtaactctgacctccgcaacaagacctacttctcccctcgaatcccaccccttgtccggctgccccctccagagcccacgactgtggcctcaaccacatctgtcaccacttctacctcggccccagtgagacccacatccaccaccaaacccatgccagcgccaaccagtcagactccgagacagggagtagaacacgaggcctcccgggatgaggagcccaggttgactggaggcgccgctggccaccaggaccgcagcaattcagggcagtatcctgcaaaaggggggccccagcagccccataataaaggctgtgtggctcccacagctggattggcagcccttctgttggccgtggctgctggtgtcctactgtgagcttctccacctggaaatttccctctcacctacttctctggccctgggtacccctcttctcatcacttcctgttcccaccactggactgggctggcccagcccctgtttttccaacattccccagtatccccagcttctgctgcgctggtttgcggctttgggaaataaaataccgttgtatatattctgccaggggtgttctagctttttgaggacagctcctgtatccttctcatccttgtctctccgcttgtcctcttgtgatgttaggacagagtgagagaagtcagctgtcacggggaaggtgagagagaggatgctaagcttcctactcactttctcctagccagcctggactttggagcgtggggtgggtgggacaatggctccccactctaagcactgcctcccctactccccgcatctttggggaatcggttccccatatgtcttccttactagactgtgagctcctcgagggcagggaccgtgccttatgtctgtgtgtgatcagtttctggcacataaatgcctcaataaagatttaattactttgtatag

SEQ ID NO: 462719 - DNA, 2161 bp, Homo sapiens
tggcaggtcaattgcagggatgcctgctttgcctgttcactcacattacagcccaggactcagtcaaggatgcctactggaagcctgttcttcagctttgggactcagactggcttccttgctcctcagcttgcagatggcctattgtgggaccttgtgattgtctctttcagccctaccatttggcgggtcccgagttcttgtcctgcatccaggaagaatgaggtatgcagacaactggaagatggagtgaagcttgttgattaagaagattttgtcttccccctcgttgctgatctgctccttgagcaggcagatgaccttcctctggtccagcaccacctggatgttgaggtagatcacagccagcagcagggccaacaccaggaagacgaagaaggtgttttccaccaggtaccggtgcgcccagggcagccaggagcccctggggcccgctgcctccagttggggcacccacatcctgcgggcctcgtacatggtgtccagggtccggaaggggccgcagatggctgagggtgtagcagaggccagacggcatagcagaggaagaggtggcgcccaggaaagcggggaagcagagcagcgtgaggaagatggtgctcacgtgggaggccagccaaggccggagcagtgcctggcagttggccaaaaggctggtctacttgacgtagaagacgagcagcagcttgatgatctgcaccgcgtggaggagcggcgagaaagagcacccccagccaggtcagagtcggcccgacgagtccatcaccaggaacccatacagcacgggttcctcccagcactggccctgcagggcgcccaccctgcggccctgccagtggtagcacagtgtccccaggatggccagcttgaggatgaagttcctgcagatggccacgtacaactccagcaccggggagtcatgcagctccagggcggtcaggccaaggcacgggtaggggccccccaggttgagggggccgaccaccagaggcaggaccagcagcgcgggctcctggccagcagcctccggattctgcatcatgaactccgagaagatgtggacggccacagcgcagcccagcgcagtccccagacacaggagccacatgagccccagcatggccgcctgccgcagcctcccgcacacgctcctggggctctgccgcagctgctgctcgggccagcagctccttctcccgtggctgtaatacatgatgatgtgggtgaagcagcctgtgtctttgaggagctccaggccagagcagatgcgggcagggcccggcggggcgggcgtgaaggcggcctccgggcccacaatgaaggccacgagcagcagcagcaggaaggcgttgaaggccagcagggtcttaaggaagaggaagtaggagagcacgttggagctgaactagcccctgatgcgcttcaggacagcagcgccagccccaggctgtgcaaggccagcacacagacatatctgagccaaccacagcaggagcagactctgccatggccccgcaggctcctccacttcccgctctgggttcggctcttctctcgcaggccgcgtttctcagccaggcttaggggaatccctcgaagcacgtggtcccgctgcgccacagccaggccctggagctccttcaccaggaggctccgcttctcctcctcttcctcccaggacgtggggtccagcttcaggtcgtacagacgcaggctgtgccgggaggagcgcaccaagtctgcgagcaggggccggccaatggtgaggctgggaatgctggccaggacgcagagtgtggccgtgctgtgggtgccctcgggccccaagagtgtctgctggccactcgctgtggccaccacccctctccctctgctacagctccagcccctcctgggcctcccagcggctctgctcttggatgagcaagtggaaggagtagtgcatttcagtctcatcaacctccttaatatgaaagagggtatctatagcaaaacctctatcaaacctcatactttaatgtgcgaggaatgcttctaaactttggaagcattttatttaacagtagtaactaaacgagccaataaaatgggggtacttctgtcaccatcaatgctcaccatgatattagaggtcccgatc

SEQ ID NO: 462720 - DNA, 423 bp, Homo sapiens
aatcatatccatgtcaggcggcaccaaacctaaatctgctttgcctcagcagacaggacatgttgagtttggccagtgagtgctgcaggatactggagggagggcaacagagaggaaggtcacctacatgtctatgttcagaagctgccttgatgccacatgcgggaggctggaaacgctgaaggatgaccactgctcagcagcagtctaccagtgatggatgagagttggtgcacaaataccccagctcccttgcctctcagtttggataatcctgaaaaggtgtgtactatgctatttctgagattaagccctagttacccatagtggtagctaaatatagtagttggctgtattctccatcacttcttgaatcccctgccagtgttctctgcacctccttaataaaccacttgaaacaaa

SEQ ID NO: 462721 - DNA, 1754 bp, Homo sapiens
agaaacaaagtggatgcccaaccaagaaaaagtcatactgaaatggaaacccctgcctccttgagcctgaaagccttgggatttctggccctgtcaaggttaattagggactcctgtacaaacgaagcctgcagtctatcaaatgtgcagacgtatgtggttggcagtgagtggggctatggcttagcaagtactggagtctcattatggagacacatgatccttgtgtgctttgctaggagaaaaccagaccctatcttttttctccccttttccctgtgtttccaattggtctgcagccctgagattgctcatagggagagaaaggtgaaagtacataaaaatttgattttcttagatgcagaattgtatgtccagttaatgtttaaaacttttaaggctttggtctcagagacctaggctgggagcaggagacatttattcaggtctttacacataaacatgtttcagctcattcccctgctctgtgaagaacacaagttggttcttaaccttttctctcatcgcagatccctttggaaatctaaagaagccatggatcctcaggaagtgaataagtgcaacttatgtcttagccacattaaaacttcgtttttatctcactattcctttacagtataaatcactggggacattttccccctgtacatagatgtaaatcctaacagattctatttcccaggatgtaagtcctaacagattccttcacacctgaatattatgcctgtagtcactttatgttaaagcataggtttcatttagaagtcagaatatccaagatattaaccttaactccaaactttatttatagtgtgttctttctcagtttgggcctgcttgtttggaaggctcaaaaagggaaggagggaagtaaggtgataggaaagttcttactggagctggccttatgttctagttgtggaagatgtttggagtagactcctttccttgtccttggagctttggagcttcttgctgggcaccacctgagtctacagtatttgtgatgtgggccaggaacattctctttacatggcttctgggagcctcttaaggtctagattttagatccttgctctcaaattttctagacctgtggcagaagctcttgggcaggtgatatggtttggctgtgtccccacccaaatctcactttgaatggtaataatgcccacacatcaaggcagggccaggtggagataattgaatcatgggggttgtttctcccatactgttctcatggtagtgaataagcctcatgagatctgatggttttcttagagactggcagatgagtcatacatgataaataaatgtaagacaaagactacaatcagtaccataaaaaagtatatcatagacatgtttgatccgagacggaaggttccagagtaagtgacaactaagcagagatcttaaagatgtgggaacacctacatgtctatgttcagaagctgccttgatgccacatgcgggaggctggaaacgctgaaggatgaccactgctcagcagcagtctaccagtgatggatgagagttggtgcacaaataccccagctcccttgcctctcagtttggataatcctgaaaaggtgtgtactatgctatttctgagattaagccctagttacccatagtggtagctaaatatagtagttggctgtattctccatcacttcttgaatcccctgccagtgttctctgcacctccttaataaaccacttgaaacaaa

SEQ ID NO: 462722 - DNA, 2006 bp, Homo sapiens
agaaacaaagtggatgcccaaccaagaaaaagtcatactgaaatggaaacccctgcctccttgagcctgaaagccttgggatttctggccctgtcaaggttaattagggactcctgtacaaacgaagcctgcagtctatcaaatgtgcagacgtatgtggttggcagtgagtggggctatggcttagcaagtactggagtctcattatggagacacatgatccttgtgtgctttgctaggagaaaaccagaccctatcttttttctccccttttccctgtgtttccaattggtctgcagccctgagattgctcatagggagagaaaggtgaaagtacataaaaatttgattttcttagatgcagaattgtatgtccagttaatgtttaaaacttttaaggctttggtctcagagacctaggctgggagcaggagacatttattcaggtctttacacataaacatgtttcagctcattcccctgctctgtgaagaacacaagttggttcttaaccttttctctcatcgcagatccctttggaaatctaaagaagccatggatcctcaggaagtgaataagtgcaacttatgtcttagccacattaaaacttcgtttttatctcactattcctttacagtataaatcactggggacattttccccctgtacatagatgtaaatcctaacagattctatttcccaggatgtaagtcctaacagattccttcacacctgaatattatgcctgtagtcactttatgttaaagcataggtttcatttagaagtcagaatatccaagatattaaccttaactccaaactttatttatagtgtgttctttctcagtttgggcctgcttgtttggaaggctcaaaaagggaaggagggaagtaaggtgataggaaagttcttactggagctggccttatgttctagttgtggaagatgtttggagtagactcctttccttgtccttggagctttggagcttcttgctgggcaccacctgagtctacagtatttgtgatgtgggccaggaacattctctttacatggcttctgggagcctcttaaggtctagattttagatccttgctctcaaattttctagacctgtggcagaagctcttgggcaggtgatatggtttggctgtgtccccacccaaatctcactttgaatggtaataatgcccacacatcaaggcagggccaggtggagataattgaatcatgggggttgtttctcccatactgttctcatggtagtgaataagcctcatgagatctgatggttttcttagagactggcagatgagtcatacatgataaataaatgtaagacaaagactacaatcagtaccataaaaaagtatatcatagacatgtttgatccgagacggaaggttccagagtaagtgacaactaagcagagatcttaaagatgtgggaacacctacatgtctatgttcagaagctgccttgatgccacatgcgggaggctggaaacgctgaaggatgaccactgctcagcagcagtctaccagtgatggatgagagttggtgcacaaataccccagctcccttgcctctcagtttggataatcctgaaaagacccagcaagaaatgattccaagatcacctagctgatctcatgctctatctggatttgagtgaagatatacatattcaccaagtcttgactcagtcaccttttgtgcaggcccaatagaagcaaatgcaggtatgatctggagaagcatatcttgaatctcaaaaagtcaggacagacaacaccataagaaacagcagggggaaaagaaaaaagcagaatcaggctcagaactacagacaccttcagagggcagtgttccattttattgagggagatctgaagagatgaagtgacttgccagagcacaggtccagtaagtgtcaggtttcaagttctttgagttgagattcagtcatttgaaagccatttatctagtggaataacaccctggg

SEQ ID NO: 462723 - DNA, 480 bp, Homo sapiens
  misc_feature (67)..(67): n is a, c, g, or t
catcatgatgatacgggcaacagtcccttccatacacctttaaatccaagtctcttgaggaccaganaagctgctgggaaaattgtgtgagcagaacaaggtggtgagggagcaggaccggctggtgcagcagctccgagctgagaaggagagcctggaaagtgccttgatggggacccaccaggagctggagatgtttggaagccagcccgcctacccagaaaagctgcgacacaaaaaggattcactgcagaaccagctcatcaacatccgcgtggagctgtctcaggcgaccacggtaacccagggagcggggttcgtgcaccccacctcatcagcactaggcagcagggccaccacctcccagcttgtgctgtcctagtccagttttcctcagaggacaagagctgagtactcccgtgcagaggggcataaacaaagacctcaatattgccctgcaaataaatagcaagtcagcca

SEQ ID NO: 462724 - DNA, 539 bp, Homo sapiens
ctctgcgggggctgtctctccatctctctctctccttctggtggcttttcatacctttgattcatgtcttctctcaccacaacaagattctgcctacctcctcctcatcccccttcttttctgatctaccacccactcacccttccctcccatgctggctgtatccatttctccactgagcgctgggccgttttgcctacggcagtgagatctgcttgtaacatgaatgcagactttgttgggagatagatcagtcagtctattctgtgcccagcatggcattagtccctacaggtaactagaaaggagaatacggctatgcccctgccttcagggagcttcagggtagtgggaagtgccaggtagcagcaggaggtggcaacacggtattcatgtagtgaaggggagccataataggttctgccaggtgcagggaagtgaggccgtgtgggctgaaggtcagggacaaaacaagcagcatgtgagttaggccttgaagttaaaaggcccagagggtaaaatctggctcagtggaaagg

SEQ ID NO: 462725 - DNA, 550 bp, Homo sapiens
taggggggatagggttgtggtcaagggcgctaacttcgggtccaaatagacccatattgagatgatggtcatgctgcttactaaatagatggccttgggtgtaagtctcttcatctctgaagaggggatagctgctgcccttatctcctagagtcatgcagccgaaatgagttagcactgtatatgcaaattgcttagcatagtgcctggtgctgagggatgctaaataaatggaaggtcttaccttttagactgtcaactgtaattgaattcatgactcttcaggcgtacgctgggagtgggtattagaaaagggctgtttggatgtgaagaaaagcagtaaaatggaagctcttgccccacgaaaaacaggataccataaagtgttcacttagatgggcattcactcgaaaaccacccatctttcccctgagggagctcggaagggtgcgtcctcagtcttggttcagaaactcgggcaattctggggtgccatctcctagaggctgaagagcagaggcagcccatgggaaagatgactgctggaggg

SEQ ID NO: 462726 - DNA, 461 bp, Homo sapiens
tgcctcctgctggcccaaagggatgtgggttccaaggggtctgggctgagagaaagggctggacactcctcatggccatttcctttgactcactgtgtggctgcttcagaatgaggtgctgaaccggcaaatccaaaaggagatctggaggatccaggacgtgatggaggggctgaggaagaacaacccctcccggggcacggacaccgccaagcacagaggtgggtgcctcctgtgccagcctcctaggctgcctgcctcaccaggagtgctccagtatttctgacctccatcccactcctgccagctcacactgtgttctagggtggtaggtaggggtcccttaccccccacagaatagaccaaataaacaactcagagacactgttgaccctgacactctaaagtcctccccagaaaaggtcaaaagcacctaagcctccccagcccccaagcaaggg

SEQ ID NO: 462727 - DNA, 348 bp, Homo sapiens
gggaggcttaggtgcttttgaccttttctgggaaggtcttaccttttagactgtcaactgtaattgaattcatgactcttcaggcgtacgctgggagtgggtattagaaaagggctgtttggatgtgaagaaaagcagtaaaatggaagctcttgccccacgaaaaacaggataccataaagtgttcacttagatgggcattcactcgaaaaccacccatctttcccctgagggagctcggaagggtgcgtcctcagtcttggttcagaaactcgggcaattctggggtgccatctcctagaggctgaagagcagaggcagcccatgggaaagatgactgctggaggg

SEQ ID NO: 462728 - DNA, 3206 bp, Homo sapiens
gacatgtccaataaaacaggtgggaaacgcccggctaccaccaacagtgacatacccaaccacaacatggtgtccgaggtccctccagagcggcccagcgtccggttgctgagtgcttgttatggctggataccttgctggctctggtgataaagagatgaaaaagacaaaagttcctccctgcaaagagctcatggtgcaatggaagagatagaaagctgcattgtgacaggcaactcgcacagcccgcaaagccgtcgcctttggcaagcgctcacactccatgaagcggaaccccaatgcacctgtcaccaaggcgggctggctcttcaaacaggccagctccggggttaagcagtggaacaagcgctggttcgtcctggtggatcgctgcctcttctactataaagatgagaaggaagagagtatcctgggcagcatccccctcctgagcttccgggtagccgcagtgcagccctcagacaacatcagccggaaacacacgtttaaggtgactgtgtgctgggtggatgaggccgaggccagctccacacgctgcctctccccacaggctgagcatgccggggtccgcacctacttcttcagtgccgagagccccgaggagcaagaggcctggatccaggccatgggggaggctgctcgagtacagatccctccagcccagaagtcagtgccccaagctgtgcggcacagccatgagaagccagactcggagaacgtcccacccagcaagcaccaccagcagccaccccacaacagcctccctaagcctgagccagaggccaagactcgaggggagggtgatggccgaggctgtgagaaggcagagagaaggcctgagaggccagaagtcaagaaagagcctccggtgaaagccaatggcctcccagctggaccggagccagcctcagagccgggcagcccttaccccgagggcccaagagtgccagggggtggggaacagcctgcccagcccaatggctggcagtaccactccccaagccggccagggagcacagctttcccgtctcaggatggagagactgggggacaccggcggagtttcccaccacgcaccaaccctgacaaaattgcccagcgcaagagctccatgaaccagcttcagcagtgggtgaatctgcgccggggggtacccccgcctgaagaccttcggagtccctctaggttctatcctgtgtctcgcagggtccctgagtactatggcccctactcctcccagtaccccgatgattatcagtactacccgccaggagtgcggccggagagcatctgttccatgccggcctatgatcggatcagcccgccctgggccctggaggacaagcgccatgccttccgcaatgggggtggccctgcctaccagctgcgagagtggaaggagcccgccagctacgggcggcaggatgccaccgtctggatcccaagcccctcccggcagccagtctattatgatgagctggatgccgcctctagctccctgcgccgcctgtccctgcagccccgctcccactctgtgccccgctcacccagccagggctcctacagccgtgcccgcatttactcccctgtccgctcacccagtgcccgttttgagcggctgccacctcgcagtgaggacatctatgctgaccctgctgcctatgtgatgaggcgatccatcagctcccccaaggtccctccatacccagaagtgttccgggacagcctccacacctacaagttaaacgagcaagacacagataagctgctgggaaaattgtgtgagcagaacaaggtggtgagggagcaggaccggctggtgcagcagctccgagctgagaaggagagcctggaaagtgccttgatggggacccaccaggagctggagatgtttggaagccagcccgcctacccagaaaagctgcgacacaaaaaggattcactgcagaaccagctcatcaacatccgcgtggagctgtctcaggcgaccacggccctgacaaacagcaccatagagtatgagcacctcgagtctgaggtctctgccctgcacgatgacctctgggagcagctcaatttggacacccagaatgaggtgctgaaccggcaaatccaaaaggagatctggaggatccaggacgtgatggaggggctgaggaagaacaacccctcccggggcacggacaccgccaagcacagaggaggacttggcccctcagccacctacagctccaacagcccggccagccccctcagctctgccagcctcaccagccccctgagccccttttcactggtgtcgggctctcaggggtcccccaccaagcctggctccaacgagcccaaggcaaactatgaacaaagcaagaaagacccccaccagacattgcccctggacacccccagagacatcagccttgtgcccaccaggcaagaggtagaggcagagaagcaggcagctctcaacaaaggtgggtacctctgcaagctcatgcaggcctgagctgggctgcgagcccaggggcctgtgtgtgtacctactcatctccctctgctgttcaagaaattcagggctggagaggaaggtggaacacgtgagaggaggggcaagagccccactggaggaggagctctcctgcagggagatgtgtcaggggatgaggaagctatgctgcattggtcagggttctctagagggacagaactaataagatatataatatatatgtgtaaaggggagtttagtaagtattaacttacatgctgacaaggtcccacaataggctgtctacaagctgaggagcaagaagagccagtctgagttccaaaactgaagaacttggagtccgatgtttgagggcaggaagcatccagcacgggagaaaaatgtaggctgggaggctaggccagtctctccttttcatgtttttctgcctgctttatattcactggcagctgattagattgtgcccaccagattaagggtagctctgccttccccagcatgttaatctgttttggcaacaccctcacagacacacccaggatcaatactttgtatccttcaatccagccaagttgacactcaatattaatcatcacaagtccaccccttgtcaacttgaacccatacacatctcctgagatcatacataatcttcaaataaagacaataataaggtcat

SEQ ID NO: 462729 - DNA, 3146 bp, Homo sapiens
  misc_feature (61)..(61): n is a, c, g, or t
  misc_feature (151)..(151): n is a, c, g, or t
  misc_feature (157)..(157): n is a, c, g, or t
gctcttgcgctgggcaattttgtcagggttggtgcgtggtgggaaactccgccggtgtccnccagtctctccatcctgagacgggaaagctgtgctccctggccggcttggggagtggtactgccagccattgggctgggcaggctgttcnccaccncctggcactcttgggccctcggggtaaggactgcccggctctgaggctggctccggtccagctgggaggccattggctttcaccgtcgtcttctgtctctccctttggtgtttggttgacctgttctctgcttctcctccttctgaccgcgtgaggacccctcctctggacaggagctctcttctgggttcccgcccgcagtacctgctcgcagccaccaactaggtgactgtgtgctgggtggatgaggccgaggccagctccacacgctgcctctccccacaggctgagcatgccggggtccgcacctacttcttcagtgccgagagccccgaggagcaagaggcctggatccaggccatgggggaggctgctcgagtacagatccctccagcccagaagtcagtgccccaagctgtgcggcacagtctggcaccccctgccccactccatgctgggctagagtcactgacagcatctcccttggcatcctgcagccatgagaagccagactcggagaacgtcccacccagcaagcaccaccagcagccaccccacaacagcctccctaagcctgagccagaggccaagactcgaggggagggtgatggccgaggctgtgagaaggcagagagaaggcctgagaggccagaagtcaagaaagagcctccggtgaaagccaatggcctcccagctggaccggagccagcctcagagccgggcagcccttaccccgagggcccaagagtgccagggggtggggaacagcctgcccagcccaatggctggcagtaccactccccaagccggccagggagcacagctttcccgtctcaggatggagagactgggggacaccggcggagtttcccaccacgcaccaaccctgacaaaattgcccagcgcaagagctccatgaaccagcttcagcagtgggtgaatctgcgccggggggtacccccgcctgaagaccttcggagtccctctaggttctatcctgtgtctcgcagggtccctgagtactatggcccctactcctcccagtaccccgatgattatcagtactacccgccaggagtgcggccggagagcatctgttccatgccggcctatgatcggatcagcccgccctgggccctggaggacaagcgccatgccttccgcaatgggggtggccctgcctaccagctgcgagagtggaaggagcccgccagctacgggcggcaggatgccaccgtctggatcccaagcccctcccggcagccagtctattatgatgagctggatgccgcctctagctccctgcgccgcctgtccctgcagccccgctcccactctgtgccccgctcacccagccagggctcctacagccgtgcccgcatttactcccctgtccgctcacccagtgcccgttttgagcggctgccacctcgcagtgaggacatctatgctgaccctgctgcctatgtgatgaggcgatccatcagctcccccaaggtccctccatacccagaagtgttccgggacagcctccacacctacaagttaaacgagcaagacacagataagctgctgggaaaattgtgtgagcagaacaaggtggtgagggagcaggaccggctggtgcagcagctccgagctgagaaggagagcctggaaagtgccttgatggggacccaccaggagctggagatgtttggaagccagcccgcctacccagaaaagctgcgacacaaaaaggattcactgcagaaccagctcatcaacatccgcgtggagctgtctcaggcgaccacggccctgacaaacagcaccatagagtatgagcacctcgagtctgaggtctctgccctgcacgatgacctctgggagcagctcaatttggacacccagaatgaggtgctgaaccggcaaatccaaaaggagatctggaggatccaggacgtgatggaggggctgaggaagaacaacccctcccggggcacggacaccgccaagcacagaggaggacttggcccctcagccacctacagctccaacagcccggccagccccctcagctctgccagcctcaccagccccctgagccccttttcactggtgtcgggctctcaggggtcccccaccaagcctggctccaacgagcccaaggcaaactatgaacaaagcaagaaagacccccaccagacattgcccctggacacccccagagacatcagccttgtgcccaccaggcaagaggtagaggcagagaagcaggcagctctcaacaaaggtgggtacctctgcaagctcatgcaggcctgagctgggctgcgagcccaggggcctgtgtgtgtacctactcatctccctctgctgttcaagaaattcagggctggagaggaaggtggaacacgtgagaggaggggcaagagccccactggaggaggagctctcctgcagggagatgtgtcaggggatgaggaagctatgctgcattggtcagggttctctagagggacagaactaataagatatataatatatatgtgtaaaggggagtttagtaagtattaacttacatgctgacaaggtcccacaataggctgtctacaagctgaggagcaagaagagccagtctgagttccaaaactgaagaacttggagtccgatgtttgagggcaggaagcatccagcacgggagaaaaatgtaggctgggaggctaggccagtctctccttttcatgtttttctgcctgctttatattcactggcagctgattagattgtgcccaccagattaagggtagctctgccttccccagcatgttaatctgttttggcaacaccctcacagacacacccaggatcaatactttgtatccttcaatccagccaagttgacactcaatattaatcatcacaagtccaccccttgtcaacttgaacccatacacatctcctgagatcatacataatcttcaaataaagacaataataaggtcat

SEQ ID NO: 462730 - DNA, 2172 bp, Homo sapiens
gacatgtccaataaaacaggtgggaaacgcccggctaccaccaacagtgacatacccaaccacaacatggtgtccgaggtccctccagagcggcccagcgtccggttgctgagtgcttgttatggctggataccttgctggctctggtgataaagagatgaaaaagacaaaagttcctccctgcaaagagctcatggtgcaatggaagagatagaaagctgcattgtgacaggcaactcgcacagcccgcaaagccgtcgcctttggcaagcgctcacactccatgaagcggaaccccaatgcacctgtcaccaaggcgggctggctcttcaaacaggccagctccggggttaagcagtggaacaagcgctggttcgtcctggtggatcgctgcctcttctactataaagatgagaaggaagagagtatcctgggcagcatccccctcctgagcttccgggtagccgcagtgcagccctcagacaacatcagccggaaacacacgtttaaggtgactgtgtgctgggtggatgaggccgaggccagctccacacgctgcctctccccacaggctgagcatgccggggtccgcacctacttcttcagtgccgagagccccgaggagcaagaggcctggatccaggccatgggggaggctgctcgagtacagatccctccagcccagaagtcagtgccccaagctgtgcggcacagccatgagaagccagactcggagaacgtcccacccagcaagcaccaccagcagccaccccacaacagcctccctaagcctgagccagaggccaagactcgaggggagggtgatggccgaggctgtgagaaggcagagagaaggcctgagaggccagaagtcaagaaagagcctccggtgaaagccaatggcctcccagctggaccggagccagcctcagagccgggcagcccttaccccgagggcccaagagtgccagggggtggggaacagcctgcccagcccaatggctggcagtaccactccccaagccggccagggagcacagctttcccgtctcaggatggagagactgggggacaccggcggagtttcccaccacgcaccaaccctgacaaaattgcccagcgcaagagctccatgaaccagcttcagcagtgggtgaatctgcgccggggggtacccccgcctgaagaccttcggagtccctctaggttctatcctgtgtctcgcagggtccctgagtactatggcccctactcctcccagtaccccgatgattatcagtactacccgccaggagtgcggccggagagcatctgttccatgccggcctatgatcggatcagcccgccctgggccctggaggacaagcgccatgccttccgcaatgggggtggccctgcctaccagctgcgagagtggaaggagcccgccagctacgggcggcaggatgccaccgtctggatcccaagcccctcccggcagccagtctattatgatgagctggatgccgcctctagctccctgcgccgcctgtccctgcagccccgctcccactctgtgccccgctcacccagccagggctcctacagccgtgcccgcatttactcccctgtccgctcacccagtgcccgttttgagcggctgccacctcgcagtgaggacatctatgctgaccctgctgcctatgtgatgaggcgatccatcagctcccccaaggtccctccatacccagaagtgttccgggacagcctccacacctacaagttaaacgagcaagacacagataagctgctgggaaaattgtgtgagcagaacaaggtggtgagggagcaggaccggctggtgcagcagctccgagctgagaaggagagcctggaaagtgccttgatggggacccaccaggagctggagatgtttggaagccagcccgcctacccagaaaagctgcgacacaaaaaggattcactgcagaaccagctcatcaacatccgcgtggagctgtctcaggcgaccacggattggccggttgtggtggcacacacctgtagtcccagataggaggctgaggcaggagaattgcttgaacccatgaggcggaggttgccgtgagccgagatcgcaccattgcactccagcctgggcaacaagagtgaaactccatctcaaaaaaaaaa

SEQ ID NO: 462731 - DNA, 2196 bp, Homo sapiens
gacatgtccaataaaacaggtgggaaacgcccggctaccaccaacagtgacatacccaaccacaacatggtgtccgaggtccctccagagcggcccagcgtccggttgctgagtgcttgttatggctggataccttgctggctctggtgataaagagatgaaaaagacaaaagttcctccctgcaaagagctcatggtgcaatggaagagatagaaagctgcattgtgacaggcaactcgcacagcccgcaaagccgtcgcctttggcaagcgctcacactccatgaagcggaaccccaatgcacctgtcaccaaggcgggctggctcttcaaacaggccagctccggggttaagcagtggaacaagcgctggttcgtcctggtggatcgctgcctcttctactataaagatgagaaggaagagagtatcctgggcagcatccccctcctgagcttccgggtagccgcagtgcagccctcagacaacatcagccggaaacacacgtttaaggtgactgtgtgctgggtggatgaggccgaggccagctccacacgctgcctctccccacaggctgagcatgccggggtccgcacctacttcttcagtgccgagagccccgaggagcaagaggcctggatccaggccatgggggaggctgctcgagtacagatccctccagcccagaagtcagtgccccaagctgtgcggcacagccatgagaagccagactcggagaacgtcccacccagcaagcaccaccagcagccaccccacaacagcctccctaagcctgagccagaggccaagactcgaggggagggtgatggccgaggctgtgagaaggcagagagaaggcctgagaggccagaagtcaagaaagagcctccggtgaaagccaatggcctcccagctggaccggagccagcctcagagccgggcagcccttaccccgagggcccaagagtgccagggggtggggaacagcctgcccagcccaatggctggcagtaccactccccaagccggccagggagcacagctttcccgtctcaggatggagagactgggggacaccggcggagtttcccaccacgcaccaaccctgacaaaattgcccagcgcaagagctccatgaaccagcttcagcagtgggtgaatctgcgccggggggtacccccgcctgaagaccttcggagtccctctaggttctatcctgtgtctcgcagggtccctgagtactatggcccctactcctcccagtaccccgatgattatcagtactacccgccaggagtgcggccggagagcatctgttccatgccggcctatgatcggatcagcccgccctgggccctggaggacaagcgccatgccttccgcaatgggggtggccctgcctaccagctgcgagagtggaaggagcccgccagctacgggcggcaggatgccaccgtctggatcccaagcccctcccggcagccagtctattatgatgagctggatgccgcctctagctccctgcgccgcctgtccctgcagccccgctcccactctgtgccccgctcacccagccagggctcctacagccgtgcccgcatttactcccctgtccgctcacccagtgcccgttttgagcggctgccacctcgcagtgaggacatctatgctgaccctgctgcctatgtgatgaggcgatccatcagctcccccaaggtccctccatacccagaagtgttccgggacagcctccacacctacaagttaaacgagcaagacacagataagctgctgggaaaattgtgtgagcagaacaaggtggtgagggagcaggaccggctggtgcagcagctccgagctgagaaggagagcctggaaagtgccttgatggggacccaccaggagctggagatgtttggaagccagcccgcctacccagaaaagctgcgacacaaaaaggattcactgcagaaccagctcatcaacatccgcgtggagctgtctcaggcgaccacggtaacccagggagcggggttcgtgcaccccacctcatcagcactaggcagcagggccaccacctcccagcttgtgctgtcctagtccagttttcctcagaggacaagagctgagtactcccgtgcagaggggcataaacaaagacctcaatattgccctgcaaataaatagcaagtcagcca

SEQ ID NO: 462732 - DNA, 340 bp, Homo sapiens
agcagaacaaggtggtgagggagcaggaccggctggtgcagcagctccgagctgagaaggtgagaagctgggggtggctttaagctggggcagatgggcgaggctggcttggagaaggttgtgggctgctgtctccaacctgactgagatgacaaagcaaggacagcttccactcagctgcctgttgaacctctaagggctcaggcctctgctgttcaatcccagagaggagctgtcagggctgctcatgtcattcccctgcctttcttcaggagagcctggaaagtgccttgatggggacccaccaggagctggagatgtttggaagccagcccgccta

SEQ ID NO: 462733 - DNA, 476 bp, Homo sapiens
ccaggggatgtggaatgagctcaggtccctggaacagaagctaccagaggtgacggaccatggtctctggcaggagcacagcgggattgtgatgttagcttcctatccctgcataccctcatcctgcccctgctgcagtaaccggcctcatgttcctgcaggtccctccatacccagaagtgttccgggacagcctccacacctacaagttaaacgagcaagacacagatgtaagagcagcgccccctgctccctccctccactccagcctcctgctgctgtcctctgcggggggctgtctctccatccatctctcttcctctgcgggggctgtctctccatctctctctctccttctggtggcttttcatacctttgattcatgtcttctctcaccacaacaagattctgcctacctcctcctcatcccccttcttttctgatctaccacccactcacccttccctcccatgctg

SEQ ID NO: 462734 - DNA, 790 bp, Homo sapiens
aggataccataaagtgttcacttagatgggcattcactcgaaaaccacccatctttcccctgagggagctcggaagggtgcgtcctcagtcttggttcagaaactcgggcaattctggggtgccatctcctagaggctgaagagcagaggcagcccatgggaaagatgactgctggaggggcatgtgtgtgtgtgtgtgtgtgtgtgtgtgtgtacacagggtgcctgcctcctgctggcccaaagggatgtgggttccaaggggtctgggctgagagaaagggctggacactcctcatggccatttcctttgactcactgtgtggctgcttcagaatgaggtgctgaaccggcaaatccaaaaggagatctggaggatccaggacgtgatggaggggctgaggaagaacaacccctcccggggcacggacaccgccaagcacagaggtgggtgcctcctgtgccagcctcctaggctgcctgcctcaccaggagtgctccagtatttctgacctccatcccactcctgccagctcacactgtgttcagagccaggcagggccttcttgggacaccagaatcttcccctgggttctagggtggtaggtaggggtcccttaccccccacagaatagaccaaataaacaactcagagacactgttgaccctgacactctaaagtcctccccagaaaaggtcaaaagcacctaagcctccccagcccccaagcaaggggcccacttgtgacatgtgacccctaccttagagttttccttgagccctgggacct

SEQ ID NO: 462735 - DNA, 248 bp, Homo sapiens
atggtgcaatggaagagatagaaagctgcattgtgacaggttttaggcaaggggtgtccaatcttttggcttccctgggccacactggaagaagaaagattgtcttgggccacacataaaatacactaacacaaacaatatctgatgaactaagaaaaaaaaatcataatgttttaagaaagtttgtgttgggctgcattcaaagccatcctgggctgcgtgtggcccacgggccatggcttggactg

SEQ ID NO: 462736 - DNA, 373 bp, Homo sapiens
cagtgaagaccagagcaaaaccacaacttgtctgcagttgcagagctggtcaggagcagagccaggcttagcactgcgattccctgactcactctccaccaccagcctgaatttccctggtgcaagctctccactccccaccccttggtaggcagaactgggcattgttgggtgctgccattcccgggggaatgctgagtagaagaggacaatctgaatattcccccttccctgtgctcctcaccgtttcctgccacgtcgtcttctgtctctccctttggtgtttggttgacctgttctctgcttctcctccttctgaccgcgtgaggacccctcctctggacaggagctctcttctgggttcccgcccgca

SEQ ID NO: 462737 - DNA, 706 bp, Homo sapiens
gacatgtccaataaaacaggtgggaaacgcccggctaccaccaacagtgacatacccaaccacaacatggtgtccgaggtccctccagagcggcccagcgtccggttgctgagtgcttgttatggctggataccttgctggctctggtgataaagagatgaaaaagacaaaagttcctccctgcaaagagctcatggtgcaatggaagagatagaaagctgcattgtgacaggcaactcgcacagcccgcaaagccgtcgcctttggcaagcgctcacactccatgaagcggaaccccaatgcacctgtcaccaaggcgggctggctcttcaaacaggccagctccggggttaagcagtggaacaagcgctggttcgtcctggtggatcgctgcctcttctactataaagatgagaaggaagagagtatcctgggcagcatccccctcctgagcttccgggtagccgcagtgcagccctcagacaacatcagccggaaacacacgtttaaggctgagcatgccggggtccgcacctacttcttcagtgccgagagccccgaggagcaagaggcctggatccaggccatgggggaggctgctcgagtacagatccctccagcccagaagtcagtgccccaagctgtgcggcacagtccatgagaagccagatacggagacggtcccacccacaaccaccttaagctc

SEQ ID NO: 462738 - DNA, 3275 bp, Homo sapiens
gacatgtccaataaaacaggtgggaaacgcccggctaccaccaacagtgacatacccaaccacaacatggtgtccgaggtccctccagagcggcccagcgtccggttgctgagtgcttgttatggctggataccttgctggctctggtgataaagagatgaaaaagacaaaagttcctccctgcaaagagctcatggtgcaatggaagagatagaaagctgcattgtgacaggcaactcgcacagcccgcaaagccgtcgcctttggcaagcgctcacactccatgaagcggaaccccaatgcacctgtcaccaaggcgggctggctcttcaaacaggccagctccggggttaagcagtggaacaagcgctggttcgtcctggtggatcgctgcctcttctactataaagatgagaaggaagagagtatcctgggcagcatccccctcctgagcttccgggtagccgcagtgcagccctcagacaacatcagccggaaacacacgtttaaggtgactgtgtgctgggtggatgaggccgaggccagctccacacgctgcctctccccacaggctgagcatgccggggtccgcacctacttcttcagtgccgagagccccgaggagcaagaggcctggatccaggccatgggggaggctgctcgagtacagatccctccagcccagaagtcagtgccccaagctgtgcggcacagtctggcaccccctgccccactccatgctgggctagagtcactgacagcatctcccttggcatcctgcagccatgagaagccagactcggagaacgtcccacccagcaagcaccaccagcagccaccccacaacagcctccctaagcctgagccagaggccaagactcgaggggagggtgatggccgaggctgtgagaaggcagagagaaggcctgagaggccagaagtcaagaaagagcctccggtgaaagccaatggcctcccagctggaccggagccagcctcagagccgggcagcccttaccccgagggcccaagagtgccagggggtggggaacagcctgcccagcccaatggctggcagtaccactccccaagccggccagggagcacagctttcccgtctcaggatggagagactgggggacaccggcggagtttcccaccacgcaccaaccctgacaaaattgcccagcgcaagagctccatgaaccagcttcagcagtgggtgaatctgcgccggggggtacccccgcctgaagaccttcggagtccctctaggttctatcctgtgtctcgcagggtccctgagtactatggcccctactcctcccagtaccccgatgattatcagtactacccgccaggagtgcggccggagagcatctgttccatgccggcctatgatcggatcagcccgccctgggccctggaggacaagcgccatgccttccgcaatgggggtggccctgcctaccagctgcgagagtggaaggagcccgccagctacgggcggcaggatgccaccgtctggatcccaagcccctcccggcagccagtctattatgatgagctggatgccgcctctagctccctgcgccgcctgtccctgcagccccgctcccactctgtgccccgctcacccagccagggctcctacagccgtgcccgcatttactcccctgtccgctcacccagtgcccgttttgagcggctgccacctcgcagtgaggacatctatgctgaccctgctgcctatgtgatgaggcgatccatcagctcccccaaggtccctccatacccagaagtgttccgggacagcctccacacctacaagttaaacgagcaagacacagataagctgctgggaaaattgtgtgagcagaacaaggtggtgagggagcaggaccggctggtgcagcagctccgagctgagaaggagagcctggaaagtgccttgatggggacccaccaggagctggagatgtttggaagccagcccgcctacccagaaaagctgcgacacaaaaaggattcactgcagaaccagctcatcaacatccgcgtggagctgtctcaggcgaccacggccctgacaaacagcaccatagagtatgagcacctcgagtctgaggtctctgccctgcacgatgacctctgggagcagctcaatttggacacccagaatgaggtgctgaaccggcaaatccaaaaggagatctggaggatccaggacgtgatggaggggctgaggaagaacaacccctcccggggcacggacaccgccaagcacagaggaggacttggcccctcagccacctacagctccaacagcccggccagccccctcagctctgccagcctcaccagccccctgagccccttttcactggtgtcgggctctcaggggtcccccaccaagcctggctccaacgagcccaaggcaaactatgaacaaagcaagaaagacccccaccagacattgcccctggacacccccagagacatcagccttgtgcccaccaggcaagaggtagaggcagagaagcaggcagctctcaacaaaggtgggtacctctgcaagctcatgcaggcctgagctgggctgcgagcccaggggcctgtgtgtgtacctactcatctccctctgctgttcaagaaattcagggctggagaggaaggtggaacacgtgagaggaggggcaagagccccactggaggaggagctctcctgcagggagatgtgtcaggggatgaggaagctatgctgcattggtcagggttctctagagggacagaactaataagatatataatatatatgtgtaaaggggagtttagtaagtattaacttacatgctgacaaggtcccacaataggctgtctacaagctgaggagcaagaagagccagtctgagttccaaaactgaagaacttggagtccgatgtttgagggcaggaagcatccagcacgggagaaaaatgtaggctgggaggctaggccagtctctccttttcatgtttttctgcctgctttatattcactggcagctgattagattgtgcccaccagattaagggtagctctgccttccccagcatgttaatctgttttggcaacaccctcacagacacacccaggatcaatactttgtatccttcaatccagccaagttgacactcaatattaatcatcacaagtccaccccttgtcaacttgaacccatacacatctcctgagatcatacataatcttcaaataaagacaataataaggtcat

SEQ ID NO: 462739 - DNA, 3079 bp, Homo sapiens
gacatgtccaataaaacaggtgggaaacgcccggctaccaccaacagtgacatacccaaccacaacatggtgtccgaggtccctccagagcggcccagcgtccgggcaactcgcacagcccgcaaagccgtcgcctttggcaagcgctcacactccatgaagcggaaccccaatgcacctgtcaccaaggcgggctggctcttcaaacaggccagctccggggttaagcagtggaacaagcgctggttcgtcctggtggatcgctgcctcttctactataaagatgagaaggaagagagtatcctgggcagcatccccctcctgagcttccgggtagccgcagtgcagccctcagacaacatcagccggaaacacacgtttaaggtgactgtgtgctgggtggatgaggccgaggccagctccacacgctgcctctccccacaggctgagcatgccggggtccgcacctacttcttcagtgccgagagccccgaggagcaagaggcctggatccaggccatgggggaggctgctcgagtacagatccctccagcccagaagtcagtgccccaagctgtgcggcacagccatgagaagccagactcggagaacgtcccacccagcaagcaccaccagcagccaccccacaacagcctccctaagcctgagccagaggccaagactcgaggggagggtgatggccgaggctgtgagaaggcagagagaaggcctgagaggccagaagtcaagaaagagcctccggtgaaagccaatggcctcccagctggaccggagccagcctcagagccgggcagcccttaccccgagggcccaagagtgccagggggtggggaacagcctgcccagcccaatggctggcagtaccactccccaagccggccagggagcacagctttcccgtctcaggatggagagactgggggacaccggcggagtttcccaccacgcaccaaccctgacaaaattgcccagcgcaagagctccatgaaccagcttcagcagtgggtgaatctgcgccggggggtacccccgcctgaagaccttcggagtccctctaggttctatcctgtgtctcgcagggtccctgagtactatggcccctactcctcccagtaccccgatgattatcagtactacccgccaggagtgcggccggagagcatctgttccatgccggcctatgatcggatcagcccgccctgggccctggaggacaagcgccatgccttccgcaatgggggtggccctgcctaccagctgcgagagtggaaggagcccgccagctacgggcggcaggatgccaccgtctggatcccaagcccctcccggcagccagtctattatgatgagctggatgccgcctctagctccctgcgccgcctgtccctgcagccccgctcccactctgtgccccgctcacccagccagggctcctacagccgtgcccgcatttactcccctgtccgctcacccagtgcccgttttgagcggctgccacctcgcagtgaggacatctatgctgaccctgctgcctatgtgatgaggcgatccatcagctcccccaaggtccctccatacccagaagtgttccgggacagcctccacacctacaagttaaacgagcaagacacagataagctgctgggaaaattgtgtgagcagaacaaggtggtgagggagcaggaccggctggtgcagcagctccgagctgagaaggagagcctggaaagtgccttgatggggacccaccaggagctggagatgtttggaagccagcccgcctacccagaaaagctgcgacacaaaaaggattcactgcagaaccagctcatcaacatccgcgtggagctgtctcaggcgaccacggccctgacaaacagcaccatagagtatgagcacctcgagtctgaggtctctgccctgcacgatgacctctgggagcagctcaatttggacacccagaatgaggtgctgaaccggcaaatccaaaaggagatctggaggatccaggacgtgatggaggggctgaggaagaacaacccctcccggggcacggacaccgccaagcacagaggaggacttggcccctcagccacctacagctccaacagcccggccagccccctcagctctgccagcctcaccagccccctgagccccttttcactggtgtcgggctctcaggggtcccccaccaagcctggctccaacgagcccaaggcaaactatgaacaaagcaagaaagacccccaccagacattgcccctggacacccccagagacatcagccttgtgcccaccaggcaagaggtagaggcagagaagcaggcagctctcaacaaaggtgggtacctctgcaagctcatgcaggcctgagctgggctgcgagcccaggggcctgtgtgtgtacctactcatctccctctgctgttcaagaaattcagggctggagaggaaggtggaacacgtgagaggaggggcaagagccccactggaggaggagctctcctgcagggagatgtgtcaggggatgaggaagctatgctgcattggtcagggttctctagagggacagaactaataagatatataatatatatgtgtaaaggggagtttagtaagtattaacttacatgctgacaaggtcccacaataggctgtctacaagctgaggagcaagaagagccagtctgagttccaaaactgaagaacttggagtccgatgtttgagggcaggaagcatccagcacgggagaaaaatgtaggctgggaggctaggccagtctctccttttcatgtttttctgcctgctttatattcactggcagctgattagattgtgcccaccagattaagggtagctctgccttccccagcatgttaatctgttttggcaacaccctcacagacacacccaggatcaatactttgtatccttcaatccagccaagttgacactcaatattaatcatcacaagtccaccccttgtcaacttgaacccatacacatctcctgagatcatacataatcttcaaataaagacaataataaggtcat

SEQ ID NO: 462740 - DNA, 848 bp, Homo sapiens
  misc_feature (20)..(20): n is a, c, g, or t
tggtacggtcggaggtttangatcgacaaggcgagccgcgtttctccccacactccccaaaaaggcgatgaccctccccaggccgcgctcacgctgaacccctgttgctgagctgcagttcctggaggtgtcctgtcctcaaatgtggggatgcggggaaaagattaagaagacagggtatgtgcggatgttgtaacagggtttgaatgaagcacgtctcacacacctcacatgtgagaacccaatcatcacatttatgaactacaaaaggattggcattttaaaatttgtaatttgtggatttttctcattccaagtaaatagttgtttacatacccaattttttatctttgtttttgttttaattttttatttctttttttattttttattttttctatttattttttctattttctacaaccaattttttattcctaactttgcgttctttttcttaaagaaagcctctgccaaattgtgtaagctcctacacaacgcataactacccctggtgatcaggcaacagtcacaatcagtgaaggctccaaatgatatttaccagtttggttactttggaagtactttcaacgtcaggctttaaaagggcaagaatattaactgagaagaattgaagctactttattgaatgccctacatggtttgttaagtgaacataacctaatattaaaatagaacgcttctcacctcagaagcgtcagtccagagggactgacattgtggctctcaggtaccaatgtgcgcatgggacagaacaccataagagtaatctaaaacaaaacaaaccctgatgtttgggtttggttgcaaattttaaggtcatttat

SEQ ID NO: 462741 - DNA, 1567 bp, Homo sapiens
agctccttaaaggatacacaaaactgtcatcagtagttaagatttcggtggtctgggggtgaattccaggtagcaagagaagagtctaaggagcagcaggcaacgtgctgaagtgcagagccaggtcaaggctgggtttgtctgagcagctggtgagtaagagagctgtgaccagggctctgagaaatatggacaggggccagcctgacaaagacaacaaagaactgcccaggggaaggtgaagaaggtaactgtcaacccttcaaaaagtgaaatggcagcgggcacacggacacatgggagcatgttacacacaccacaccctcacagcgtgcacacatgcacatgcacacacacacacctgctccactgctattcggctgtgcgaggtctctgcggccccgctggcgctgctggtgttttgcaggcagctgtttcctcctccggccctcctgttccccgggccgcctgggcaccggcgcctgcactctggcattcattgctctacccgttccaggggctggcctgacttggaatttaagcagcagcgcagccctccctggagtgagcggcggccggggctccagataaggcgggcctgcctcctagtggccaaggtgctgcagggcagctctgagggctggagggctgcgcagccgccacccgaggacacggggaggaggcacaggagaatcctcaagcggggagacacacccttcctgcagaggcgtatcgccagccacgacaaggcgagccgcgtttctccccacactccccaaaaaggcgatgaccctccccaggccgcgctcacgctgaacccctgttgctgagctgcagttcctggaggtgtcctgtcctcaaatgtggggatgcggggaaaagattaagaagacagggtatgtgcggatgttgtaacagggtttgaatgaagcacgtctcacacacctcacatgtgagaacccaatcatcacatttatgaactacaaaaggattggcattttaaaatttgtaatttgtggatttttctcattccaagtaaatagttgtttacatacccaattttttatctttgtttttgttttaattttttatttctttttttattttttattttttctatttattttttctattttctacaaccaattttttattcctaactttgcgttctttttcttaaagaaagcctctgccaaattgtgtaagctcctacacaacgcataactacccctggtgatcaggcaacagtcacaatcagtgaaggctccaaatgatatttaccagtttggttactttggaagtactttcaacgtcaggctttaaaagggcaagaatattaactgagaagaattgaagctactttattgaatgccctacatggtttgttaagtgaacataacctaatattaaaatagaacgcttctcacctcagaagcgtcagtccagagggactgacattgtggctctcaggtaccaatgtgcgcatgggacagaacaccataagagtaatctaaaacaaaacaaaccctgatgtttgggtttggttgcaaattttaaggtcatttat

SEQ ID NO: 462742 - DNA, 1988 bp, Homo sapiens
gaaaccaccagtttcagagtaactacaccatttcacatttccactagccacgtatgagagtcttcattgttccatgtgaaaaagcaaaacccaagattacagagcctactgcttctcagctggccttctctgaggaatcctctttccaggaacttctggcacagagatcctcaagagattccaggttggggcaagctagagatgaggaaaagctaataaaaattcaggaagggaacttgaggccaggaacaaacccccacaaagagatatgccctgagaagttgagttataaacatgatgatttggagccagatgatagtctgggcttaagggttttacaggaacgagtcactccacaagatgctctccatgagtgtgactctcaaggaccaggaaaagaccccatgactgatgcaaggaataacccttacacatgcacggaatgtgggaaagggtttagcaagaagtgggcccttgttcggcatcaacagattcatgctggagtgaagccctatgagtgcaatgagtgtgggaaagcctgtcgttatatggctgatgtcattcgacatatgaggcttcatactggggaaaaaccatacaagtgtattgagtgtgggaaagccttcaaacgcaggtttcacctcacggagcaccagcgtattcacaccggagataagccctatgagtgcaaagaatgtggcaaagcattcacccaccgctcttcttttatccagcataatatgactcacactcgagaaaaaccctttttatgcaaagaatgtgggaaagctttttactacagctcctcatttgctcaacatatgaggattcatactggaaagaaactctatgagtgcggtgaatgtggaaaggccttcacgcaccgctccacatttatccagcacaatgtgacccacacaggagaaaaaccatttttatgtaaagaatgtggaaaaaccttttgcctcaactcatccttcactcagcacatgaggattcacactggagagaaaccctatgagtgcggtgaatgtggaaaggcctttactcatcgctccactttcatccgacataagaggacccataccggagagaagccctttgagtgcaaagaatgtgggaaggccttttgtgacagctcttccttaattcaacatatgaggattcacactggtgagaagccttatgagtgcagtgaatgtggaaaggcttttacacaccactctgtttttattcgacataataggacccacagtggacaaaaacccttggagtgcaaagaatgtgcaaaagccttttactatagctcttccttcactcgacacatgaggattcacactggagagaagccctatgtttgtagagaatgtggaaaggcttttacccaacctgcaaattttgttcggcataataggatccacactggagaaaaaccttttgaatgcaaagaatgtgagaaagccttctgtgacaactttgctttaactcagcacatgagaactcacactggagagaaaccctttgaatgcaatgaatgtggaaagaccttcagccacagttcatctttagagccttacactgtacctgagaataatcgaggggagagacctggtggttaacatgcatttagggattcccaaattgttgttgtgctaaagttccaatcctcattcttttttatattgataatttgtattttcctgtttttaagtttgctgaatctctcctctgattgcatgtcttctgaatccctttattgtattcatattttgtttccattactgtaaattttgatctagaatgttttttgttctttttagaaatcattttatctctttatttctatcctcattttgctcatacatctttttcctttgttcatgtctttagctttttaagcatctttaagacagttgtctttttctggcgagactgacatctgggtttcctcaagtatgttttccctccattcattttgttcctttaat

SEQ ID NO: 462743 - DNA, 1282 bp, Homo sapiens
tgaagatctgatgccggaatataaggggaggacggtgctagtgagagatgcccaagagggaagtgtcactctgcagatccttgacgtgcgccttgaggaccaagggtcttaccgatgtctgatccaagttggaaatctgagtaaagaggacaccgtgatcctgcaggttgcaggaggagcgtggggagagagtggagagaggacaagttccattaacagctgcccctgttcatcacaggaggctatgggggaagagggccatggccaggaccataccctggcagaggccctgctggcttcaggcctactgctgcggcatcatagaaattgctttgcccccgtggacagtgctcagggcaaagaggttgctgcctgctcttctagagcagatatctctggggatactcccatggtccacagctgggatctactgctcttgcaaactcttctggggaagttccagggtatagctattgagtatctgtctgctcatggttgggatgggactgtagcattatgggagggcctctacatagaggccctccttctgatttgccaaattgttttcattctttagagaaactccggagtgaactgagtaagtttcccatgttcttgtaacttccgtaccaacttatctcctgttgccctaatatttgcagtgatagctcattccccttgtttcttctttcatagagttgaaaagagctgcagcaaactcaggctggagaagagcccggttgcattttggtaagttataccaatcaaataggtccatatctcagagcacttcctccttatggctttgtaaccttagattttgttccattcctctggaatgcaggtaatttaaaaatttttaaatcaaatctgtatatctgactatcaaattaaaaaaatctttgtgatcgatcttgaggtcatatttagatttagaaagtatcccctcttttagagcactgataatattaggtttggtcttcttaagggttttctgtggtttttgagatttttcctatgtttatcagttatttgtatttcttctttgtgtgacttgtctgttcctgttctatttgggcttttttttgatttgtgaagactctttctagataaagtatattagctctttgtcatatttgtcaccattacttttcatttgtacttccttatagtatttttctgatgcataagtgttttatttttacgtagtcaaattcattcatctttttctgtgtagtctcttccatgctttcaggtttgggaagtccttcctatcccacaa

SEQ ID NO: 462744 - DNA, 1722 bp, Homo sapiens
aggcacttgtcagagccctgttttcccatggcagcaggaacgccccaagagtgctgtgtttcctggcgaggggaaggtcaagatgagcgtggaggagcagattgaccgaatgcggcggcaccagagtggctccatgagggagaagcggaggagcctgcagctcccggccagcccggcccccgaccccagtccccggccagcctacaaagtggtgcgccgccaccgcagcatccatgaggtagacatctccaacctggaggcagccctgcgggcagaggagcctggcgggcatgcctacgagacaccccgggaggaaattgcccggcttcgcaaaatggagctagagccccagcattatgacgtggacatcaataaggagctctccactccagacaaagtcctcatccctgaacggtacattgacctggagcctgacactcccctgagccctgaggagttgaaggagaagcagaagaaggtggagaggatcaagacactcattgccaaatccagtatgcagaacgtggtgcccatcggcgagggggactctgtggacgtgccccaggactcagagagccagctgcaggagcaggagaagcggattgaaatctcctgcgccctggcgaccgaggcctcccgcaggggccgcatgctgtctggtggtatatggtaaggtgttggagcataaatgtacatgtatgtgagtgtacaatacattggtggaggtggtgtttatgaatgcatgtatttatgtgtgattggcttttccgcagtatgggaaatgataaagcatatttgtgtatatgttgtgtacagtgtatatattgcaatactgtgaacttctgtctgtgtgcacaggctgggagaaagtacagtgtcatgaatgtgagtatgtgtgactgatcatttctgcatgcatgtggtacttgtgattgcacacattataatatcacatctgtatgattcacatctgcagcatatgcaaatcttaactattttgatggatatatttctaatatatatttagtatttttctgccttcttaacaaagttctgtttacatatgacctcttcttgctcatgtattatcattataaatatctttattttgccgatctctgttaaaggaatgcccttagggccacaatggacatagatctgtttgtagctatgctaaatgttcccaaactgtcactcttttaaagctgttatgtctgctttttacaaaatattttttctcctcagtcgtgctttcttacagatgtcagtgggcctcccaattcctctgtctctttgaattttcctgtttctaatctcccctgggctagaaacccagcgagtcaacaccttttagaattgcgtataaataagagtaactggactccagggggtccatatgagtaaattctgagagcctcgctgcatgtcctgtgggctataacctctatgttggcttcctggagatatcttttgcttcgtttttggtttcttggctgttttagaagttgagactgctagatgactaagcgttgggtcagtgatgtggctatgcacacgaatgtgtgtttgaaagtgtttgtgagtgtatttgcacatgaagttacaagtgttgggtcatgtggaagggcacaggcttggaagtacacaaatacgcttatgtgagctgtgtgcgatgagtgtaatgatatggacttgccagatcccatgcacaaactttgtatc

SEQ ID NO: 462745 - DNA, 914 bp, Homo sapiens
cctaatggtgcattcacacccacctaagttacccaaacagcagtggggacgcaattattcaaaccacaagggccatggttcctggaaaacatcaataggtcgaagtcatgtgcgcagatccaaaaggaagcaaacgtgtcttatcatgctggggagattcctggccacgtatgattgtggccgccatcctcgccatcgctggcattgtgatgatgacctacgctgatggcttccacagccactccgtcatcggcatcgcactggtggtggcctcagcatcgatgtctgccctctacaaggttttgttcaagctcctcctgggcagtgctaagtttggagaagccgccttatttttgtccatcttgggtgtgtttaacatcctcttcatcacctgcattcctattatcctctactttaccaaagtggaatactggagctcttttgatgacattccatggggaaacctttgtggattttcagttcttttattgacattcaatattgtattaaattttggaattgccgttacatatcccactctgatgtctcttggaatcgtcctcagcatacctgtgaatgcagtgattgatcactacaccagtcagatcgtcttcaatggggtccgggtcatcgccatcatcatcatcggcctgggttttctcctcctgctcctgccagaggagtgggatgtctggttgatcaagctgctcacccgactcaaagtgaggaagaaggaggagcctgcagagggcgctgccgacctgagctcaggacctcagagcaagaacagaagagcccgcccttccttcgcccgctaacaccactcctctagaactcggtggtaatgactgggaggtctattcctgccgggaggaacctcagttgggtaaggtgtacatacctgtacagttttg

SEQ ID NO: 462746 - DNA, 3004 bp, Homo sapiens
  misc_feature (1295)..(1295): n is a, c, g, or t
  misc_feature (1301)..(1301): n is a, c, g, or t
  misc_feature (1304)..(1305): n is a, c, g, or t
tggtttgaatcttcaccctaggtttctgtgagcttcacatgtacacgctcaactgcctagttgacactgccattggctcggagcagctgtgtccttcagtgcaggtccagccaagagccgtgggccacagatgacgctggtggggaagcagagggcagactaggcagaggcaaggctttcctgtgccctgagctgtcagagatgggccagggccttcagcttcctcgatagggcagaagtgaccacgctggctccattcagcaaaggacgtggacggagctgccgggcttgtctgagaggaggagaaatgtggaattgagtgaggctctctaagaaggttctgctggagttgagaaaaattagggtgaggcacctccccgattttatgtcctttttcctgggtccagcctcctgaacagctaccattcgcttctgtgagacacctgtcggtgcctccttttccagcccttaatggaacggtgagtgaggttccctgactggggtggagtctgcttgtgagtttccccatcccatgtctctctgactcctgctccaactccttacttcgccagttcctctcccagccacctcagacttcccataccaccctccctggacaggaagcgtttttacaggagtttgaagcttcaggagtgccctccggccacatgaagacaaggcgctaacaaacatggcgttctgcaaattgcaccatcgccaactcctgtcttactctcacagaggtctcttgggctcttctgagaagggtgaatgaacttggttggagggaagagaggggtttggtggctcttagtaaaattgcttcacgcagtgacctttggcagtttaggataataacctgtgcagagagagggtctcctgtcctgaagtcacagcccggatctccaggctggctctgctgcctctgaatgatttgtgggtcacacacgccaacagcatcgccaagggctgacatcagcctgcttgagccacggaaactgaatgggcaaggatgagttccccagcacagagggaggcatcctctgtcaagaccatctgcgcatgtgctgtgcagtctccagtctgcactgtgagcagtgtgtctcaacggcttttgagaactgcttcgagaggggaccagatgcgcagagacaagcttccagcctggctagggacggaccctctggggatgctcctctctggccgggcagcagtagaagcacctgcctccatccacatccagacgccattcccttttcttcaccgctgcttcccatcagatggtccccaggacntgcccntcnncaggtgttcagcctgggtaggcgggagaaggaggaggcgtttcaggtatgggaggttcagctgcagacccaccaggtgaagacccaccagcacaccttgccctgcttctgggccacgtctctccagtgcacctgcaggagacctctgtggatgcaccgtgtctcctaacactgtctccagcccacactgagcttgtcttgcgtggaaatctttgtctctgctgttgcctttgcctggagcgtccttgccccacaccctctcacagctgcctctctgtcatctttccaatgtctgtcctcagagagcccttcctggccactccatctaaaggagtcctgggccaggtgtggtggcccacacctgtaatctcagaactttgggagacggaggtgggaagatcacttgaggccaggggttcaagaccaacctgggcaacatactgaaacccccatgcctataacaataaaaaaggaaaaaaagggaatctgaaattgttctatttattcatcttttgtcaacaattcctggtaagaggtgctactcaggtcacagaattggttttaggttgctctagtaaaaactttttgctgtctttagcaaaaagagctgtgcacatagacatactttcaggttaaaccaatatgtatgtttttaatttgctaccccttgccacctcttggcctagaaacagggaggaggaagccacgctttcattattattaactatctcgggccttttattagtttgatcaagtaataatcatctaaagtgcatctcctttgtggggagcccaaattccaggccggaaaaggtccaaccgctgttcctccaacaccggtgcttttccagaacgcgaacttcacgagagctgccgcttcctgtcttgttcaccaaaacattctcagcagcttgaacaagtcctggccgggagcagttgatgaaggagtgaatgacaggcaaattgggatgcgagcaggtgtccatgtctctggacaagggagtgtctttttttccccaaatccctgcaacgagagcctaatagagtgctttagagcacaggaaacctttgaaatagcgccgaactgttgacggaaatgtaaattaatacagttattatggaaaacaaccaagagtagagggggagtggttaactagaggaaaattgggatgctgctaccagaagaaggagggatgaattctaggcaggcagcgcccaggtgagagcttagggtgtcatctcccaggacgtgctgggagtattttaggtatctagcttcctcctgtttctaagcaggcagctcttggtgatcagccttaagtggacttttaccaacttgttgaataaggtgcatagatacagccacctctgccatttcgggatcccccaggaaccaagaacttttacacttgagcttgctatgtgtcaggaagaggaaggtcaagagttgagctgtttctcaggccgcttagccctctgtgtttcccctgaaagtctgttcccacaaatctcattgatcctttctagatctcaagccctgattattctttcagactttgttctgctttcataattcattcaggcattctgtttcatttcctctcttggtggattattccaaaggagcttgtccactgccagtttctcctatgcttccatccctgcctctggctactctccttgtttggtcagttttccct

SEQ ID NO: 462747 - DNA, 2186 bp, Homo sapiens
  misc_feature (477)..(477): n is a, c, g, or t
  misc_feature (483)..(483): n is a, c, g, or t
  misc_feature (486)..(487): n is a, c, g, or t
catgtttttcaggttgaactagaggatcccgacgtagtggactcacgagagagagggtctcctgtcctgaagtcacagcccggatctccaggctggctctgctgcctctgaatgatttgtgggtcacacacgccaacagcatcgccaagggctgacatcagcctgcttgagccacggaaactgaatgggcaaggatgagttccccagcacagagggaggcatcctctgtcaagaccatctgcgcatgtgctgtgcagtctccagtctgcactgtgagcagtgtgtctcaacggcttttgagaactgcttcgagaggggaccagatgcgcagagacaagcttccagcctggctagggacggaccctctggggatgctcctctctggccgggcagcagtagaagcacctgcctccatccacatccagacgccattcccttttcttcaccgctgcttcccatcagatggtccccaggacntgcccntcnncaggtgttcagcctgggtaggcgggagaaggaggaggcgtttcaggtatgggaggttcagctgcagacccaccaggtgaagacccaccagcacaccttgccctgcttctgggccacgtctctccagtgcacctgcaggagacctctgtggatgcaccgtgtctcctaacactgtctccagcccacactgagcttgtcttgcgtggaaatctttgtctctgctgttgcctttgcctggagcgtccttgccccacaccctctcacagctgcctctctgtcatctttccaatgtctgtcctcagagagcccttcctggccactccatctaaaggagtcctgggccaggtgtggtggcccacacctgtaatctcagaactttgggagacggaggtgggaagatcacttgaggccaggggttcaagaccaacctgggcaacatactgaaacccccatgcctataacaataaaaaaggaaaaaaagggaatctgaaattgttctatttattcatcttttgtcaacaattcctggtaagaggtgctactcaggtcacagaattggttttaggttgctctagtaaaaactttttgctgtctttagcaaaaagagctgtgcacatagacatactttcaggttaaaccaatatgtatgtttttaatttgctaccccttgccacctcttggcctagaaacagggaggaggaagccacgctttcattattattaactatctcgggccttttattagtttgatcaagtaataatcatctaaagtgcatctcctttgtggggagcccaaattccaggccggaaaaggtccaaccgctgttcctccaacaccggtgcttttccagaacgcgaacttcacgagagctgccgcttcctgtcttgttcaccaaaacattctcagcagcttgaacaagtcctggccgggagcagttgatgaaggagtgaatgacaggcaaattgggatgcgagcaggtgtccatgtctctggacaagggagtgtctttttttccccaaatccctgcaacgagagcctaatagagtgctttagagcacaggaaacctttgaaatagcgccgaactgttgacggaaatgtaaattaatacagttattatggaaaacaaccaagagtagagggggagtggttaactagaggaaaattgggatgctgctaccagaagaaggagggatgaattctaggcaggcagcgcccaggtgagagcttagggtgtcatctcccaggacgtgctgggagtattttaggtatctagcttcctcctgtttctaagcaggcagctcttggtgatcagccttaagtggacttttaccaacttgttgaataaggtgcatagatacagccacctctgccatttcgggatcccccaggaaccaagaacttttacacttgagcttgctatgtgtcaggaagaggaaggtcaagagttgagctgtttctcaggccgcttagccctctgtgtttcccctgaaagtctgttcccacaaatctcattgatcctttctagatctcaagccctgattattctttcagactttgttctgctttcataattcattcaggcattctgtttcatttcctctcttggtggattattccaaaggagcttgtccactgccagtttctcctatgcttccatccctgcctctggctactctccttgtttggtcagttttccct

SEQ ID NO: 462748 - DNA, 1713 bp, Homo sapiens
ggggctagtacgaggctggtgtgaatcggccgaggtggggttcctgccggctgtattcgggccttggactggactgagaagctacggtggagaccatccatggaaaagaacccccctgatgatacgggccccgtgcacgtgcctttggggcatattgtggccaatgagaaatggcgcgggtcacagctggcgcaggagatgcaagggaaaattaagctcattttcgaggatggcttgacaccagacttttatctgtcgaacagatgctgcattctttatgtcaccgaagctgatttggtggcaggaaatggctacagaaagaggcttgttcgggttagaaattccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggttcaagagcaaaccaaagaacccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcccgagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggccaacatggagaaacccctaaaaataggaacaattagccaggcatggtgacaggtgcctgtaatcccagctacttgggaggccgaggcatgagaatcacttgaacccgggaggcggaggttgcagtgagctgagatcgtgccactgcactccagcctgggcaccagagcgagactccgtctcaaagaaaacaacaaaaaaaaaaaaaaaagaaaaaggattttctccagcagcaaccagtgaaagatgaggcgaggcttgaatggagcccgtgggtcgtcctgccttagcgtctgagttcagcttgtgaagttagtgggccgcagagggcactgccttcattctgctaagacgaaaagggctggtgggatcttcgcaagagagtcagggactcacactcagcaaaaagcattagggccgattttaatgtgcgaccttgacctgcatctgtcatggaaagtgccttctaaaaagcttcagtggtggatgtgaccatctgaaggaaacaaatgtacaaggaagcactgtgtatcctaagccctgggttcccagagtttcacctgctgttcatcaggtctggccttcatatacccgtactgcgagggctgtttccaatgtaaataaataactgcgcaacagttccttcctcctttcctttgttcctccctccccccggcctttttttttggcagatgtacagtttgtttataatcactgcatatgtcttctgcacacagaaagtatgaagtctgaagttcccacttaaagttgaaaactcaacggccgggcat

SEQ ID NO: 462749 - DNA, 1744 bp, Homo sapiens
ggggctagtacgaggctggtgtgaatcggccgaggtggggttcctgccggctgtattcgggccttggactggactgagaagctacggtgcggatccagctggggtatcaggggctaggtggagaccatccatggaaaagaacccccctgatgatacgggccccgtgcacgtgcctttggggcatattgtggccaatgagaaatggcgcgggtcacagctggcgcaggagatgcaagggaaaattaagctcattttcgaggatggcttgacaccagacttttatctgtcgaacagatgctgcattctttatgtcaccgaagctgatttggtggcaggaaatggctacagaaagaggcttgttcgggttagaaattccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggttcaagagcaaaccaaagaacccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcccgagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggccaacatggagaaacccctaaaaataggaacaattagccaggcatggtgacaggtgcctgtaatcccagctacttgggaggccgaggcatgagaatcacttgaacccgggaggcggaggttgcagtgagctgagatcgtgccactgcactccagcctgggcaccagagcgagactccgtctcaaagaaaacaacaaaaaaaaaaaaaaaagaaaaaggattttctccagcagcaaccagtgaaagatgaggcgaggcttgaatggagcccgtgggtcgtcctgccttagcgtctgagttcagcttgtgaagttagtgggccgcagagggcactgccttcattctgctaagacgaaaagggctggtgggatcttcgcaagagagtcagggactcacactcagcaaaaagcattagggccgattttaatgtgcgaccttgacctgcatctgtcatggaaagtgccttctaaaaagcttcagtggtggatgtgaccatctgaaggaaacaaatgtacaaggaagcactgtgtatcctaagccctgggttcccagagtttcacctgctgttcatcaggtctggccttcatatacccgtactgcgagggctgtttccaatgtaaataaataactgcgcaacagttccttcctcctttcctttgttcctccctccccccggcctttttttttggcagatgtacagtttgtttataatcactgcatatgtcttctgcacacagaaagtatgaagtctgaagttcccacttaaagttgaaaactcaacggccgggcat

SEQ ID NO: 462750 - DNA, 1603 bp, Homo sapiens
ggaaacgtccgcccttatccgttctcttattggtcaggttagacgtccatttctgacgccacagcctatccggcgctgcgggaggcggagggcgggctggatgaaggactgggcgagcaccgagggcgtgaacccggaaggtggcgcggccaccagtaacatgatctctagactgggacggtggggttcctgccggctgtattcgggccttggactggactgagaagctacgtccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggttcaagagcaaaccaaagaacccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcccgagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggccaacatggagaaacccctaaaaataggaacaattagccaggcatggtgacaggtgcctgtaatcccagctacttgggaggccgaggcatgagaatcacttgaacccgggaggcggaggttgcagtgagctgagatcgtgccactgcactccagcctgggcaccagagcgagactccgtctcaaagaaaacaacaaaaaaaaaaaaaaaagaaaaaggattttctccagcagcaaccagtgaaagatgaggcgaggcttgaatggagcccgtgggtcgtcctgccttagcgtctgagttcagcttgtgaagttagtgggccgcagagggcactgccttcattctgctaagacgaaaagggctggtgggatcttcgcaagagagtcagggactcacactcagcaaaaagcattagggccgattttaatgtgcgaccttgacctgcatctgtcatggaaagtgccttctaaaaagcttcagtggtggatgtgaccatctgaaggaaacaaatgtacaaggaagcactgtgtatcctaagccctgggttcccagagtttcacctgctgttcatcaggtctggccttcatatacccgtactgcgagggctgtttccaatgtaaataaataactgcgcaacagttccttcctcctttcctttgttcctccctccccccggcctttttttttggcagatgtacagtttgtttataatcactgcatatgtcttctgcacacagaaagtatgaagtctgaagttcccacttaaagttgaaaactcaacggccgggcat

SEQ ID NO: 462751 - DNA, 1395 bp, Homo sapiens
cacctttcaataattttactgatgtctgagaaattatattcatgatacatgaaaacatttgttcccttaagtcaagctgagccaaatggaaaaacgcaatttctacaaaacatattttaagaaaacggccagtcctccagagggcgctcacgtgctgttgctttcattgtggttcaggttcaagagcaaaccaaagaacccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcccgagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggccaacatggagaaacccctaaaaataggaacaattagccaggcatggtgacaggtgcctgtaatcccagctacttgggaggccgaggcatgagaatcacttgaacccgggaggcggaggttgcagtgagctgagatcgtgccactgcactccagcctgggcaccagagcgagactccgtctcaaagaaaacaacaaaaaaaaaaaaaaaagaaaaaggattttctccagcagcaaccagtgaaagatgaggcgaggcttgaatggagcccgtgggtcgtcctgccttagcgtctgagttcagcttgtgaagttagtgggccgcagagggcactgccttcattctgctaagacgaaaagggctggtgggatcttcgcaagagagtcagggactcacactcagcaaaaagcattagggccgattttaatgtgcgaccttgacctgcatctgtcatggaaagtgccttctaaaaagcttcagtggtggatgtgaccatctgaaggaaacaaatgtacaaggaagcactgtgtatcctaagccctgggttcccagagtttcacctgctgttcatcaggtctggccttcatatacccgtactgcgagggctgtttccaatgtaaataaataactgcgcaacagttccttcctcctttcctttgttcctccctccccccggcctttttttttggcagatgtacagtttgtttataatcactgcatatgtcttctgcacacagaaagtatgaagtctgaagttcccacttaaagttgaaaactcaacggccgggcat

SEQ ID NO: 462752 - DNA, 1859 bp, Homo sapiens
ggaaacgtccgcccttatccgttctcttattggtcaggttagacgtccatttctgacgccacagcctatccggcgctgcgggaggcggagggcgggctggatgaaggactgggcgagcaccgagggcgtgaacccggaaggtggcgcggccaccagtaacatgatctctagactgggacggtggggttcctgccggctgtattcgggccttggactggactgagaagctacggtggagaccatccatggaaaagaacccccctgatgatacgggccccgtgcacgtgcctttggggcatattgtggccaatgagaaatggcgcgggtcacagctggcgcaggagatgcaagggaaaattaagctcattttcgaggatggcttgacaccagacttttatctgtcgaacagatgctgcattctttatgtcaccgaagctgatttggtggcaggaaatggctacagaaagaggcttgttcgggttagaaattccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggttcaagagcaaaccaaagaacccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcccgagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggccaacatggagaaacccctaaaaataggaacaattagccaggcatggtgacaggtgcctgtaatcccagctacttgggaggccgaggcatgagaatcacttgaacccgggaggcggaggttgcagtgagctgagatcgtgccactgcactccagcctgggcaccagagcgagactccgtctcaaagaaaacaacaaaaaaaaaaaaaaaagaaaaaggattttctccagcagcaaccagtgaaagatgaggcgaggcttgaatggagcccgtgggtcgtcctgccttagcgtctgagttcagcttgtgaagttagtgggccgcagagggcactgccttcattctgctaagacgaaaagggctggtgggatcttcgcaagagagtcagggactcacactcagcaaaaagcattagggccgattttaatgtgcgaccttgacctgcatctgtcatggaaagtgccttctaaaaagcttcagtggtggatgtgaccatctgaaggaaacaaatgtacaaggaagcactgtgtatcctaagccctgggttcccagagtttcacctgctgttcatcaggtctggccttcatatacccgtactgcgagggctgtttccaatgtaaataaataactgcgcaacagttccttcctcctttcctttgttcctccctccccccggcctttttttttggcagatgtacagtttgtttataatcactgcatatgtcttctgcacacagaaagtatgaagtctgaagttcccacttaaagttgaaaactcaacggccgggcat

SEQ ID NO: 462753 - DNA, 1102 bp, Homo sapiens
  misc_feature (968)..(968): n is a, c, g, or t
ggaaacgtccgcccttatccgttctcttattggtcaggttagacgtccatttctgacgccacagcctatccggcgctgcgggaggcggagggcgggctggatgaaggactgggcgagcaccgagggcgtgaacccggaaggtggcgcggccaccagtaacatgatctctagactgggacggtggggttcctgccggctgtattcgggccttggactggactgagaagctacgggaaaattaagctcattttcgaggatggcttgacaccagacttttatctgtcgaacagatgctgcattctttatgtcaccgaagctgatttggtggcaggaaatggctacagaaagaggcttgttcgggttagaaattccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggttcaagagcaaaccaaagaacccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcccgagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggcaatgggaacctaaaatngaataccgatggaaggcggatcccgatggaggggaggaataacggggggggggagaagggtcctggaggagttaaaaaaagggggtggggccattggagagttatgggtaggatttgcagtgttgtgttgtccc

SEQ ID NO: 462754 - DNA, 1801 bp, Homo sapiens
ggaaacgtccgcccttatccgttctcttattggtcaggttagacgtccatttctgacgccacagcctatccggcgctgcgggaggcggagggcgggctggatgaaggactgggcgagcaccgagggcgtgaacccggaaggtggcgcggccaccagtaacatgatctctagactgggacggtggggttcctgccggctgtattcgggccttggactggactgagaagctacggtggagaccatccatggaaaagaacccccctgatgatacgggccccgtgcacgtgcctttggggcatattgtggccaatgagaaatggcgcgggtcacagctggcgcaggagatgcaagatgctgcattctttatgtcaccgaagctgatttggtggcaggaaatggctacagaaagaggcttgttcgggttagaaattccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggttcaagagcaaaccaaagaacccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcccgagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggccaacatggagaaacccctaaaaataggaacaattagccaggcatggtgacaggtgcctgtaatcccagctacttgggaggccgaggcatgagaatcacttgaacccgggaggcggaggttgcagtgagctgagatcgtgccactgcactccagcctgggcaccagagcgagactccgtctcaaagaaaacaacaaaaaaaaaaaaaaaagaaaaaggattttctccagcagcaaccagtgaaagatgaggcgaggcttgaatggagcccgtgggtcgtcctgccttagcgtctgagttcagcttgtgaagttagtgggccgcagagggcactgccttcattctgctaagacgaaaagggctggtgggatcttcgcaagagagtcagggactcacactcagcaaaaagcattagggccgattttaatgtgcgaccttgacctgcatctgtcatggaaagtgccttctaaaaagcttcagtggtggatgtgaccatctgaaggaaacaaatgtacaaggaagcactgtgtatcctaagccctgggttcccagagtttcacctgctgttcatcaggtctggccttcatatacccgtactgcgagggctgtttccaatgtaaataaataactgcgcaacagttccttcctcctttcctttgttcctccctccccccggcctttttttttggcagatgtacagtttgtttataatcactgcatatgtcttctgcacacagaaagtatgaagtctgaagttcccacttaaagttgaaaactcaacggccgggcat

SEQ ID NO: 462755 - DNA, 1037 bp, Homo sapiens
ctaccactcatgcagagccaatcagaactcgcggtgggggctgctggttcttccaggagcgcgcatgagcggacgctgcctactggtggccgggcgggatggttttgcccggccgccgccgcacataagccacgaggaggagctttacgacttcccggttttcggcgccgggcgcagcaagggccagactatgcgctagcaggcgttgcgcgccaaccggccggcacctgtcgcagaaggtgcaaccgatcgcactgtcgcgcagaagctcctcaatggccaacgccagctgcagccccggccgcccactcgcctcatctgagcctgggcaaatctggattgggaaagttgacattaatcaactcattattcctcacagatttgtattctccagagtatccaggtccttctcagagaattaaaaagcctgtacaggtctagatattggtatttttaattgatgataagctggaataatattaatacacacaaagcacgtgttgtaactttcattatgcttccttagagctctgttcacggaaagggcctgggagctgcaacacctcaacagcaacaagcacacctgctacctagaacttggtttctaaaaaccatcctcctctaaaaggaaacagagctctttgaagaaacggtaatttcaaagctagagcacagaaagtataagatgagcccagaatatctttttgtacaagaaagtaaggcaatgctcaaagaatgatggagacatgcccaaaaaaagcagagaagccaacttgaaaagattccaacaggccaaatatggggcgatttgaacatcagaataaaatggtgacagtcacagaattataacccagtgaagaaaggaattcatgacatcatattaatataaataataattgaatattgaaattcgttaaaggaaatgagatatttatgtagtcttaaggtatcttctcacaaattatgtattacttacaaaggggaaaagtgcaccttgacgtgagaatcttggcagaaccactttaatcaagaggttt

SEQ ID NO: 462756 - DNA, 837 bp, Homo sapiens
ctaccactcatgcagagccaatcagaactcgcggtgggggctgctggttcttccaggagcgcgcatgagcggacgctgcctactggtggccgggcgggatggttttgcccggccgccgccgcacataagccacgaggaggagctttacgacttcccggttttcggcgccgggcgcagcaagggccagactatgcgctagcaggcgttgcgcgccaaccggccggcacctgtcgcagaaggtgcaaccgatcgcactgtcgcgcagaagctcctcaatggccaacgccagctgcagccccggccgcccactcgcctcatctgagcctggctctgttcacggaaagggcctgggagctgcaacacctcaacagcaacaagcacacctgctacctagaacttggtttctaaaaaccatcctcctctaaaaggaaacagagctctttgaagaaacggtaatttcaaagctagagcacagaaagtataagatgagcccagaatatctttttgtacaagaaagtaaggcaatgctcaaagaatgatggagacatgcccaaaaaaagcagagaagccaacttgaaaagattccaacaggccaaatatggggcgatttgaacatcagaataaaatggtgacagtcacagaattataacccagtgaagaaaggaattcatgacatcatattaatataaataataattgaatattgaaattcgttaaaggaaatgagatatttatgtagtcttaaggtatcttctcacaaattatgtattacttacaaaggggaaaagtgcaccttgacgtgagaatcttggcagaaccactttaatcaagaggttt

SEQ ID NO: 462757 - DNA, 641 bp, Homo sapiens
cgcgcagaagctcctcaatggccaacgccagctgcagccccggccgcccactcgcctcatctgagcctgggtacgtgcggtccacaacgcctcccccagccagggcccggggatccccgggagtgtccccggctacctggcgccgctcatcctgggtagggtcggccccctgaggctgcccggcatgagggagttgcacccctgagcttgacctctgacggtcctttgtaatagcattaagtctttgaaacttgtagcggggtagaaggggctaggaaatgaagaaaacatctttttaaaaatataagcagtcggctgggcgaggtggcccacacctgtaatcccagcactttgggaggtcgaggcgggtggatcacgaggacaggagttcaagaccagcctggccagcatggtttcactgaaaccccgtctctactaaaaacacaaaaattagtcgggcgtggtggcaggtgcctgtaatcccagctactcgggaggctgaggcagagaattgtttgaacccgggatgcggaggttgcagtgagcggagatcgcgccactgcactccagcctgggcaacagaccaagactccgtctaaacaaacaaatatatgtgtgtatatatatgcgatcgagcccgg

SEQ ID NO: 462758 - DNA, 629 bp, Homo sapiens
ctaccactcatgcagagccaatcagaactcgcggtgggggctgctggttcttccaggagcgcgcatgagcggacgctgcctactggtggccgggcgggatggttttgcccggccgccgccgcacataagccacgaggaggagctttacgacttcccggttttcggcgccgggcgcagcaagggccagactatgcgctagcaggcgttgcgcgccaaccggccggcacctgtcgcagaaggtgcaaccgatcgcactgtcgcgcagaagctcctcaatggccaacgccagctgcagccccggccgcccactcgcctcatctgagcctggaaggtaagcatgagcaaattactttttagaggtaactttgctgaacttgtgaagaatggtgtgcaaggtccagagcgactgcaggagagggaaggtgggattcccacagagcaggagcacagatgagccaagcaaggccctgcttggaaggcagcaatcaacagagatgcacagacctgtgagggtgccgggacagccatgcaacaatgcagcccttttgcttcctaagctcaccagttccctcgctccacctctgagaggtggtttggagaaacacagcccttctcaagagggctgcaag

SEQ ID NO: 462759 - DNA, 1105 bp, Homo sapiens
gtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccaggcgctcctgcgcccgactcgccctcgcccccactccccggcggggtggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttcggataataatgccttgttttgatgatcgcatcacagttgagtgaaatggccttcctgttcagctgttagagactgaagattgttagggcaccttagaatgtctcatcttttctaggttgtcaacagatgcatagtttgtgaatatttctaaaattttctccaaacattagctctttttagagacatgttggatttgacatgtgtccatgttttaagtaagatttttaaaataagaatacagggcaagttgaaataaatggtaactcattgtgtctagtaagtcagacacat

SEQ ID NO: 462760 - DNA, 762 bp, Homo sapiens
gtgacttctgtcacctgactggaccctgattgtgttacgaggatttcaggaactccatgtcctcaccaacacttggtatgatgtccagttcattcaacaacatttctttaaaacacgatcttcagtgagttgcctttgcacctttctttaaaattatttgatcttatatttgttggtctatttctgcacttccttaatctgtatttttgctaatattttaaagtcttatttaacataattttacactatgtctttaaatcaggcaatgtattcctttaactttgtacttcttttcaaattttttctgtttttattttgttttgtttttggcttttctaagttcttcgcatttccatatgaattttagaatttagttgtcattttctaataaaagtattgtggattttgattgggattgcattgaatatatgtatatcaatttgaagagaattttaacgttaacaatattgagtgttgtaacccataaacgtggcatatctctccctttatttagatctttaatttttctccgcaatcttttatagtttcagtgtatatatcctgcaaatcttatatgtctcaagtatatgttgtatgctcttgtaaaaagtactcttaaatttcaattttaaattagtcattgttagtacatagaaatacaatttttatagaaatattcattatctaccctgtaaaccagaggtgtccaatcttttggcttccctggcccacagtggaagaagaatagtcttgggccacaga

SEQ ID NO: 462761 - DNA, 3828 bp, Homo sapiens
agggcagtgtgggctgatgggcacaggtggccattgcccaggagatccaaggagcctgcagaaagggcctgaggtttggggagggaccttccccagagggagttggtggagccttgtcaatgcattgaaggccactgagacctccagcgaggacgaaatcaactgaagggtgaggtgggacagaggcaccatgcctgagagtggtgctcgttccctgtgacctcagtgtcccctgtcatggtcacatggccacagagacccccatggcttcatgcagattgcctggtcccaacagcccgaggagcagagctgagctgcaggccttgcatcttcccagactcaggtagttgtccacttggggctggaggaagagacatggatgcctgacaaagctatgggaggagggactctggcggggactggctctggccttctccagtaccagacccagaattcacccagaaatactgagtgcaaggaggcctttcacattggagaagggtatcacaggtgcagtgaatgtgggaaagcctttagccacagaaataggctttgtgagcaccagagagtccacagcagagaaagaccttacaaatgcagtgaatgtgggaaattcttcagtcataactctagccttactgtacaccagagagttcacatgggtttaaagccttacgggtgcagcgaatgtgggaaagcctacagaaaaagctcccatcttgttcaacacaagaaagttcacgctggagagaggccttatgggtgcagtgaatgtggaaaagcctacagcagaagcacccaccttgttaggcataaaaaccttcacactggagaaagggcttacagatgcagtgaatgtgggaaagcctatagcagcaaacacacactcattcagcaccagagagtccacactggagaaatggagccaggccttatgaatgcagtgaatgtgggaaatcctttagacaaagctatggccttattgaacaccagagaattcacactggggcaaagccttataagtgtagtgaatgtgggaaatgcttcagctgcaaaatcacacttgctcggcattggagaatccacactggagaaaggccttataagtgcactgaatgtgggaaggtttttagccaaatctctggccttactgcacatcagagagttcacactggtgaaaggctgtgagtgcacagaatgtgggaaatcttttagccaaagatccagcctcattttacaccagagagttcacactggtgaaaggccctatgtgtgcagcgaatgtgggaaagccttcagcgttaaatctatacttgttcaacacctgagagtccatactagaaaaagaccttatgagtgtagtgaatgtaggaaattatttagccacaagtccaacctcattaaatataaaaaaaaaatcacactggagaaaaggcttaaaccaacagcctatgtggtgccagaaagttcaccctggaggaaggccttggaacgcagggaggatgctgtctgcttggtccacatagtgggtgacaccggacagaagctctgaaagtagctttgtgtagtagctatcaatcagccaaaagttaatctcacatctggacatccatgctggagagattccgtacttattttctttttctaaaactttacataaatggaataacaaaatgctgttttttgcttttttctcactcagcataattattttgagattcctccatgttgcatgtgtcaacacttcattgttttattacagactcgtgtatagctttatatagatactccacaattttgctgctcatttgttaaaggacatttggattgcttctagtttggggctattacaaataaagctgctatcaacattcatgtactagtctttcttatatgttaatacctaggagtaacaggactgagtgtttcatttctacctgtgggatgttaatttatacaggtgactaagtgacaacacagagaagccagtgccattgaaataattcaccattcacattttccaagagaaggaaaggcatcgtgccacagagggccacatggaaagcaccagtgttggtcaggaggcaggagcaaggggaaaacataggccacagcctttattggggtttccatggaaaagaccaggcagggcagagtaagcagcttgtgattagctagtttgcataatttcagcaggctttggcctacagggttggtctctggttacctggtacttggtcctggggtgctttagtgcaggagagatattggcgtggggtgtgagagttggataaagaggtaattggggctgtagactctagactggttggctgtatatgagagaggtgctctgggtcaaggcttttgccatctctaagaaagggctagccctgggaggggcagtctctccagagccagcaaacttttaaagatgtcaccataaaatacagaaaataagcataagcacaccaacttacagggtaagtggatgtttacctttttcaaactgacaaattgtgttccaaagtggttatactattttatattctctccacagtgttacgaggatttcaggaactccatgtcctcaccaacacttggtatggtcagtgtttaattttcaccattctcatttggtgtgtagtggtatttctctgtgattttactttgtatccccctaatgactaatgtttacaatttttatgtgtactactgccatccctctgtcttctttggacttttaagtgttcaaatcttttgcccatttaaactcttttctttattattgagttttgagggttcttaataagtattgaatacaagtcctccttcagatatgtgatttgccagtatagtcttctagcctatggatcttttttaccttcatcttaacagtctgtcctatagcagaaaattttactgttgacaaagttgaatgtgttatttttcctttgattgaacatatttttggtacatatctcagaagtatttgccaagatttaagaaattatctcatgttacttaattaaagttttgtacttttaggtttataatccattttgaggtagttcttgaatattgtataccatgtgaggtttggggtcacagctttacagtgttgttttttggtttttgttttaatacagatgtccagttcattcaacaacatttctttaaaacacgatcttcagtgagttgcctttgcacctttctttaaaattatttgatcttatatttgttggtctatttctgcacttccttaatctgtatttttgctaatattttaaagtcttatttaacataattttacactatgtctttaaatcaggcaatgtattcctttaactttgtacttcttttcaaattttttctgtttttattttgttttgtttttggcttttctaagttcttcgcatttccatatgaattttagaatttagttgtcattttctaataaaagtattgtggattttgattgggattgcattgaatatatgtatatcaatttgaagagaattttaacgttaacaatattgagtgttgtaacccataaacgtggcatatctctccctttatttagatctttaatttttctccgcaatcttttatagtttcagtgtatatatcctgcaaatcttatatgtctcaagtatatgttgtatgctcttgtaaaaagtactcttaaatttcaattttaaattagtcattgttagtacatagaaatacaatttttatagaaatattcattatctaccctgtaaaccagaggtgtccaatcttttggcttccctggcccacagtggaagaagaatagtcttgggccacaga

SEQ ID NO: 462762 - DNA, 780 bp, Homo sapiens
  misc_feature (55)..(55): n is a, c, g, or t
cgtaccactaatataccacaacccccaatattgctttctcttcagtcgttacccnacgcatttcaggttactccatgtcacaaccaacacttggtatgatgtccagttcattcaacaacatttctttaaaacacgatcttcagtgagttgcctttgcacctttctttaaaattatttgatcttatatttgttggtctatttctgcacttccttaatctgtatttttgctaatattttaaagtcttatttaacataattttacactatgtctttaaatcaggcaatgtattcctttaactttgtacttcttttcaaattttttctgtttttattttgttttgtttttggcttttctaagttcttcgcatttccatatgaattttagaatttagttgtcattttctaataaaagtattgtggattttgattgggattgcattgaatatatgtatatcaatttgaagagaattttaacgttaacaatattgagtgttgtaacccataaacgtggcatatctctccctttatttagatctttaatttttctccgcaatcttttatagtttcagtgtatatatcctgcaaatcttatatgtctcaagtatatgttgtatgctcttgtaaaaagtactcttaaatttcaattttaaattagtcattgttagtacatagaaatacaatttttatagaaatattcattatctaccctgtaaaccagaggtgtccaatcttttggcttccctggcccacagtggaagaagaatagtcttgggccacaga

SEQ ID NO: 462763 - DNA, 416 bp, Homo sapiens
cagctgagatcagactttgtgtgtaactccactagcctaccagggtgcctctcataaagatgaatttcttcctctgctgagtactctaaagactcactccttggcactcagggccgtggacaggagctttttactcaccaatgaagaacaccaagttaacgcgacccccgtgctgccctgaggaagtcgaagctcctcgctgcttctggcacctcagcgggaagttggttggggcgggatcgcgcgccctctggtggcgccatggttcagcacagacgctcttgctcacagtttctcggcggatgtgcgccccctcctggctgtcctgaaatacctataaaattcaatattcagtttattcagtgtcataattttggaaattcaaaccgaaataaaggccagtatatccataccct

SEQ ID NO: 462764 - DNA, 596 bp, Homo sapiens
  misc_feature (592)..(592): n is a, c, g, or t
cagctgagatcagactttgtgtgtaactccactagcctaccagggtgcctctcataaagatgaatttcttcctctgctgagtactctaaagactcactccttggcactcagggccgtggacaggagctttttactcaccaatgaagaacaccaagttaacgcgacccccgtgctgccctgaggaagtcgaagctcctcgctgcttctggcacctcagcgggaagttggttggggcgggatcgcgcgccctctggtggcgccatggttcagcacagacgctcttgctcacagtttctcggcggatgtgcgccccctcctggctgtcctgaaatacctgtaataccagctactcaggaggctgaggcaggagaatcgcttgaacctgggaggcggaggttgcagtgagccgagatcacgccactgcactccagcctccgcaacaagagcgaaactccgtctcaaaaacaaaacaaaacaaaacaaaaaacttatctaggtttagtgctttgtcctctttgggtaaatttttgattactgtttcaacttacagccattggtcagggtttcactactctttggccaaacttgggcnctca

SEQ ID NO: 462765 - DNA, 1407 bp, Homo sapiens
cagctgagatcagactttgtgtgtaactccactagcctaccagggtgcctctcataaagatgaatttcttcctctgctgagtactctaaagactcactccttggcactcagggccgtggacaggagctttttactcaccaatgaagaacaccaagttaacgcgacccccgtgctgccctgaggaagtcgaagctcctcgctgcttctggcacctcagcgggaagttggttggggcgggatcgcgcgccctctggtggcgccatggttcagcacagacgctcttgctcacagtttctcggcggatgtgcgccccctcctggctgtcctgaaatacctataaaattcaatattcagtttattcagtgtcataattttggaaattcaaaccgaaataaaggccagtatatccatacccttcccataaatggtgatggaagaattatttggaagccatatagaatgaaatgactctatacacaaattaaaacacaaaaacctactcaaaatactccagagactacaacttcaattgcaaaactataaataacctaaaagaaaacctaagagacattggatctggtgttgagtttttacacacagcatcaagtgccaattcgtgaaaatactgagaacagactttataaaactaaattttctactatgaaaaaccctattcagagaacaaaaagacaagacacactgtgtccctgtagggatgacggcgcctcctgcgtaggtcctgaggagacggctcggctccgccccctggagccgcaggccgtctgtgccggaacccgggcgccgcttgaggttctgcagcagaggcgtcacttagggaccagacttccgtgggaaaccaccatctccttccaacccagatgcgcttcatggcaaacgcgagcagatgaaggtcatgtaggagacgaaagaactcgctccccaagccccattgaagaacgtctttacaaaggctgtacaaaacctgccatattctttgtcacacagattgactcatgtgcaatgcagccatttgatgaaacactggcatttaccagatgtaaacttattagcagacgacaactagaaatagtgtgctggatgtgcccgtttatttatatgaatataaccatctctctagatgcatcgaaagatacacaacatgagatccactttatttctacaagtttatgatcaggtggtcaggacagggaaagaagaggaaaaaactttaaatcatggacctttattcttagacacctttatcctacatacacaagggacatgcatggttgaaataacggaaacaagtggataaaagtgaaagtaacttaaacagctttacccaggaatgcccaattcaggtgctgcagagaagagcatgagaaccgggtgtcttcaggacaggtg

SEQ ID NO: 462766 - DNA, 839 bp, Homo sapiens
tgtcggagatgagatcagctaataacagactcaattcctgaccttcctagttttctgagactgcatccactttgatagtttctactgagtccaaattagaacatcccagctggtgggctgtctcccaggaagccctcggagaggagcggtgcatagggggcacctggacacagcccacctcccccgagtagcgtcaggtaggcttgtctatctacatcctttcgccctttctcaggaaactatcagatgatgtgctcccccagatgaagaagtagtgccaggaaaaaggagacacgggatacagggatcctgaagccggcggaggacaagggagctcctgggaggacagctgtgctccggcctagcaatagcgagcagctggtccagactgccgccgtgactcagaagatagacatgcggagggttatgatcacagagcaacgatggtccttgtacatgaagataaaaatgctcaggtgtgcccaggttgaagaagatgaaaggccctgcctcccagagcgcccggggacactggtgatctcttccaggtctgtttccacccactgcagctgtgatggagtcttgctctgttgcccaggctagaatgcagtggcgtgatcttggctcaccaaaaattctgcctcctgggttcaagtgcctccacacccagctaattttgtatttttagtagagacgagatttcaccatgttggccaggctagtcttgaactcctgacattgtgatccacccacctcagcctcccaaagtgctaagattacaggtgtgagccaccatgcccggcctacctggagcattattaaaaccttaaacctttaaa

SEQ ID NO: 462767 - DNA, 630 bp, Homo sapiens
ttcgggagctgcagaacttcagtgtccatcagtcagaggcaatgcccctgacccagacgcctctagttgagagatagacagagctggatttatagcaccacagacctgacctggaatgagacttgcaagtatgtcagggagctgcacgctaacctaggaagaggctggccagatggagtcttgctctgttgcccaggctagaatgcagtggcgtgatcttggctcaccaaaaattctgcctcctgggttcaagtgcctccacacccagctaattttgtatttttagtagagacgagatttcaccatgttggccaggctagtcttgaactcctgacattgtgatccacccacctcagcctcccaaagtgctaagattacaggtgtgagccaccatgcccggcctacctggagcattattaaaaccttaaacctttaaaaaaaaacaaaaaaaaggatttaaaaaaaaaaaaagagaaaaaaaaaaaacagaaaaaaaagaaacaaaacaaaacaacaaaacaaaaaaaaacagaaacaacaaaaccagccacgagacaaacaacaaaggaggggccgcagcaaaaacacccaccacaggagaggagcgcaaagcagagccgccagcacaca

SEQ ID NO: 462768 - DNA, 1798 bp, Homo sapiens
tgtcggagatgagatcagctaataacagactcaattcctgaccttcctagttttctgagactgcatccactttgatagtttctactgagtccaaattagaacatcccagctggtgggctgtctcccaggaagccctcggagaggagcggtgcatagggggcacctggacacagcccacctcccccgagtagcgtcaggtaggcttgtctatctacatcctttcgccctttctcaggaaactatcagatgatgtgctcccccagatgaagaagtagtgccaggaaaaaggagacacgggatacagggatcctgaagccggcggaggacaagggagctcctgggaggacagctgtgctccggcctagcaatagcgagcagctggtccagactgccgccgtgactcagaagatagacatgcggagggttatgatcacagagcaacgatggtccttgtacatgaagataaaaatgctcaggtgtgcccaggttgaagaagatgaaaggccctgcctcccagagcgcccggggacactggtgatctcttccaggtctgtttccacccactgcagctgtgatggagtcttgctctgttgcccaggctagaatgcagtggcgtgatcttggctcaccaaaaattctgcctcctgggttcaagtgcctccacacccagctaattttgtatttttagtagagacgagatttcaccatgttggccaggctagtcttgaactcctgacattgtgatccacccacctcagcctcccaaagtgctaagattacaggtgtgagccaccatgcccggcctacctggagcattattaaaaccttaaacctttaaatttttcatcattgtgctttgtttccttaaagattaggaaagggattgtcagcggataagacttgccctcttctgctgctctctagccgtgggcaagttccttccactcactgtgtgtcattttcttcatctgtaaacacaggataatagtaacaacacctctctcctagggcctggacggggcatgccagtaaggggtcctgaagcttaggcccctgggatttggatagagaaagtcatggtgaaggtgggtgtgacattggtgaggtggcattggacacccttcagggcctctcctgtcctctgtacactccagacagtgcccatttgtgcagaggctgtcctgggtctctgcctgagggctttctctgctcctctaccccagaccaatccgaagtgtccccacgagcaaccttcaaccaaagagggacaggagtcggtgaacatgcacctcagcctcctcacctctccgaggaactttaaaaaaatcttcttaatgaattactccaaggcaaacacctctgtaaccattggtgggacattgcgagagctctcaggagtcctggggaatgagctccagttgcctacagtggttacctgctccttaagtgacacacgctttactggcctgcttttttggatttccttttctcactcatttcaggatcaccttccaaataagccatatacccaaattctcatctcaggtgtctacgcagaggacaccaagcaggccctgggacacagcaatcctgagtgtgtttggagcagaaagcagcccatggtggctggaccacagggagagatggcctgggagagtcaggcaggagcctaatcatatggtttacagccctgcgtgtgtgtgttggggttggggggggggggctgggtgtgtgtatgtgagcaacgtgtgagtcatgtgggatgggaggcccccttgcactttccttctcagcccct

SEQ ID NO: 462769 - DNA, 701 bp, Homo sapiens
aggaacgagattcatggttaacgttaacccacatgaaagctcttcccactgttggaagagaaaaacagattttcactcaatgtcttctcaattgctaggttcacttcttcatgggaaaacaccccacaattatggtagttgctgccaagagaataatggtaacaaagagaaaagaaacagttattatggagtttgtccagaaatccatccctattatgtaacagcaaatgatacaattgattccctcaaacttgggccaggagacttttttgagagaaggtgtgggtggacaaagcaaagcagagccctgacctcacaccagctggctgagctgtcttggcttgcatttgctgttccagcatttgtggagtttgaaatctgcatgcttggagtgcggagagctggatcttgcaccacagtctccctgtgggctcttgaatgagaaaaccaggggaagcagaggtaagaacctgttcaagaaggcacatctcagatgtggaagaaccatgattcaactcgagtctgtctgcttcccaagactgtggtatttaaacagcttataatgaaaattccttctatagctccccataaaagggcacacagttctttcttaacgtattatttcaggcattcattcaccattgatgtatttgtgaaggtgttctctctaaataaactattgggaccttacttgactgtga

SEQ ID NO: 462770 - DNA, 449 bp, Homo sapiens
tgaaacgacaatggaaacacagagaaggtgtgggtggacaaagcaaagcagagccctgacctcacaccagctggctgagctgtcttggcttgcatttgctgttccagcatttgtggagtttgaaatctgcatgcttggagtgcggagagctggatcttgcaccacagtctccctgtgggctcttgaatgagaaaaccaggggaagcagaggtaagaacctgttcaagaaggcacatctcagatgtggaagaaccatgattcaactcgagtctgtctgcttcccaagactgtggtatttaaacagcttataatgaaaattccttctatagctccccataaaagggcacacagttctttcttaacgtattatttcaggcattcattcaccattgatgtatttgtgaaggtgttctctctaaataaactattgggaccttacttgactgtga

SEQ ID NO: 462771 - DNA, 1379 bp, Homo sapiens
gtgggaagtcaccaggactatgttggtgaggaaactgaggcacaggccactgcatgctttcacgctcacctgcctgaaaatccccgctgcagggaaggctgcactctgggctctggggctaggaggtgggatctgcgtgtgcagcttggggactccgggtgtttccaatgcgcagcagcagtggggggcgctctgctttatggagcccattgtgcagatgggtaaacagtctctgaggggcaaagtgaccccaaaggacccacaggtcctctgggctcctgtttctgcctcctccatgacttggctgccctcagatgactggttcctgagggtgccaccatgcaggcagggtgtcctgcagagctctggggttggggccagggtccccgggtctcctgtgcccccagcactgtcgggtatgaggccccagaccctcccgcaaggaggccccatcctggaggagcggagcctgccccagctgccaggcacgcgagaaatcccagcccagccgcaccaggactacttgaattcatttctggaaaacgtcaaacatccacacaagtgctctagagaacagcctcggagccccagagaataccctggtggccgagcctccagcgccggcatctctacttgctgtttccacaccctcggccccctccaaaccatggggctgccgggttctttattctgccctaaaactaatgcaaccagacccaagtccaaccccagagccgggctccctgccctcctgtgcggaaaggacacggacacgcctggtggatggcgtggcctggacagggctgcctggcggcatgtctgtctcctcggcctcccatggcccttctgcaggatcctgttgcacccaggcctggggcccacgattaaatcgtgcattggcactgcagcatggggccaaggaggggctggcagctccttcccacttcacatacgtttgcatttcccccagagacgcgaccacttagaaacctataaatccctggcagggctgccggcctaggctagtatataaatcaggacttgtaaaagcctaatggccccctctggcgggtgagacgggcgtgtgccaagaatcctcaggcggcgccccaggactcaagtcttggtctctagctgcagatgggcaggggggcaggcaggcgccggtgccacagacctgcctggaatccccgctctgccccctctccaacctcgggcaagtcacccctgtgagcctcagttctctcctcagtacaatgaggtcacaacccgtgccttgcagaaggtcatcagcaggctgcacaagccctctaggagcccagcattcttttctggtgggctgaagggatgggggacagagcgcaaatggggccctgaag

SEQ ID NO: 462772 - DNA, 1457 bp, Homo sapiens
ggtccttgggtcagaaaacaagatcttctgattctggactctacagctgtcttgggtaaggaaactgaggttggaggaggacaccgggagcctggtcaggccgctggcagcctggagacccagaggtccaggcattcaccgccctccacaccaccgcccctccctcccaggcccaggagtcttcattcccagcatattcacctgtcaataactcaggccccccgcaatcgtcaggtgatggcctccctgtgtgtggctgccaggctagggatgggggtgtctgtgcttccctcgcccaagctgagagtggcctgttcccagggggcgggcttcctctttggttggcagcctggagtctggagtgcaggtgccgggcaggcagcactgggagcgctcggcgacttggctggaggccgaaggtgccgcccctcggggaccagagcgtctttgcaagcgtggttggggaactccagagccccacatcacagttcagcatgtgcctcaggagcttcagcaagtctttcgtggaaggagagtctgccggtgacgggggaagcaggccatcagcccgcccagcttcatctcaggccgcttccaacaccgccaagcaaactcccttggcaagatccatgcaaggccgcggctgaccaccgggaggcagcagcctactctgcaaggcactttctttacccgacccccacccccttttaacaggtggcaggaaacctgctggcccagccatctgccgcacccacccttcactcccagtcccatctccccatagcacagatttccctatcatgagccctgacgtgacctgggtgtcctcttgccttcctctgcccaaggaattcctacagagattctttctctatcctcctttgtacatttccaaggaattgtttccccagggcccctccccttgaagaaattagacaggaagctggagtagatggttccctctttcccacctctcacactcccaagctctggttaactctctgtgggccagtggctagattccccaacacagatgacaactgaacaatacacatgcagcgtaagaatgttgtcgctgccaccagccacttacagatacaccattgctaaggtccacccaactggactgtttccccctcccatagactaagccccaaaggccaaaaagtaaaacccgctaccccaaacctgcctgtaactgtttgaccagaggccagctgtcccaggatgcggttaagacgtctactttgcacaagagaactggcaagaaaaacatctccaggaagcggtcagacacatggcacaaaggacccccccccttttctttttccttcaccctgatccagttctatgtcctataaaaccttgctctagcctataagtggggctgccttctctgcttttgtcaagaggtagccaggcaggactgacaataaatcagcttgcctgaacttggg

SEQ ID NO: 462773 - DNA, 3675 bp, Homo sapiens
ccctctggcagccctggacagacataagagggcatttggcaatgtctggagacaattttggttgtcacaactggaaggtttttggcattgtgcctgcactgaataaaagcaagcagctccagttctcggggctgaactccggccacttgagctgctcttacactgtatacctgtgtctgagtactcagttcatccaccagtcagggtctgtgggacagactaggcaggtggtgccccgtgtgaggagcagcgcagtggatcatgatggaaccctcgaaaatgaacgtgaagtgactgcgcaaggtcatctcaggaacttccaggaagagtcaaataaagagctgtcacacaccctagagctggaatctgcaccctccacaccaacccctttgcacagcctgtctgctctgcatgatcctgcagctggttactgcagcctggaagagctgagacagagaagacagacgtggggagggagaataacaataataaacagaccttagacaagaggctgctgcatggatctcattcagctgtttactcaggacaataggagcacctgatcttcggagatgcctggtagagatgattgaaaagaactgatcagcattggcctctttcccccaagatctaccagggtcatagcactctgaggattattttgtgatatttcccccatggcctctccatcaactgcccatactccataagtttgtcccctgtcctctgtccagatctagactccagggcagtgaggcacaagggaaaactatcctatcacctcttctattaatagaaacaattaggagagcagatgtagcttggcctcctaagggtccctccttctgccctccttaagactgtctgaggggaagggcaagttctgaggcttctttagaacccctccccccaccatagactcttggagcagacagtgtcatctggctcagtctccagccttcagccaggaaaattctacagctttcagagcagacagagaagactcagtatctcttcaaccatcaagatgggacagactgtaagagagccctggaggtaagatgttgaggctgtttctaggctcggtggcaggctgcttggcatcatgaaggggtcaagcaagatgctactctgggatctatggtatgtctccttgaaggtatgtcctctatgtaggaccagggctggaggaagttctacatgtttgtcttcccagtaatctacaagctccttcaaggaaaggaatgtcttattcatatttgtttctcccacctaacagggcacgtggcacaaaaaagatgccaataaatatttgtgggcagaagagaggaagggaggccttaagtaaactcaaccaaatgagttgctaaccaggatgcaagccctgtcctttcccagctcagcccaatgttctgttgtgggactcctctggcttctcccttaacccttcaggccctaactcggacaatacctcctcttttacttctccctgcccttttgcatgtcaaagcagaattcatcattccgttctccaatggaatattggatattccattacagcctttaatcaactggattgatagtctctgcctcttcctcttcaccaatagtcagggatgctagagggaaaggctcagagcctgttcctcagactggatgcgaggacctccaggttacttgcagataacaaaggtcgcacagcaaggtaactgggatgaaggttgaggttagacagctctttcctggggtgaggacggaggaggggtgagtggaggaaggttgcctttgaggagggctggcaggacaaacgaggcttctttagaccagtgggaatgtgccatctggacaggcttgtttttcctaaaactcgtgaggcagctcttggcaccagaagtcagaactgagcctgggagcaggatggaaaaggtacctatgctgtctcacctggggctcagggctccagcatcatggaaggtagagttggacctctgggctctcccaggccagtggctgctgtagggcaaccctgggtcactccgagtccttaaaagtaatcatggggacctgagagacactttcaatttctccaaagaactcgtggaattttcatcatatggtaagattgaataggctaaagtaaatggttgcttttctttgcttttggctagaattatatcaacacagtgtcctcatggaaaaataaattatttgataaatgcagtttggtgggtacaatttttcaaaatatgggatccttctttttgatgttaaaaaaattgggaaccactggttcccccaaatctttctttccatagatgagaagcatgaggcccagataggtcacgcagcaggtcagtagcaggcctagggttaggaccaagtgaactgaccctagtcaactgccctctctgcacaccacatgcttctctgctttctcttgtcttcatcattcttactgaagggggagtcctctgactctgccaccccaacacctactgctctccagtggaacttctaatggagtctgacacccatgtgttctctggggtgccccactgagccccagcatctactgctatcaatattatgtccatagctgccaggggagtggtgtccctatgaaagaaaggagacatccaagatatacccctaggggatacatcagtcagattcatatttagttatgggtaaaggaaatcttgacaaattgtggcctaaccaagaaagttcttttcttccctccccttccttccccttccctccccttccttccccttccctccccttccttccccttccctccccttccctttcttccccttccctcccatcccctcccctttccccctcccctcccctcacctttctttccttttcttaccatcctttctaccttccttctctcctcccctcccctccccctccctgcccttccttgtttctttgtttctttgtttctgtcccttccatgcaacaagaagtctgggggtgggcagtcccgggcaggtacagctgctcaaggaggtcattaaggtaccaggctctttctctttttctgttctatcatcctcagtgtttagcctttctcctcatgtttgcaaagtaactgctaaatttccagtcaagaagagggtgaaaatggtcagggagagggaaaagcccactgctagaaggccttggctctgattattcaggaagggaaggcctcctcggggatagctccccctccctttgagtagaactcatctcatgaacatcactagctgcaagggacactagacatttaagcattttcctttccagcccttatactagaggaaggtaatatagaagaggattgaaatggggtagacagagccaacataaatacgcacatctcccctgcgtccttacccatcctcctctccagccttgctgttacaaggagagatgactgtgggcagccaatctttccactggtgctatggatcccatgccctgtcacctcctcacctctgtttcctgtatcttcaaacttttctgctctcttggatcttattcactttttaatatgttcttaaatcattcccatgttaaacaaagtcaaacaactcttggagcagtgacttagaggacttatagaaaaatgctgggaactaaaattgtgtttgtcagcatttgctgaccttcagtgag

SEQ ID NO: 462774 - DNA, 1255 bp, Homo sapiens
gatacggttgattcacaggatctggcagcacagggcatctctttccaagcgaaaggtggagccatttgaaggaaggcatgcagcatggaacccaagctgctgtgcaggatccgcagcccttcatatgggagccccagctggtgcacacagaacttcagcattctggttgggatgagggcagagtacaagagagggatccgaggagtgccgaccagagaggcagttcatgtagcctcattagtaaagcccccaggggctgtgactgtcctgcgcgggcttccaagtccacctgagagttctgatgctgtgctgaccccatggcacatcaggggcagcgagcctgctgtccacactggctgggagaagcagcagccaggcaagagaacaacaaacaggggcaggcagccacccaccaagaggacatgtggaaccaggcagcacgccatttggaaagcaagtctatatgggagtggtcactatcatggaaaggaaaaagaatgggaaaacctgagatttaagaaagacccaatgctgttctagaagcatcttcagaaagagcaataaagcttctttggggaagtcacaggacacagactctccagggtggaagggatcttgaagagcacagaggccaagtcctcatccatctctcgacttccttcatgactcatctgaagacggctggattggtctatgtctgtaccctaccctcaccccacaatcccagtccaccctatctcagaacaatttcaaatgcaggggaggatcagagatgaagatgttactccaaaagtatacatgcaaagatgttctggaagtgctacttcttaacttgtctggtcttatagtctgtggttgaaagagtcctccatggagaagtctactgccgaagtccactgattttcactgccgtatgatattccatcgtgtggcacgtggaacaatcaggatcatatttcaacatgagatccccacgttgatgtctcagtcttgggtagacatggtagggctggtaggaagtggtctaatgacttccattcctctgttggaacatttgggttgcttttgggtgttttgttattaaaaacactgctgctgctatcattcttttttgtacagtttctttggattccaatccataaaagcctagcatggaattgttagggatcacattttgagaacctcccagccttaaatcaaggctcaaaatgctgttgcatactctcccgagtcaacaaagcccataaatatagac

SEQ ID NO: 462775 - DNA, 1040 bp, Homo sapiens
gatacggttgattcacaggatctggcagcacagggcatctctttccaagcgaaaggtggagccatttgaaggaaggcatgcagcatggaacccaagctgctgtgcaggatccgcagcccttcatatgggagccccagctggtgcacacagaacttcagcattctggttgggatgagggcagagtacaagagagggatccgaggagtgccgaccagagaggcagttcatgtagcctcattagtaaagcccccaggggctgtgactgtcctgcgcgggcttccaagtccacctgagagttctgatgctgtgctgaccccatggcacatcaggggcagcgagcctgctgtccacactggctgggagaagcagcagccaggcaagagaacaacaaacaggggcaggcagccacccaccaagaggacatgtggaaccaggcagcacgccatttggaaagcaagtctatatgggagtggtcactatcatggaaaggaaaaagaatgggaaaacctgagatttaagaaagacccaatgctgttctagaagcatcttcagaaagagcaataaagcttctttggggaagtcacaggacacagactctccagggtggaagggatcttgaagagcacagaggccaagtcctcatccatctctcgacttccttcatgactcatctgaagacggctggattggtctatgtctgtaccctaccctcaccccacaatcccagtccaccctatctcagaacaatttcaaatgcaggggaggatcagagatgaagatgttactccaaaagtatacatgcaaagatgttctggaagtgctacttcttaacttgtctggtcttatagtctgtggttgaagtgagtttctccacttctagaacgctttaggtctgtttcctggtcctctttgaacaagtttcattaataattacgtgctgcccttctattactcctactttccacaccctgggaaagtatacacgggttctagaaatattccattaggagggccaggtaaggattcttaaatatgaatgg

SEQ ID NO: 462776 - DNA, 1879 bp, Homo sapiens
cctccagaaacggaagcctcagcctatcagcgatgcctaagtcccagtcacgataaccaaacggcgtcgcccttttacaccttcccggagcggcagtcatcccaaatacaaactacatgttccaggatgctttgggcggcagatctcgcggaagccgcgaggagagcccggccccgtctcgcgcgcctgcttccgcctccctgtggcggcggcttgttgttgtggaggccaaaatggcggctcaggcggcggcagcggcccaggcggcggcggcccaggctgcgcaggccgaggcggccgactcgtggtacctggcgcttctgggcttcgctgagcacttccgcacttccagcccgcccaaaatccgcctgtgcgtgcactgcctgcaggccgtgttccccttcaagccgccgcagcgcatcgaggcccgtacacacctgcagctgggctccgttctctatcaccacaccaagaacagcgagcaggcgcgcagccacctggagaaggcggtgagcgcgggccgggccgcgagggaggagtcgcgggctccttgcaagatctgggctgacgggtcgcgaccgcggcgggtggggggccgctcctcggcgacctgggggcgcgacctccgtcaaagccgcaggacccccacccgcctctgccggaccccaaagccaccagcctctcaagggacacgaaagcctcgccccccacgccttatttcccgtttctggtgacagggctccaggagccccgtcaccgtactctgaaagttgcctgttattgggagcaacaggatccgcaaatcgtctggttttcaggaggatcccacctgttggtggcgatggggacatcacagggtcctgaagctattagctcctcctggttcagcttccggagcatcagccccaaacgcttccacctaaagtgacttggggtaggggttggcgaaggcgagacccctggcattctcccgggaatctgaagtctggtctctcaggaacctggaagggcatgattctccttggacacagaagtttggtaatcgtggtttttggagggtcttgtgcccccatcaataatgcctggtgtcgtacgagggaagctgagacccggagtctggagttggtcatttgaggcctatgaggaggagaaacaggggttctggattccaggccccgctgttcagtttcagtattaggggaactaaaagcagctcctgctttttctccatccactggtgacttctaccatccatcagtccatcctcttccgtcagatcgcatcccaactgaaaatttttccagcttttagttaaagtaatgttttctatactgttttccttccaccaacgtttgtgaattttttttgtgttacaacataagcatgctttctttcatcttcattctttattaattgtgcattttttcccaatcagggagctatcaacttttattctttccttccccagagctacttaataaagaatcgtatgttctccgcttagaggtggtttgctggtttctacttctgaaaagcaaatggctgaagagattccagtgtcttcttggagagccaacccagtgtaacagtattttgcaatagtttgtgacatttctccttgctcattctctctgctgttctttttatttttattgttacttttattttatttatttattttttgagatgtagtcttgctctgtcacccaggctctggagtgcaatggcgcaatcttggctcactgcaacctctgcctcccgggttcaagcgagtctcctgcctcagcctcccaaactttgtgaggccaaagtgggcagattgcttaagcccaggagttcaagaccggccttggcaacatagcaaaaccctgtctctacc

SEQ ID NO: 462777 - DNA, 2656 bp, Homo sapiens
ccctgcgcggatgattctgggaaatgtcgatcggctgtgggcggcgcactgggtccgccccgctgtagcctcaggcctgacggcgactcccaggctccgggacgattctgggcagtgtcgtccccagaggtcggcggccgttgcccgctcaccagcgacgcggggcgcctgcggggacggtgaggccctgctgaggactccggccagtatgagtcccgggggcggcggcggggctcaggccctgggtctgccccgcggtgtgaccccggccggtgccttggttttcctggccttcatgtcctcctatgtaaacgcggggtgatgacggcgccgacctcttggcgctgttgtgagagtgaagtgggcgcgtggttagacgccagccacagttgtctttgggttatgtcgtcatgaagccggcgctctacagttgtgtaaccttgaacaaatgggttcagtatcttggaatttcagttttgtcatcgtttaaaaaatagatctggaaaaatgtgaacgcacaccgtgcatagtggtgaagactgaacgagctgataaagtttttaccattgttttatgaggattttatttacagagtaattgattttcctcgcaggtggcacctggtaaatggttagcccttgcggagaaacaccctgttagttcccagggagagattggcgccctggagagtgattaccagtgtgcctttccattatggtgtgtcacaggtgccgcaagataagcctgatttttcatgactgctttttcctgcccttctgtgccctcaggacactgcccatctctaagataagagcctggaaagaggactctgttggctgttggaaattgcagagtaatgcctcaggtgacatttaatgatgtggctatagacttcactcatgaagagtggggatggctcagttctgctcagagggacttatacaaggatgtgatggtccagaattatgagaacctggtctctgtagcaggtctttctgtaactaagccatatgtgatcacgttattggaggatggaaaagagccctggatgatggagaaaaaactgtcaaaaggtatgattccagattgggaatcaagatgggaaaacaaggaattatcaacaaagaaggataattatgatgaagattcaccccaaacagtaataatagaaaaagttgtaaaacaaagttatgaattttcaaattctaagaagaatttggaatatatagagaagttggaagggaagcatggaagtcaggtagaccatttcagaccagcaattctcacctctagagaaagccccactgcagacagtgtttacaaatacaatatatttagaagcacctttcattcaaagtctactctttctgaaccacaaaaaatttctgctgaagggaattcacacaaatatgatatattaaagaagaacttaccaaaaaagtcagttataaaaaatgagaaagtcaatggtggaaagaaacttttgaattctaataaaagtggggcagccttcagccagggcaaatctcttacccttccccagacttgtaatagagagaaaatctatacatgcagtgaatgtgggaaagcctttggcaaacagtcaatcctcaatcgccactggagaattcatacaggagagaagccctatgaatgtcgtgaatgtgggaagacttttagccatggctcatcccttacacgacatctgataagccatagtggagagaaaccttacaaatgtattgaatgtgggaaggcctttagccatgtctcatcacttactaaccatcagagcactcacactggagagaaaccatatgaatgtatgaactgtggaaagtcttttagtcgtgtgtcccatcttattgaacatctaagaattcatactcaagaaaaactctatgagtgtcgtatatgtggaaaggccttcattcataggtcatctctcattcaccatcagaaaatccatactggagagaagccttatgaatgtagagaatgtgggaaagctttctgctgtagctcacaccttactcgacatcaaagaattcacactatggagaaacaatatgaatgcaacaaatgtctgaaagtctttagtagcctctcatttcttgttcagcatcagagtattcatactgaagaaaaaccctttgaatgtcagaaatgcaggaaatccttcaaccagcttgaatcactgaatatgcatttgagaaatcacattagattgaaaccctacgaatgcagtatatgtgggaaagcctttagtcataggtcatccctgcttcaacatcacagaattcatactggagagaaaccttatgaatgtattaaatgtgggaagaccttcagctgtagttcaaaccttaccgtacatcagagaattcacactggagaaaagccatataaatgtaatgagtgtgggaaagcttttagcaaaggctcaaatcttactgcccatcaaagagtacataatggagagaaacccaatagtgtgattccagaagatgagaaatacttaatctagagctagcaaggccaaagggaaaaaaaaaaaagactctcctagtaggtgacattgacattggtgcagaacagggaaggatgcaaaggaggagaggagagggagaggcactgcagagatctggactcagtg

SEQ ID NO: 462778 - DNA, 2047 bp, Homo sapiens
ccctgcgcggatgattctgggaaatgtcgatcggctgtgggcggcgcactgggtccgccccgctgtagcctcaggcctgacggcgactcccaggctccgggacgattctgggcagtgtcgtccccagaggtcggcggccgttgcccgctcaccagcgacgcggggcgcctgcggggacggacactgcccatctctaagataagagcctggaaagaggactctgttggctgttggaaattgcagagtaatgcctcaggtgacatttaatgatgtggctatagacttcactcatgaagagtggggatggctcagttctgctcagagggacttatacaaggatgtgatggtccagaattatgagaacctggtctctgtagcaggtctttctgtaactaagccatatgtgatcacgttattggaggatggaaaagagccctggatgatggagaaaaaactgtcaaaaggtatgattccagattgggaatcaagatgggaaaacaaggaattatcaacaaagaaggataattatgatgaagattcaccccaaacagtaataatagaaaaagttgtaaaacaaagttatgaattttcaaattctaagaagaatttggaatatatagagaagttggaagggaagcatggaagtcaggtagaccatttcagaccagcaattctcacctctagagaaagccccactgcagacagtgtttacaaatacaatatatttagaagcacctttcattcaaagtctactctttctgaaccacaaaaaatttctgctgaagggaattcacacaaatatgatatattaaagaagaacttaccaaaaaagtcagttataaaaaatgagaaagtcaatggtggaaagaaacttttgaattctaataaaagtggggcagccttcagccagggcaaatctcttacccttccccagacttgtaatagagagaaaatctatacatgcagtgaatgtgggaaagcctttggcaaacagtcaatcctcaatcgccactggagaattcatacaggagagaagccctatgaatgtcgtgaatgtgggaagacttttagccatggctcatcccttacacgacatctgataagccatagtggagagaaaccttacaaatgtattgaatgtgggaaggcctttagccatgtctcatcacttactaaccatcagagcactcacactggagagaaaccatatgaatgtatgaactgtggaaagtcttttagtcgtgtgtcccatcttattgaacatctaagaattcatactcaagaaaaactctatgagtgtcgtatatgtggaaaggccttcattcataggtcatctctcattcaccatcagaaaatccatactggagagaagccttatgaatgtagagaatgtgggaaagctttctgctgtagctcacaccttactcgacatcaaagaattcacactatggagaaacaatatgaatgcaacaaatgtctgaaagtctttagtagcctctcatttcttgttcagcatcagagtattcatactgaagaaaaaccctttgaatgtcagaaatgcaggaaatccttcaaccagcttgaatcactgaatatgcatttgagaaatcacattagattgaaaccctacgaatgcagtatatgtgggaaagcctttagtcataggtcatccctgcttcaacatcacagaattcatactggagagaaaccttatgaatgtattaaatgtgggaagaccttcagctgtagttcaaaccttaccgtacatcagagaattcacactggagaaaagccatataaatgtaatgagtgtgggaaagcttttagcaaaggctcaaatcttactgcccatcaaagagtacataatggagagaaacccaatagtgtgattccagaagatgagaaatacttaatctagagctagcaaggccaaagggaaaaaaaaaaaagactctcctagtaggtgacattgacattggtgcagaacagggaaggatgcaaaggaggagaggagagggagaggcactgcagagatctggactcagtg

SEQ ID NO: 462779 - DNA, 1874 bp, Homo sapiens
ttggaatccagaatgccttccacattttatttctgataacttcctttttttccatactatttcatccattacatatatttttcccatttccattatcacactgtgttcccacttctgtgaactctgtattctctgctccatttgagcactgttcagaaatcattgaaatatttcagttgtcagaactatgtgttttctgggggcttcatttctaatccagttctcctaattccaatttagaagtttcttttcaaatagttaaaaaaaaacaaaacagtgctttgcttttttgatgtatttcagattgggaatcaagatgggaaaacaaggaattatcaacaaagaaggataattatgatgaagattcaccccaaacagtaataatagaaaaagttgtaaaacaaagttatgaattttcaaattctaagaagaatttggaatatatagagaagttggaagggaagcatggaagtcaggtagaccatttcagaccagcaattctcacctctagagaaagccccactgcagacagtgtttacaaatacaatatatttagaagcacctttcattcaaagtctactctttctgaaccacaaaaaatttctgctgaagggaattcacacaaatatgatatattaaagaagaacttaccaaaaaagtcagttataaaaaatgagaaagtcaatggtggaaagaaacttttgaattctaataaaagtggggcagccttcagccagggcaaatctcttacccttccccagacttgtaatagagagaaaatctatacatgcagtgaatgtgggaaagcctttggcaaacagtcaatcctcaatcgccactggagaattcatacaggagagaagccctatgaatgtcgtgaatgtgggaagacttttagccatggctcatcccttacacgacatctgataagccatagtggagagaaaccttacaaatgtattgaatgtgggaaggcctttagccatgtctcatcacttactaaccatcagagcactcacactggagagaaaccatatgaatgtatgaactgtggaaagtcttttagtcgtgtgtcccatcttattgaacatctaagaattcatactcaagaaaaactctatgagtgtcgtatatgtggaaaggccttcattcataggtcatctctcattcaccatcagaaaatccatactggagagaagccttatgaatgtagagaatgtgggaaagctttctgctgtagctcacaccttactcgacatcaaagaattcacactatggagaaacaatatgaatgcaacaaatgtctgaaagtctttagtagcctctcatttcttgttcagcatcagagtattcatactgaagaaaaaccctttgaatgtcagaaatgcaggaaatccttcaaccagcttgaatcactgaatatgcatttgagaaatcacattagattgaaaccctacgaatgcagtatatgtgggaaagcctttagtcataggtcatccctgcttcaacatcacagaattcatactggagagaaaccttatgaatgtattaaatgtgggaagaccttcagctgtagttcaaaccttaccgtacatcagagaattcacactggagaaaagccatataaatgtaatgagtgtgggaaagcttttagcaaaggctcaaatcttactgcccatcaaagagtacataatggagagaaacccaatagtgtgattccagaagatgagaaatacttaatctagagctagcaaggccaaagggaaaaaaaaaaaagactctcctagtaggtgacattgacattggtgcagaacagggaaggatgcaaaggaggagaggagagggagaggcactgcagagatctggactcagtg

SEQ ID NO: 462780 - DNA, 1215 bp, Homo sapiens
gcggcaggtcctgacgcggcataagcatgagtctgagcccagaggaaacttctgctgccacaattgctgcgtgtgctcatggcttgggtttgcggcctcatctggtggactttctggcacagcccttcctcaaggttgctgcatctgaagctctttaagacggcgtttcccttctgccagattgcactctgtgcacagtgcagttgcttctccctgcggagtgagatgggcccacattggctgtggctccacctggccttggtgctcttgccgccccctgctctgctgctcccttcatgtgagaagggtgtgttaagagtccccctaccactgcccaggcaggcccaggaagtgtcccagcagtgcccaagaaggtcacctccacctgtggaatccacagtgtgggtagcccccagggagccacagccatgtagacccagattcacaggaggatgcggttactgcaagcatctgaacctggccccaccacctatgggcagagttggttccagctcagtgtgtccatgggatgtctttaggttcaccttgcttttctgttcccacgctcacatgttggagctaagctgcatggagtgtcgttctccctgtacatatgagattagtcagcaatcctgtctccttccatattctgtctttatttctgcgacactatttctggagaacattgtatttgtgcttttcctttgatatgtttgtaattttcgttagaaaacccttttagattctaaagcttctacattcagtatttcaatcaatgataacaaactggtgtaagactaaatataaaatacaaacacatttccataaatcaacacatttccataaattgctgttataatgtctgccacaaaaagttcagttgtttgtatgtttttcaaatgtgctttgcttgtcttgatgatttacaactgttggcactgctgtttaagtctgttctgacagtgagaaagtgactcatttggcaaagtcagctgttttttactaaaagtgaatagtggtgagtggaaaggggcttgtatacaattttcttgtcaaagaacgatgaccggcaaataagcaattttagttccttggatttgagcaccactcttgcatgcctccaccaaccagcttgtctccacagagcttccttcctcactttacactgaaaatctgttatcagtgtgtggaaaataaaaattttacacatcttta

SEQ ID NO: 462781 - DNA, 2417 bp, Homo sapiens
caaaagcctgaggcgacccaggcccaggcagtgagggagcacttgtgtccagatggcattctgtccgcttcctcctccagccggtgctcagtgtggcacaaactgggcaagaccattctcacccaaccctctgctgagccctaggtgtacctgctgttggcaaatgtttccagctgcctggcaagctcaagagcagacagttctgactttcagaaggaggggctgtccagggagaagaggaacatggaacagaaagcattgacgttgaggtatttgagataacatttggggatagcagaagcatcctgttgctgttctgcagcatcccacactcatgtctgggcctccttcctgtctctgctctctggtcacgctgtcacttgtagactgttctgcctagaagccatgtgtgggccagcttgcacctaacagacattaggtagcactaaaacagatgcacactgccctgtgaggggcatgggaatactgtaatgggcatgaagctgcattataatagatcttaggaaattctgactctggcagctgagttgatggcagtgagaagtggcgtccaggactgggactgagccccacggtggtgagacatggcgtccaggaggaggactgagccaatggtgatgagacatggcgtccaggaggaggactaagcccatggcagtgagacacagcgtccaggaggaagactgagccagtggtgggcagctctggcaggccgttctgtttgagatcaggggttcctgtaattgatagcatcccagctcaagctcacagccaccttttcactctctgccctctgaggccagggaagcccactgggcccatgtgcaagtgtggtcctgaagtccatcaccaggttccccctttactgacaccccttccctgtggctcctgcccccctactcctggatctcccttctccacacagccagcgacctctctcagcagccacctctctgagggctgggctcggatgtgaatgatgttgagacgtgagccacagcgcaaatcagatagaagcctctgggcccatatagtctatgcctcactcatgaacaccaaacacatctcattttctgtgctcgacaagggcagcgttgagaggaacagtggatccctgcaccattatcccccaaaaccaggacttatctactgtagggaagaaatgtgtaggacaattgaagttgacccctcagggaaaggcaagaatgctatcttccaagatggagctgatttagcctccacatggagtcgctggaaacctcatggggaggaaaccagaaacagaaatggaaaaactagattttgtccaacaatggaggaaccacgtagaaagtacagtgcatcaatatcccagactatgcagccacgagacaatacttgtgacaaaactggcttctagcttcccatcctgtgaaaaacagcagaacccccatggtgcacccactgtatgcaggtggacagagccagggaggaaagggtcacagaagaaaacatttttgtcatggtggaattaacttattaccccaggtggaaaaatgactgcatgtgtgctgggatccttttcaaatgttcaaattatttttttttttaaatccagagtataatataaaaaggactctgcaaggaatagaggagtttattcatttaccttctagctggcagcttccccacttccagagttcgcctattttcttgacatatatgaagctcagagaaaatcagtttcttttgaacttgtacgtttcttcaaagggtagagcaatttgaactccctgcctattgtggttttcttaacaagccaaaaaggacacaacacataatgcttaaatctgcaagtacaaaagcctcttcttggatttaaagttgggaaacatctcctggggaaagtgtaactattaacgcaaagtatttggtattcactgtactggaggagaaaaagttctatacaaccatacttctggaacctgacctatctgtttaattacttcaccaaagaagtgtttaaccctctgcaaatccaacttcgtaatttatcagtccagtcgctgtgcctatgaggaaacataaattgcaatcatcttgcatttgcacagcagccaccaacttacagagcactttcacatcttttggtccatttcattcacgaacactcatcttcccgccccagagcccagtgaggagggcagggtaaattcctgtggtgctggagctgtgaataactaatctaatctgtggaacacagctcctgccctctcctggcttaccctctgagttcaggaagcctcaggaactgtttgctccttgatatctgggaagtgttgcacagagcagttctcacccttgtgggagcctggcgtagaggcagaaggccttacagatacagagtggggctcttc

SEQ ID NO: 462782 - DNA, 1583 bp, Homo sapiens
ttcttacagaagagctgggactgcgccctgtagcctttctcctagccctcatgtctgtgtgctgtggctgccgctgctttaatattttagaggccctcaaaatcacaaactatgctcaactcactctctacagttctcataacttccaaaatctattttcttcctcacagctaacacatatactttctgctccccagctccttcagctatactcactctttgttgagcctcccacaattaccattgttcctggcccagacttcaatccaggctcccgcattattccggataccacacctgacccccatgactatatctccctgatccacctgacattcactccatttccccatatttccttctttcttgttcctcactctaatcacacttggtttatcgatggcagttccaccaggcctacttgccgctcatcagcaaaggcaggctatgctatagtatcttccacatctatcattgaggctaccactctgccccctccaccagctctcagcaaatgatgtaaatcttttcttttgctgagccatgcatatttttggtattgtgacatgtcgctggacccaacacctacaggattggatcagaggctactgaataagccctgcccataggcggccttgtgacatatgtctgcatctatcgcctaagtgatgtgactctttttctgcctgcagcctgcacatagagaagattgtgacatatagctctgcccagtaaccaggtgatgtgtcttttctggcaggtcttttcccacagggagcattgtgaaacatcactgggctcagccaccaggttatgtgactcttctgcctgtgccctgcttccagaaaatattgtgacattcctcatacagcatccaggtgatgtgactcttctgctcattttctacttacaggagacatgcccaaaaaagggattgtggcatatctctgagcccaacacccaaatgttgtgactctcctgcctgagctgtgcctagagaaaatattataatatgtcaccggaccctgcatgcaagtgatccaattctccagtctgggccttgcccatagaggagattgagacatattccaggtgaagaattcaggtcatgcaaatggaggcggattttgacatatcataaagccaacataatacacagtctgcaggtggaattgggactctcatgcatggatccagttcatcattgatactgtgactcatgtacttggatgcaactcacaggaggtgttgacgcttttacctgaagctgggacatgtgtggaattgtgaatcctagccctagatcttcccacaggtgggattttgacatataactgcacccagcacacaggtgaagcatctcgtatgctcatcctgccaaaagttatgagtgtcaccctcacacatggacagagacctctggttaggtcttgaatcttgtacatggacacagtccgcagttggaatgtcatatgtagatccagccacaggtgtgatgttgacctatttataaagttagctcacaggcacattgataactctcatacctggatccagccaataaaagatatgttgactattat

SEQ ID NO: 462783 - DNA, 4507 bp, Homo sapiens
tcccttgcgccctgcggtagcccggggctgcccagggctgcgggctccaggcacccagagcgctgcgaccacatgaaaggcccggcgctcagcacccgccagccacctccagctggtttctaactacaccgccggggcctccatgcttctcagagaccagccttcgaagtgccgccttacacccggggcctggccaccgggcgggcgcggatggagctctggtccacatttgggagctcacagttgttcctgccaggaaccagccagaacaggaggcagccagggagaggggagccagggagaacgcagcctcagtcctggaaggagagggcctgctgggaagaacagaacccagctgtcttggccccagatgtggaagctgagacttaaagaagctatgaaacttgatcaggtcatgcagcgccagaggacccaaggtgggatctcaacccagactgtttggctccaaagctgaactgctacattacgttgcttcagcaaacagtcattcagagacaatgggctttagaggagtttagtgatgttactaacaaacataagtaccttgtactaacctcctggtgcccaagtgtttgaggtgagaaaaactgaaacatgaaaagcccagagaggtaaagtgactggctcaagcaaatacaggctccagctgcagccactttgaagataaagtttcctccatagaaattctgcaatacagatgtccttccgcggtcccagttcagtcctgcaccagttccttttcccactgggaaatttctttcctcttcctacttccatgcaactgcgaggcaaggctcaagcccacttccttctccttttcctgtgcctccctgtggagggagctccctcttcttcacagctccaggctcttccctactctggcccaaccttatgggcattttgctccataactctcctcgatctgaactgcttctgatttctctcaagtcatatggtagaagcccagcaggtagttctctaacagcagtcgtgatggacagtttcataatgaacagctatcacaatagccagtcagccctagacaatgtagcctctcaagttgctgcctttgctcccccgcaaaggagaggagcacaggagcttgcaggcagccacatttcaagtcataatagccatgtgggaccagaggctaccataaaggatgtggtacctctgagagctcgctgcccctggatgccaaatgaggtcctgagtggccatcctctaccactccctgggaacaaacaggccatgatcccttctggacgatgcagcttctgccctggtcccagactgctggggtgctgggctctcacctgcctcaccaggggcaagttcagcggtacaaaagcacatggctgccctctcttctttttcttcctcttcctcctcctcctcttcctcctcctcctcctccttctcctattcctcctccttctcctcctccagctgctctcccctcctcctcctcctcctgctttccttctccatgtgccaagcctgacagctttcaccaggagaactgagaagcctctcccgagggtggacataacctcctccgaagcagcagcagggctgcaggaccaggtgcacaggcggcggcttggagggcccttgcacagaccactgtgttttgcaaccaggagcggaagggaggctcagaaaacatccccaggagcaatgaccctggtggcctgagggctatttctcccatcacataagcaactactgtctggggtttcaaaatcctttttcaggcttcatcactaaaaagtgttttactcccaaatgacctgttgtcatcctcctgatcttctagagcttttttttttttaaataaacccctccccttgctcaagtaggacatgaatgatgtgatttaaggaaaagagaggggcagagagccccagtgcctagaaataaccacagccagtagcccttacacctgtaagtgttacttttcttctcattttatgtatgaaaaaaattaagtccagagagcacatgccccttctaacctgctgtataagttacttatttgtttcacttactacgtgcctttcccaaccataagctgcacgagggcacaacttcatacctcctctgtgcatcgctgtatcccaaaagccttacacggtgcctggagcacagtgggccctcaataaatattggtcatgtatggatggcggtgttcagattgtgaaaattcatgattggtgcacttttctataatgtatattacacttttctgtacatatgtgtattgtacttaataaaactgggttttaaaagacttgtcatgttaccaactcctgcttcaatcaatatttgtttattcatctgtaaaatgggtatgatgatggcaatatgacagtgcccatctcctacggttaataggataattaaaccagttaatatatgtaaagcacttagaacacagcctggcatgctgtcagcattatataagagcctgtgattccatccacgagttgggcaatgtatgcaagcacttaagttttgtcacatgcaaaaatatctttgctgagttgtgatttgatgttataccctagtttttatagagggtggatgtgacaaatagttattgaagaatgtgtcagtgtcactgacgaagctgaggacattgttcaccatgttgcacaacgccctttatctcaacattcccatgctcgctctgttcctcccggagctgaacatcaggaaagaccatgtctctccagaccagcacgtgtgatgtctgggagcagcacaagacccctttggctgtcaggaatttggaaataaaatgaaaggtgctgttcattggcttaagctgaggtcctaggacattctccttttcctgttgtttgttttctttatcaaaaacattgttttaactttgatgtttttgaaatggaaattgttttatagattatttctgattttaaaacatatgtatcttgattgtaaagaaaaatattaatattttgatgtatccccttatagatgtttgtatatacatttgggtatgtataatgtacgtgtgtgttatgtatattatatgcatctgtatgtgtaaacatggatatgtgtgtgcatatgtttttggaaacaaaattttagaaaagggaaaatggtgccatactgttttgaaacctaccatttgcttttagcttactgcagacattttaaggagttacaatacctcagggtatgcttgttgaaaaagaaaagaagttacaataatagcagtcataactttattcattcatttagcaaaatatgtatgatacccccaactgtggatggaaaatatttcttaaaaatacaataacaagtgggcggccgacaagatggctgaataggaacagctccagtctgcagctcccagcaagatcaacacagaaggcagtgatttctccatttccaactgaggtacccagctcatctcattggtactgattagacagttgatgcagcccacggaagctaagggaagccatgaaggactgtgccttgaggaacggtgcattccagcccagatactacgcttttcccatggtcttcgcaacccatggatcaggagattccctcgggtgtctgcatcaccagggctctggttttcaagcaaaaaactggatggccgtttgggcagacactgagctagctgcaggagttttttttcataccgcagtggtgcctggaatgccagcaagacagaaccattcactcccctggaaaggggactaaagccagggagccaagtggtctagctcagtggatcccacccccatggagcccagcaagctaagatccactgtcttgaaattctcgctgccagcacagcagcctgaagtcgacctgggacactcgagtttggttgggggagaggcatccgccataactgaggcttgagtaggcggttttcccctcacagtgtaaacaacgcctctgggaagtttgaactaggtggagcccactacagctcagcaaagccactgtggccagactgcctctctagattcctcctctctggtcaggacatctttgaaagaaaggcagcacccccagtcaggcgcttatagataaaactccctgggacagagcatctgggggaaggggtggctctgggcgcagtttcagcagacctaaacgttcctgcctgctggctctgaagagagcagtggatctcccagcacagtgctcgagctctgctaagaaacagactacctcctcaagtgggtcccggacccccatgcctcctgactgggagacacctcccagcagggatcaacagacacttcatacgggagagctctggctggcatctggcaggtgcccctctgagacaaagcttccagaggaaggaacaggcagcattctttgctgttctgcagcctctgctggtgatacccaggcaaacagggtctagagtggacctccagcaaactccagcagacctgcagcagaagggcctgactattttaac

SEQ ID NO: 462784 - DNA, 2433 bp, Homo sapiens
tgcacaggaacgagcaaagacagctagcctgtgaggctagaaccaagatggagtcagccatgtcagatttctctgattgtcataattttgcaaagcgcccgcctggcaggacgactgagcaaggctttggaaaaccagagagattagagcgaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtgcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgc

SEQ ID NO: 462785 - DNA, 2199 bp, Homo sapiens
tgcacaggaacgagcaaagacagctagcctgtgaggctagaaccaagatggagtcagccatgtcagatttctctgattgtcataattttgcaaagcgcccgcctggcaggacgactgagcaaggctttggaaaaccagagagattagagcgcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgc

SEQ ID NO: 462786 - DNA, 438 bp, Homo sapiens
gctgcgtctaataccacctccacccctcatccctcacaatgcgcggaaaaccacaggcggctgtgcgcgcagcgtcggctcagccaccgcagctcctcccctgggatgaaaaagcactctgacgtcttgaaagctggcagctctctgtttggaaaatctctgcccagtgaaaaaatgtaccgacaagattactaagtaacacagtcttctgggaatgccttatcaatgccagctatttgaagagcacccaaagtcaaactagtgctccgcgctggcagtctggaaaaggcagatgtatgtgagtagagaaactgatagacaactagttgctggccagttggcctgttttcgtgctacaagccttcagaaaacagtcgcctccttttaccacgtttctatttctaaaccaaaatgaaaaggacgtttgttcaaaagata

SEQ ID NO: 462787 - DNA, 667 bp, Homo sapiens
gctgcgtctaataccacctccacccctcatccctcacaatgcgcggaaaaccacaggcggctgtgcgcgcagcgtcggctcagccaccgcagctcctcccctgggatgaaaaagcactctgacgtcttgaaagctggcagctctctgtttggaaaatctctgcccagtgaaaaaatgtaccgacaagattactaagtaacacagtcttctgggaatgccttatcaatgccagctatttgaagagcacccaaagtcaaactagtgctccgcgctggcagtctggaaaaggcagatgtatatttcagtcagtaatggatattaccaccagcatttaatcaaggaagcaggaagtgatccatcactgctagctgctatctacaggaattctgtctacaggcagggcagaccagtcagccagtatcttcccgaagtaccttggtcttccaccatccatcccactgagagagccgttcctctaatgaggcatttctaagcagctgtccattgaactctaccccttgagatatcctgagaaataggaatctatggttcctattgtttggaaagtagtatatcttccttgaagattcacaatgcgtattaatatgcttagggctctgataagtcctgtattaaaaatgcttgttaaactttaaaaagaacctag

SEQ ID NO: 462788 - DNA, 954 bp, Homo sapiens
gctgcgtctaataccacctccacccctcatccctcacaatgcgcggaaaaccacaggcggctgtgcgcgcagcgtcggctcagccaccgcagctcctcccctgggatgaaaaagcactctgacgtcttgaaagctggcagctctctgtttggaaaatctctgcccagtgaaaaaatgtaccgacaagattactaagtaacacagtcttctgggaatgccttatcaatgccagctatttgaagagcacccaaagtcaaactagtgctccgcgctggcagtctggaaaaggcagatgtattgttaaacaggaaatggagaaacaggcaccaagaagaaaggagagagatgaggcgttctatgaacatctgtccctgatgaattccaaggaaagacgggcccactcatgagagatctactaccccccgcaacccatgtattctaggatccacgcagctcttttcagaagtttcatcagttatacctgcttccctgagagctgaatgttctgactaaaggcaagttttgctctcctatagccacaatgtgggcattcattagctatgccaatcagttgctcagactcggactttgaaccggggctaacattacaaagaagtggaagccatgaagaatctattctgtgggaggcctagggtcacaacagcagcaacatcaagttttcaagaacagaagcagtgctctgagctgatatactctataaatgatgtccttctgctccacatgcatgcggaatcttttcactttttcaaagatggctttggcctgttcaccctccttcttgtccaggacactggaagttgggctttctatgccagctgactccaaacctggctgtgggtagggcaatgactgtttgccggaatctatgtcagctgaacaccctgaggacgaaagcaaaatcttggacttggagagtttcagaggcctcactga

SEQ ID NO: 462789 - DNA, 468 bp, Homo sapiens
cagtcctcatttgaaaatgagaggattgggaaagatgtcttcttagggcttgtttggtgtgagaattttatacatagatattaaaattatacatgtttatcctccttagatttcagtcagtaatggatattaccaccagcatttaatcaaggaagcaggaagtgatccatcactgctagctgctatctacaggaattctgtctacaggcagggcagaccagtcagccagtatcttcccgaagtaccttggtcttccaccatccatcccactgagagagccgttcctctaatgaggcatttctaagcagctgtccattgaactctaccccttgagatatcctgagaaataggaatctatggttcctattgtttggaaagtagtatatcttccttgaagattcacaatgcgtattaatatgcttagggctctgataagtcctgtattaaaaatgcttgttaaactttaaa

SEQ ID NO: 462790 - DNA, 1528 bp, Homo sapiens
gctgcgtctaataccacctccacccctcatccctcacaatgcgcggaaaaccacaggcggctgtgcgcgcagcgtcggctcagccaccgcagctcctcccctgggatgaaaaagcactctgacgtcttgaaagctggcagctctctgtttggaaaatctctgcccagtgaaaaaatgtaccgacaagattactaagtaacacagtcttctgggaatgccttatcaatgccagctatttgaagagcacccaaagtcaaactagtgctccgcgctggcagtctggaaaaggcagatgtataaaccaaaaaggatggagttcagagaccttccatgttgatgaacaagaacacattcacctgctgtaggggtaggtgtaccccaaaactccactgatacagaagcttctatactcaagacccttctatactcaagaccctggatcttaccctatatatctcttcatctggctatttatttgcatcttttaatatatcctttgtaataaactagtaatctagaaagcaaacttttcctagctctgtaggccattctagtaaatgattaaacctgaggaggagttatgggaacctttgatttgtagacaagttggacaaaagtggtatatatcctaatataacatgggaacctgccacttatgattggcgtgtgaaattgggggatggggaagcagtcttgtgggactgagcccttagcctgtggggtctaatgctatcttcaggtaatatcagaactgagttaaattataggataccagtcagtgtccattggagaattgaattattgtgaggagaaacccacacatttggtggctaaaagtattgatgtgagtagtagcatataggagttttttgctatatacatatgtagtgtaagtttaaagtaaaaagttttgtattgtcaggagtgacttctttgcacctaaatatcactgctataactgcgttactaaggaatagttgcttgcttttatgtatttggcacctgcagctactgttctaaaaagtttgcatgtgttaacctattaattaaatctacaaatgactggctgtacccatgaagtgagttattctaaagacaatggaacatttaaatggtttagaaattttttgattaaaaatacattaataatatctcctaaagaatgtggagcagggaagtgtcctcgctgtgaagaggccgtcgaaaaaagacctgaaggaggtgtgagggtgggcctgtggctactggagaaagaacattttgggagaggccctaaggttgggagactccctggtgttttggaggaacagcaaggagtccgagcagccgctgccattgcactggctgcagccaggcgggacccactcccaggcccagagcctctgccactctgttaccctggccccgtgtcatctctcttgcctaccgcctctgtggggaggtgtggggaggaggtggatagtccccggaggagcctgcccctgggagccccctggagcctgctgccctgggagcctccacgatgagg

SEQ ID NO: 462791 - DNA, 2780 bp, Homo sapiens
tttgttacaagtgtatccaatgtccccagaacgagggacttgtggggcgcggctcatcccagcgccacttgctctgcagctcccagaggtggtggttgtgttacgaaggctgaccctgccaatggccgacaaaatggtgcgcacccccaagtgctcgagatgcaggaaccatggcttcctggtgcccgtcaagggacacgcgggcaaatgccgctggaagcagtgcctctgcgagaagtgctacctgatctccgagcgccagaagatcatggccgcgcagaaggtgctcaagacgcaggccgccgaggaggagcaggaggcggccctgtgtgcgcaggggcccaagcaggcctccggggctgcggccgccgcccccgcccccgtccccgtcccggccgcgagcctccgcccgctgtccccggggactccctccggagacgccgacccgggacccgagggccgcgcggccgcttgcttcttcgagcagcccccgcggggccggaaccccggcccgagagccctccagccggttctgggcggccgcagccacgtggagccgagcgagcgagccgccgtggcgatgcccagccttgcgggacccccttttggggcggaggccgcaggcagtggctaccctggccccctagacctgcgcaggccgatgcggaccgtgcccggcccactgttcaccgactttggtaagtcgtggccttggtcccgcggtcgactcccggagctggcagcccaggccagcccggatggggagctggcataggggttcggggtggagagaagtttttccacgggtaacggaccttccgctttgagaaacccttcttcgaacagggatttggattgggtaacttttcgcaaaaaggaaacgagaaacagaaaggaatgggcggttcagagggcttttaacatttagctgtagtttgtgccattccggcatgcaagaacaaaatggcgtccagtcgacttagcagtgcttcctcctccgggggaggcttcgaggagccgagtcctactgctcttgcgcacctcttcccgccatttccttgggctggaggctcctcctccagaataacagaattttcctgccggcacgttagcgcaaggacgcctgcgcactcttccctcccggttcgcggtcgggaggctcctcccctcagctccgccctggcccagtgcgcctgcgcacctcttccctccgtttccccacgtgcagtgcgccctctgaacatcaacccggaccgtgcactgggccctgagtaccctggtggctccagcatgcacccctactgcccgttcccgctgggctacctggacgcccctcctggcgtccccctgcagcagggcttccggcatgtgtcccgcagccagtaccaaggcggaggcttggtgtcagaaccaggaggagacttccagccaagctactacctgccgccgccgccgccgccactgccgccccttccaccgcttccaccgcagccccagttcctcccgccaggctacctctctgcgctccacttcctccccccgccaccgccaccaccacctccatcatctttctcactgaccgtcctgtttgatactgacaaggagaacactgatgaccaggatgcagaggtactgtcgggtgagcccagccagccatcgtctcaggagcagtccgactaggccccaggcccgccctcctggccagcagagtggggcactggggggcaacagcaacagttttcttgtcttcattcagtgatatgtagggaggaaggaggttgatagcatagatggcaactgattcccagtttaagataggaggaaggagagcaatttctaagtttcaatcctgcgctgtacagttgaagaagagtgtggaggaagctattaccaggggagggccagggctctgaggagtgggcgctgggagaagctcccatttaggaatgaatttaactgtccttgggttacactaccatttattggaacaagccccagaggcagtatttgatttcctcaggccccactctaggacaggaggcaccatctatttcagccttctgctgcctttgcctggtcctccaggttgctgggggcaccacagacatcaagattccagttcatccaggtggctggagccagcagccaggaccagggtcgttgacagcaggttctgcagcatcctgccttgctgctctgtcccccacatcttcctggccacagccccttgcccctcctctaaggggttttactagcaagcatcctggctgctggggctacttcattccccctccataaagtttcagccattatgggcactggttttaaaaaatttattagtttgactatttgatgtttttatagtgattgccaactttaaaaagtaggctgttcataagcactgatgcagtccctagggaatagaatggtgcttctgatcacctgtgacatgaacagtttcttctgtgaggacagttggctattgaaataaaatgagcaatggaaatccttgtggaaggcttattctccctttgatcctggtggaagctgtgtattgttgggctcatcatgtaatttttccaagccttactttgtcctctggtaacattggttcagtggtgctctgaggatgcaggagtgcttgtgtgaaacaccttctttgatggcacctgtgtcattggatgcttgaaggcagtgacctttttgagaccacgtcagaggctagaaatgaccaaggctctttacttcctggtgctccccacattccaggcactgtgctg

SEQ ID NO: 462792 - DNA, 2250 bp, Homo sapiens
tttgttacaagtgtatccaatgtccccagaacgagggacttgtggggcgcggctcatcccagcgccacttgctctgcagctcccagaggtggtggttgtgttacgaaggctgaccctgccaatggccgacaaaatggtgcgcacccccaagtgctcgagatgcaggaaccatggcttcctggtgcccgtcaagggacacgcgggcaaatgccgctggaagcagtgcctctgcgagaagtgctacctgatctccgagcgccagaagatcatggccgcgcagaaggtgctcaagacgcaggccgccgaggaggagcaggaggcggccctgtgtgcgcaggggcccaagcaggcctccggggctgcggccgccgcccccgcccccgtccccgtcccggccgcgagcctccgcccgctgtccccggggactccctccggagacgccgacccgggacccgagggccgcgcggccgcttgcttcttcgagcagcccccgcggggccggaaccccggcccgagagccctccagccggttctgggcggccgcagccacgtggagccgagcgagcgagccgccgtggcgatgcccagccttgcgggacccccttttggggcggaggccgcaggcagtggctaccctggccccctagacctgcgcaggccgatgcggaccgtgcccggcccactgttcaccgactttgtgcgccctctgaacatcaacccggaccgtgcactgggccctgagtaccctggtggctccagcatgcacccctactgcccgttcccgctgggctacctggacgcccctcctggcgtccccctgcagcagggcttccggcatgtgtcccgcagccagtaccaaggcggaggcttggtgtcagaaccaggaggagacttccagccaagctactacctgccgccgccgccgccgccactgccgccccttccaccgcttccaccgcagccccagttcctcccgccaggctacctctctgcgctccacttcctccccccgccaccgccaccaccacctccatcatctttctcactgaccgtcctgtttgatactgacaaggagaacactgatgaccaggatgcagaggtactgtcgggtgagcccagccagccatcgtctcaggagcagtccgactaggccccaggcccgccctcctggccagcagagtggggcactggggggcaacagcaacagttttcttgtcttcattcagtgatatgtagggaggaaggaggttgatagcatagatggcaactgattcccagtttaagataggaggaaggagagcaatttctaagtttcaatcctgcgctgtacagttgaagaagagtgtggaggaagctattaccaggggagggccagggctctgaggagtgggcgctgggagaagctcccatttaggaatgaatttaactgtccttgggttacactaccatttattggaacaagccccagaggcagtatttgatttcctcaggccccactctaggacaggaggcaccatctatttcagccttctgctgcctttgcctggtcctccaggttgctgggggcaccacagacatcaagattccagttcatccaggtggctggagccagcagccaggaccagggtcgttgacagcaggttctgcagcatcctgccttgctgctctgtcccccacatcttcctggccacagccccttgcccctcctctaaggggttttactagcaagcatcctggctgctggggctacttcattccccctccataaagtttcagccattatgggcactggttttaaaaaatttattagtttgactatttgatgtttttatagtgattgccaactttaaaaagtaggctgttcataagcactgatgcagtccctagggaatagaatggtgcttctgatcacctgtgacatgaacagtttcttctgtgaggacagttggctattgaaataaaatgagcaatggaaatccttgtggaaggcttattctccctttgatcctggtggaagctgtgtattgttgggctcatcatgtaatttttccaagccttactttgtcctctggtaacattggttcagtggtgctctgaggatgcaggagtgcttgtgtgaaacaccttctttgatggcacctgtgtcattggatgcttgaaggcagtgacctttttgagaccacgtcagaggctagaaatgaccaaggctctttacttcctggtgctccccacattccaggcactgtgctg

SEQ ID NO: 462793 - DNA, 1046 bp, Homo sapiens
gtgagtctagaagtggactctgccccagagacaccttggttgccacctttcagagccctgagacagaggatgccaaagttaagccacatctggattcctgacccacagaaactttctggaatctatgttccagaattcggcttcccaagacccacagcccagaatccaggctccagaattcaggctccccgagatccaggcttcagaatccgagctccctcagacccaagctccgaatccgggctccctgagatccaggttccggaatccgggctcctggagatccaggctccggaatccgagctccctcagatccaggttccggaatccgggctccccgagatccaggctccggaatccgagctccctcagaaccaggctctggaatccgggctcctccagatccaggttccggaatccgggctccaggctcgcattccgggctgggagccagccacagccgttaggctgagatttttaaaatctggcgccaaaatccactccccgggtgggagtggcggtgccgggtggagctcccgggggaaagagggtcccgcgttcgaatcccgcctccgctacgcccctggtgcggattccccgaccgcgcctcccaaactgcgcgctgggagggggaaagccccgggccccacccacgggaagcgcggggctttctgggacttggagtccagtccctgggggtcccgcggggatggctctgggcacccgaagcccctccccagcgccgagacaggagggctggggtagattcgagaccccggtttgcagagcgcaagactgaggcccagggccgcgcagtcaggcaggaaacggcgctcctggcggatggaacagcacgggcaaaggctgggtatggggggtctcgctccgttgcccacactggagtgcagtggcgcaatcatggctgactgcagacttgaactcctggatgcaagccattctcctgcctcagcctcccgaggagctgggactacaggtgtgtgccagcacatgtggctaattattaaaaatttttttggctgggtgcc

SEQ ID NO: 462794 - DNA, 932 bp, Homo sapiens
  misc_feature (5)..(5): n is a, c, g, or t
  misc_feature (7)..(11): n is a, c, g, or t
  misc_feature (14)..(16): n is a, c, g, or t
tcctntnnnnnatnnnagctctagtttgccagtcttccgctgagcacctaatcttctccaggcctctgataatggaagccaaggacccagcacagaccagctggcggccccatccaggaagtgccaaccccacgggtcactcttggggacccttggtggcccagccattgcagccatgcagagatgcattaactccccataaggactcaggattgtcatcaagaagtacaggtgggattctgaaggcagacctcaagctggaagaggctagctgcatcccacaggtaggcgtggacatcaagcaagcacctgcctgcctgtctagcatggcgctagacatgaaggaagcaaaagaatggagcacagaccctgatgaggagcctgcactgagtgccaaccatgagctggacagcccactaggcaagtgcaatgacaaaagaaacaagcgttaatcctgtctagccagagcactaaggaacctgcttattctgcgaatgcctcagcaaggtcctaaaggagagcttccactgcctcctagtttgcaaatgatttccaaatataatttctcatcggaatctcacaaccaccaaatacgaccaggcattattcatctgattttacagatgaggaaatcaagggtcagagaagtgatgtgacttgcccaaggcccacagatggtaggtggcaaagccaggacttggaatccaagataaagaaaactcagtgggaaggagaagtttgtgattaaatccaattaaaggaatagagtaaaataaagaacacagtaaatttctcaccaggaatgtgttccgttttcctcttggcttttgaaaatgaggctgcttctgctatattatctggtggaaaacacatcatcaaagtcaatgggacatcagcccttctcttgggtatttgttgaggctcctctgcac

SEQ ID NO: 462795 - DNA, 887 bp, Homo sapiens
gattgagtcctgtgtcttggataaaacgagaggaggacagcctgatcctggacactcaggggggcgtggccacgggaggcgggcttctttggaagctgcggggccgagggcgccatactcctgtctgtccagacccccgatcgcccaccgcccctgtcgccctagcccaggcccacgcgcggccgcatgcggatccactcactggagaacgtggacaaggcgctgcagtttctgaaggagcagcgcgtgcacctggagaacgtgggttcgcatgacatcgtggatgggaatcaccggctgacgctggggctggtctggaccatcatcctgcgcttccagattcaagtcatcaaaattgagactgaggacaacagagagacacgctcagccaaggatgctctgctcttgtggtgtcagatgaagacagctggttaccctgaggtaaacatccagaatttcaccaccagctggcgggatggcttggccttcaatgccctcattcaccggcacaggcctgatctcgtggacttcagcaaactcaccaagtccaatgccaactacaacctgcagagagccttccgcacagctgagcagcacctggggctggcgcggctgctggatcctgaagtctatccctaatcccatccctgacttcagcctcagccccaaaccaggatcagccctgacacccatctcccatcccaaattaaagctgctcccttcctctgagctctactgtgtgccagacacatgtctgggaaccttatcagagctgttcactttcatcttcacactgacctggttagagagaatttatcaaccctgttttattttattttatttatttatttatttatttatttatttatttatttatttattttttt

SEQ ID NO: 462796 - DNA, 1606 bp, Homo sapiens
  misc_feature (1)..(1): n is a, c, g, or t
  misc_feature (4)..(5): n is a, c, g, or t
  misc_feature (7)..(8): n is a, c, g, or t
  misc_feature (10)..(10): n is a, c, g, or t
  misc_feature (12)..(13): n is a, c, g, or t
  misc_feature (15)..(15): n is a, c, g, or t
  misc_feature (19)..(19): n is a, c, g, or t
ncanntnntntnntncaanatgatgattattccccaccttctaagagacaaagaccaacgagccaccacagccaccagtcccagaacccgccaatgctggggaacggaaaatgagggagttcaactctggccctcacaatccagtggaggagacgaaactcatctgcctctgtccctctgggcacgcctcatgccaggtgcatctgtggacaggggccatgctcctgggcttccaaagttggagaaagctgccaggctcaggtctgaaggccagaattctacagtaagtcctactgagtcaaggtgggagcagggtcggtagcttccgaggctctgcgggagaatccgtttcctggccgtagaggtggcctgcactcctcagcttgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatggtatgtctaaactggaaaagtcttgtaatcttatgttcatgggcgtttacacagtggagttactgttcatcatgggggtaccgtggacaagcccagggctgccggcgagtcatgccatccttacatgtttctccttgtaaggtgctttgtagtgtctacacactttgtttctagattgctgcaaagctgaggaaaagtttctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagctggacctaccatgaaagacttctgaatccaggaagagaaactgactgggcaacatgttattcagatggggtcttcttatgttgcccaggttggtctcaaattcctaggctcaagtgattccgcccacctctgcctcccaaagtgctgggattacgggcatgagccagtgcatctggccaccttattttctattactggctcaatgtaatggctccatctcaggaacagccaatgaaagagatgcacaggacaaggtgatggagctggccaaggtgctgagggaagagcattgtaggctgagtcaacaggataaaggcattaggaggaaactctctggtgtgtctgaggctctggaaggaggccagtggagcaaagagatggagcgaagtcagcgaggaggccagggagttgctgggctgggatcggtacagatcgtggccacagagctggaggtgagcagcaggcgagtgaagggaaacttcatctgtatttctagcccctcccatcgcttgcatgaccacctgagctccatgtcctgtcagatcagcagcagcattagattctcacaggagcacaaactctgttgtgaagtgtgcatgcgagggatctaggttgtgtactccttatgagaatctaatgcctgatattctgtta

SEQ ID NO: 462797 - DNA, 348 bp, Homo sapiens
tttgaggtggagtcttgctctgtcatccaggctggcagtggcgtgatcttggctcactgcaatgtctgcctcctgggttcaggtgattctcctgcctcagcctcctgagtagctgggactacaggcgcccgccaccatgccctgctgttttgtatttttgagaaatggaatcatcgtatcgctgatctacgtaaacaaactgaagaattgtctgaaagaaaatatgacatgaacttatgaattcaacaggtgaagatttacaacttgataaatcaactttgtcagctcgagctgtaaaagccaaaggtccggtgatgatcccatacccttttttccagtctcatgttg

SEQ ID NO: 462798 - DNA, 1671 bp, Homo sapiens
gggagagcaccgcgagggcggagctgcgttctcctctgcacagatttcggtggtactgcgaaggcggagcagagttctcctcagatgatgattattccccaccttctaagagacaaagaccaacgagccaccacagccaccagtcccagaacccgccaatgctggggaacggaaaatgagggagttcaactctggccctcacaatccagtggaggagacgaaactcatctgcctctgtccctctgggcacgcctcatgccaggtgcatctgtggacaggggccatgctcctgggcttccaaagttggagaaagctgccaggctcaggtctgaaggccagaattctacagtaagtcctactgagtcaaggtgggagcagggtcggtagcttccgaggctctgcgggagaatccgtttcctggccgtagaggtggcctgcactcctcagcttgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatggtatgtctaaactggaaaagtcttgtaatcttatgttcatgggcgtttacacagtggagttactgttcatcatgggggtaccgtggacaagcccagggctgccggcgagtcatgccatccttacatgtttctccttgtaaggtgctttgtagtgtctacacactttgtttctagattgctgcaaagctgaggaaaagtttctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagctggacctaccatgaaagacttctgaatccaggaagagaaactgactgggcaacatgttattcagatggggtcttcttatgttgcccaggttggtctcaaattcctaggctcaagtgattccgcccacctctgcctcccaaagtgctgggattacgggcatgagccagtgcatctggccaccttattttctattactggctcaatgtaatggctccatctcaggaacagccaatgaaagagatgcacaggacaaggtgatggagctggccaaggtgctgagggaagagcattgtaggctgagtcaacaggataaaggcattaggaggaaactctctggtgtgtctgaggctctggaaggaggccagtggagcaaagagatggagcgaagtcagcgaggaggccagggagttgctgggctgggatcggtacagatcgtggccacagagctggaggtgagcagcaggcgagtgaagggaaacttcatctgtatttctagcccctcccatcgcttgcatgaccacctgagctccatgtcctgtcagatcagcagcagcattagattctcacaggagcacaaactctgttgtgaagtgtgcatgcgagggatctaggttgtgtactccttatgagaatctaatgcctgatattctgtta

SEQ ID NO: 462799 - DNA, 7995 bp, Homo sapiens
gaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacagataaggtaactggctcacagattaatttgcacaagattaaacatctggcaagtgatgtgttctgcatgtctgactctgaagcctttgcttattactctataccgttctgcagagtaaccgttttatctgcagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatggaggacaacaagccagggcacaaaagcttgaaaactggtagcagattggagaaggaaatggtagattctaaggctagactaacaaagcagctaataagaaagaaagaaagaaactttacctcttttaaggagtttagacttcgttatgtagaaaatgagagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaaatgaacatttgaaagacataatggaacaagaacaaaaactgaaagaacatcacacagttgaagctccaggaggtcaaaaggctcgttatcggaaagagcaaacattgcttaagcaactgccttgcattccattggtagaaaatttgttgaaggatgggacagatggctgtgcattagctgcccttattcatttttactgtcctgatgttgtcagattagaggatatttgtttgaaagaaactatgtctttggctgatagcctgtataatctgcagctgattcaagaattttgccaagaatacttgaaccagtgttgccatttcactctggaagatatgctctatgctgcttcatccataaagagtaattatttggtgttcatggcggaactgttctggtggtttgaagtggtgaagccgtcttttgtacagcctcgtgttgttcgtccacaaggagctgaacctgtaaaagatatgccttcaattcctgtcttgaatgctgccaaaagaaatgtcttagatagtagttctgacttcccttcaagtggggaaggagctacatttacacagtctcatcatcatttgccttctaggtattcacgtccccaggctcattcttcagcctcaggaggaattagaaggtcttcatctatgtcttatgttgatggcttcatagggacatggcccaaagagaaaagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactagaagaaaagaggcgtgctatagaagcccagaaaaagaaaatggaagctgcttttaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccagtctctagcctttctttggcatcgctgaacacgggtgataacgagagtgtacattcaggcaagaggacgccaagatcagagtctgtagaaggcttcttatctccaagtcgttgtggcagtcgaaatggagaaaaagactgggagaatgcatcaacaacttcttcagtggcttctggaacagaatatacaggaccaaagctctacaaagaacccagtgcaaaatccaataagcacataatacaaaatgctttagctcattgctgtttggctggaaaagtaaatgaaggtcagaagaaaaaaatactggaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaaatgactccttttctgtttcttgaataaaatgtagtttttggtaaaattatttgaacttgagataactcatacagtttttctatcccctaacctatgtttaaatttaataacttgaatattcataacaggcaacttgaaataattagccttttaaaaatactaacttagggcaatgttaaaaagtcggtaactttctatgcttagcacagacggtctacatagtatgatttataaatgtgcttatcttatgttaatcttgctcatactaattcactatcttttggtgaattgatagttatattgtaccagaactagtgctctatgtctttgaaactgaatggccagtgaactcactgatctggagtagccatgagaagctagttcttgaccattattttgtaagtttcactttgattttgctgattctacttactcagaacagagtaaagaaaaaggtgttttttaagaaaaaagagatctgataacaaaactataaaataatcgtcatgcctaattatatacctgaagaaatatctggttagtagacataaatgtggttttctagcttgggacctttttgataggttctgtaacttcagagcaca

SEQ ID NO: 462800 - DNA, 6532 bp, Homo sapiens
tattactggtacattagaatttacagtactgatttttttcctatgcgttatttggtacttatttattttcatgtattttttttatatcgtaggctcgttatcggaaagagcaaacattgcttaagcaactgccttgcattccattggtagaaaatttgttgaaggatgggacagatggctgtgcattagctgcccttattcatttttactgtcctgatgttgtcagattagaggatatttgtttgaaagaaactatgtctttggctgatagcctgtataatctgcagctgattcaagaattttgccaagaatacttgaaccagtgttgccatttcactctggaagatatgctctatgctgcttcatccataaagagtaattatttggtgttcatggcggaactgttctggtggtttgaagtggtgaagccgtcttttgtacagcctcgtgttgttcgtccacaaggagctgaacctgtaaaagatatgccttcaattcctgtcttgaatgctgccaaaagaaatgtcttagatagtagttctgacttcccttcaagtggggaaggagctacatttacacagtctcatcatcatttgccttctaggtattcacgtccccaggctcattcttcagcctcaggaggaattagaaggtcttcatctatgtcttatgttgatggcttcatagggacatggcccaaagagaaaagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactagaagaaaagaggcgtgctatagaagcccagaaaaagaaaatggaagctgcttttaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccagtctctagcctttctttggcatcgctgaacacgggtgataacgagagtgtacattcaggcaagaggacgccaagatcagagtctgtagaaggcttcttatctccaagtcgttgtggcagtcgaaatggagaaaaagactgggagaatgcatcaacaacttcttcagtggcttctggaacagaatatacaggaccaaagctctacaaagaacccagtgcaaaatccaataagcacataatacaaaatgctttagctcattgctgtttggctggaaaagtaaatgaaggtcagaagaaaaaaatactggaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaaatga

SEQ ID NO: 462801 - DNA, 7340 bp, Homo sapiens
gaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacagataaggtaactggctcacagattaatttgcacaagattaaacatctggcaagtgatgtgttctgcatgtctgactctgaagcctttgcttattactctataccgttctgcagagtaaccgttttatctgcagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatggaggacaacaagccagggcacaaaagcttgaaaactggtagcagattggagaaggaaatggtagattctaaggctagactaacaaagcagctaataagaaagaaagaaagaaactttacctcttttaaggagtttagacttcgttatgtagaaaatgagagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaaatgaacatttgaaagacataatggaacaagaacaaaaactgaaagaacatcacacagttgaagctccaggaggtcaaaaggctcgttatcggaaagagcaaacattgcttaagcaactgccttgcattccattggtagaaaatttgttgaaggatgggacagatggctgtgcattagctgcccttattcatttttactgtcctgatgttgtcagattagaggatatttgtttgaaagaaactatgtctttggctgatagcctgtataatctgcagctgattcaagaattttgccaagaatacttgaaccagtgttgccatttcactctggaagatatgctctatgctgcttcatccataaagagtaattatttggtgttcatggcggaactgttctggtggtttgaagtggtgaagccgtcttttgtacagcctcgtgttgttcgtccacaaggagctgaacctgtaaaagatatgccttcaattcctgtcttgaatgctgccaaaagaaatgtcttagatagtagttctgacttcccttcaagtggggaaggagctacatttacacagtctcatcatcatttgccttctaggtattcacgtccccaggctcattcttcagcctcaggaggaattagaaggtcttcatctatgtcttatgttgatggcttcatagggacatggcccaaagagaaaagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactaaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccagtctctagcctttctttggcatcgctgaacacgggtgataacgagagtgtacattcaggcaagaggacgccaagatcagagtctgtagaaggcttcttatctccaagtcgttgtggcagtcgaaatggagaaaaagactgggagaatgcatcaacaacttcttcagtggcttctggaacagaatatacaggaccaaagctctacaaagaacccagtgcaaaatccaataagcacataatacaaaatgctttagctcattgctgtttggctggaaaagtaaatgaaggtcagaagaaaaaaatactggaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaaatga

SEQ ID NO: 462802 - DNA, 3035 bp, Homo sapiens
actaatggctgtcactcgccatatacaaatgctcagcccttgtgttgctggaaagtaatgaaggcagaagaaaaatactgagaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaaatga

SEQ ID NO: 462803 - DNA, 1410 bp, Homo sapiens
ctccttgagtatccccccccaatggaatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaaatga

SEQ ID NO: 462804 - DNA, 4691 bp, Homo sapiens
gaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacagataaggtaactggctcacagattaatttgcacaagattaaacatctggcaagtgatgtgttctgcatgtctgactctgaagcctttgcttattactctataccgttctgcagagtaaccgttttatctgcagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatggaggacaacaagccagggcacaaaagcttgaaaactggtagcagattggagaaggaaatggtagattctaaggctagactaacaaagcagctaataagaaagaaagaaagaaactttacctcttttaaggagtttagacttcgttatgtagaaaatgagagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaaatgaacatttgaaagacataatggaacaagaacaaaaactgaaagaacatcacacagttgaagctccaggaggtcaaaaggctcgttatcggaaagagcaaacattgcttaagcaactgccttgcattccattggtagaaaatttgttgaaggatgggacagatggctgtgcattagctgcccttattcatttttactgtcctgatgttgtcagattagaggatatttgtttgaaagaaactatgtctttggctgatagcctgtataatctgcagctgattcaagaattttgccaagaatacttgaaccagtgttgccatttcactctggaagatatgctctatgctgcttcatccataaagagtaattatttggtgttcatggcggaactgttctggtggtttgaagtggtgaagccgtcttttgtacagcctcgtgttgttcgtccacaaggagctgaacctgtaaaagatatgccttcaattcctgtcttgaatgctgccaaaagaaatgtcttagatagtagttctgacttcccttcaagtggggaaggagctacatttacacagtctcatcatcatttgccttctaggtattcacgtccccaggctcattcttcagcctcaggaggaattagaaggtcttcatctatgtcttatgttgatggcttcatagggacatggcccaaagagaaaagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactaaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccagtctctagcctttctttggcatcgctgaacacgggtgataacgagagtgtacattcaggcaagaggacgccaagatcagagtctgtagaaggcttcttatctccaagtcgttgtggcagtcgaaatggagaaaaagactgggagaatgcatcaacaacttcttcagtggcttctggaacagaatatacaggaccaaagctctacaaagaacccagtgcaaaatccaataagcacataatacaaaatgctttagctcattgctgtttggctggaaaagtaaatgaaggtcagaagaaaaaaatactggaggtaagcatgtttgcatgaaaattaaatttggcaaactgtagaagtcttttatccattcaagagaatgtactctcatgggcctagactttcaacagcatgtaaaaagatctgtagctagatgttttaattatcagatttagtttattttcacattaggttctggaagcctgcagattttattaaagactagcaataggctttaagatttgtcattgaaataatgttataaaatgtgactaagaaacgtaacataattatataaactttattcagcaaaataaagggtttttattcgtgttgttatg

SEQ ID NO: 462805 - DNA, 3998 bp, Homo sapiens
gaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacagataaggtaactggctcacagattaatttgcacaagattaaacatctggcaagtgatgtgttctgcatgtctgactctgaagcctttgcttattactctataccgttctgcagagtaaccgttttatctgcagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatggaggacaacaagccagggcacaaaagcttgaaaactggtagcagattggagaaggaaatggtagattctaaggctagactaacaaagcagctaataagaaagaaagaaagaaactttacctcttttaaggagtttagacttcgttatgtagaaaatgagagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaaatgaacatttgaaagacataatggaacaagaacaaaaactgaaagaacatcacacagttgaagctccaggaggtcaaaaggctcgttatcggaaagagcaaacattgcttaagcaactgccttgcattccattggtagaaaatttgttgaaggatgggacagatggctgtgcattagctgcccttattcatttttactgtcctgatgttgtcagattagaggatatttgtttgaaagaaactatgtctttggctgatagcctgtataatctgcagctgattcaagaattttgccaagaatacttgaaccagtgttgccatttcactctggaagatatgctctatgctgcttcatccataaagagtaattatttggtgttcatggcggaactgttctggtggtttgaagtggtgaagccgtcttttgtacagcctcgtgttgttcgtccacaaggagctgaacctgtaaaagatatgccttcaattcctgtcttgaatgctgccaaaagaaatgtcttagatagtagttctgacttcccttcaagtggggaaggagctacatttacacagtctcatcatcatttgccttctaggtattcacgtccccaggctcattcttcagcctcaggaggaattagaaggtcttcatctatgtcttatgttgatggcttcatagggacatggcccaaagagaaaagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactaaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagt

SEQ ID NO: 462806 - DNA, 1779 bp, Homo sapiens
gaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacagataaggtaactggctcacagattaatttgcacaagattaaacatctggcaagtgatgtgttctgcatgtctgactctgaagcctttgcttattactctataccgttctgcagagtaaccgttttatctgcagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatggaggacaacaagccagggcacaaaagcttgaaaactggtagcagattggagaaggaaatggtagattctaaggctagactaacaaagcagctaataagaaagaaagaaagaaactttacctcttttaaggagtttagacttcgttatgtagaaaatgagagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaaatgaacatttgaaagacataatggaacaagaacaaaaactgaaagaacatcacacagttgaagctccaggaggtcaaaaggctcgttatcggaaagagcaaacattgcttaagcaactgccttgcattccattggtagaaaatttgttgaaggatgggacagatggctgtgcattagctgcccttattcatttttactgtcctgatgttgtcagattagaggatatttgtttgaaagaaactatgtctttggctgatagcctgtataatctgcagctgattcaagaattttgccaagaatacttgaaccagtgttgccatttcactctggaagatatgctctatgctgcttcatccataaagagtaattatttggtgttcatggcggaactgttctggtggtttgaagtggtgaagccgtcttttgtacagcctcgtgttgttcgtccacaaggagctgaacctgtaaaagatatgccttcaattcctgtcttgaatgctgccaaaagaaatgtcttagatagtagttctgacttcccttcaagtggggaaggagctacatttacacagtctcatcatcatttgccttctaggtattcacgtccccaggctcattcttcagcctcaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagt

SEQ ID NO: 462807 - DNA, 417 bp, Homo sapiens
ggaaaaggaaactcagctccggaaacaacagttggaagcagaaatggagcataagaaggaggaaacaaggtaaaggaaattgctggcccagtgctagatctgaactttaatgatgcatgggcatatttagaaaaagttggtaagtactcaaagaggtggtctctcattaatttttattaacagatttctttcagagaagtttgtagtatagatagacagctggatcaatgctattttttggtgctttgtagaaatcaatttattttcccaaagtattgcctaattttatatttttatcttaagtttaaggcatctcatgggaaagttctctagaaacattaatttaaataattatatgtttaaaaaacattaaaataactttcctgggagatacacacacacacacacacacacaca

SEQ ID NO: 462808 - DNA, 519 bp, Homo sapiens
ggtttaaacaatatgtttccatatttttaaaatttaggttgtagaatgagaggtggtagtgttgtttctaacttaagacattctacctaaatttatattaaacagctaaaatataacattttaaatttattttccattgcagtggggaaggagctacatttacacagtctcatcatcatttgccttctaggtattcacgtccccaggctcattcttcagcctcaggtaatatatttgaaaaagcctaggaaaatactcttttaagtaggttacctgggaaatgattgacagtaaatataaataaacaaatatccagggtttttttgtgtgtgtgtgtgtgtgtttttttgtttgtttgtttgttttctgaaaaatggctattataacacactaaaagcatggtcagtttcactgtggttgcttttcttgataaaattatctctaattctccttatgtacctatttaatttgtattgctattaatgaatcctcaaatacatgaaatctcctaagttgcta

SEQ ID NO: 462809 - DNA, 761 bp, Homo sapiens
tgagacggagtctttctccattgcccaggctagagtgcagtgacacgatctcggctcactgcaacccctgcctcctggcttcaagtgattcttctgcctcagcctcctgagtagctgggattacaggcgcgtaccaccatgcccagctaatttttgtatttttggtagagacgggctttcaccatattggccaggctgatctcgaacttctgaccttgtgatctacctgcctcggcctcccaaagtgctgggattacaggcatgagccaccgcgcccggccttatcatattatttttaggcctttaggttgattttgattgttactttcacgtataccctctgggccccattttttctctgtttgagacataaaacatattttattttctaattagatcagagtctgtagaaggcttcttatctccaagtcgttgtggcagtcgaaatggagaaaaagactgggagaatgcatcaacaacttcttcagtggcttctggaacagaatatacaggttagtgtctatacatttttagagaaacatttgaatttaacacactcataaatggagggtgtactaaagaaaattttattggctcacctttgggtcttaaacataggcaactaataaacagtgaatgcaggtggtcactttcaggtagttcagtaagtttctaaacaaaattagtgatgctacttatatctcatccctctaaccaatgctggccatttctgtgtgtagtttgggtccgaagaagtttta

SEQ ID NO: 462810 - DNA, 7394 bp, Homo sapiens
gaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacagataaggtaactggctcacagattaatttgcacaagattaaacatctggcaagtgatgtgttctgcatgtctgactctgaagcctttgcttattactctataccgttctgcagagtaaccgttttatctgcagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatggaggacaacaagccagggcacaaaagcttgaaaactggtagcagattggagaaggaaatggtagattctaaggctagactaacaaagcagctaataagaaagaaagaaagaaactttacctcttttaaggagtttagacttcgttatgtagaaaatgagagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaaatgaacatttgaaagacataatggaacaagaacaaaaactgaaagaacatcacacagttgaagctccaggaggtcaaaaggctcgttatcggaaagagcaaacattgcttaagcaactgccttgcattccattggtagaaaatttgttgaaggatgggacagatggctgtgcattagctgcccttattcatttttactgtcctgatgttgtcagattagaggatatttgtttgaaagaaactatgtctttggctgatagcctgtataatctgcagctgattcaagaattttgccaagaatacttgaaccagtgttgccatttcactctggaagatatgctctatgctgcttcatccataaagagtaattatttggtgttcatggcggaactgttctggtggtttgaagtggtgaagccgtcttttgtacagcctcgtgttgttcgtccacaaggagctgaacctgtaaaagatatgccttcaattcctgtcttgaatgctgccaaaagaaatgtcttagatagtagttctgacttcccttcaagtggggaaggagctacatttacacagtctcatcatcatttgccttctaggtattcacgtccccaggctcattcttcagcctcaggaggaattagaaggtcttcatctatgtcttatgttgatggcttcatagggacatggcccaaagagaaaagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactagaagaaaagaggcgtgctatagaagcccagaaaaagaaaatggaagctgcttttaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccagtctctagcctttctttggcatcgctgaacacgggtgataacgagagtgtacattcaggcaagaggacgccaagatcagagtctgtagaaggcttcttatctccaagtcgttgtggcagtcgaaatggagaaaaagactgggagaatgcatcaacaacttcttcagtggcttctggaacagaatatacaggaccaaagctctacaaagaacccagtgcaaaatccaataagcacataatacaaaatgctttagctcattgctgtttggctggaaaagtaaatgaaggtcagaagaaaaaaatactggaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaaatga

SEQ ID NO: 462811 - DNA, 6067 bp, Homo sapiens
ttcggtacccgagctttctccttcagcctcgtgttgttcgtccacaaggagctgaacctgtaaaagatatgccttcaattcctgtcttgaatgctgccaaaagaaatgtcttagatagtagttctgacttcccttcaaggtattcacgtccccaggctcattcttcagcctcaggaggaattagaaggtcttcatctatgtcttatgttgatggcttcatagggacatggcccaaagagaaaagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactagaagaaaagaggcgtgctatagaagcccagaaaaagaaaatggaagctgcttttaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccagtctctagcctttctttggcatcgctgaacacgggtgataacgagagtgtacattcaggcaagaggacgccaagatcagagtctgtagaaggcttcttatctccaagtcgttgtggcagtcgaaatggagaaaaagactgggagaatgcatcaacaacttcttcagtggcttctggaacagaatatacaggaccaaagctctacaaagaacccagtgcaaaatccaataagcacataatacaaaatgctttagctcattgctgtttggctggaaaagtaaatgaaggtcagaagaaaaaaatactggaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaaatga

SEQ ID NO: 462812 - DNA, 6401 bp, Homo sapiens
gaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacagataaggtaactggctcacagattaatttgcacaagattaaacatctggcaagtgatgtgttctgcatgtctgactctgaagcctttgcttattactctataccgttctgcagagtaaccgttttatctgcagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatggaggacaacaagccagggcacaaaagcttgaaaactggtagcagattggagaaggaaatggtagattctaaggctagactaacaaagcagctaataagaaagaaagaaagaaactttacctcttttaaggagtttagacttcgttatgtagaaaatgagagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaaatgaacatttgaaagacataatggaacaagaacaaaaactgaaagaacatcacacagttgaagctccaggaggtcaaaaggctcgttatcggaaagagcaaacattgcttaagcaactgccttgcattccattggtagaaaatttgttgaaggatgggacagatggctgtgcattagctgcccttattcatttttactgtcctgatgttgtcagattagaggatatttgtttgaaagaaactatgtctttggctgatagcctgtataatctgcagctgattcaagaattttgccaagaatacttgaaccagtgttgccatttcactctggaagatatgctctatgctgcttcatccataaagagtaattatttggtgttcatggcggaactgttctggtggtttgaagtggtgaagccgtcttttgtacagcctcgtgttgttcgtccacaaggagctgaacctgtaaaagatatgccttcaattcctgtcttgaatgctgccaaaagaaatgtcttagatagtagttctgacttcccttcaagtggggaaggagctacatttacacagtctcatcatcatttgccttctaggtattcacgtccccaggctcattcttcagcctcaggaggaattagaaggtcttcatctatgtcttatgttgatggcttcatagggacatggcccaaagagaaaagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactaaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccagtctctagcctttctttggcatcgctgaacacgggtgataacgagagtgtacattcaggcaagaggacgccaagatcagagtctgtagaaggcttcttatctccaagtcgttgtggcagtcgaaatggagaaaaagactgggagaatgcatcaacaacttcttcagtggcttctggaacagaatatacaggaccaaagctctacaaagaacccagtgcaaaatccaataagcacataatacaaaatgctttagctcattgctgtttggctggaaaagtaaatgaaggtcagaagaaaaaaatactggaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacatttt

SEQ ID NO: 462813 - DNA, 3924 bp, Homo sapiens
gaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacagataaggtaactggctcacagattaatttgcacaagattaaacatctggcaagtgatgtgttctgcatgtctgactctgaagcctttgcttattactctataccgttctgcagagtaaccgttttatctgcagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatggaggacaacaagccagggcacaaaagcttgaaaactggtagcagattggagaaggaaatggtagattctaaggctagactaacaaagcagctaataagaaagaaagaaagaaactttacctcttttaaggagtttagacttcgttatgtagaaaatgagagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaaatgaacatttgaaagacataatggaacaagaacaaaaactgaaagaacatcacacagttgaagctccaggaggtcaaaaggctcgttatcggaaagagcaaacattgcttaagcaactgccttgcattccattggtagaaaatttgttgaaggatgggacagatggctgtgcattagctgcccttattcatttttactgtcctgatgttgtcagattagaggatatttgtttgaaagaaactatgtctttggctgatagcctgtataatctgcagctgattcaagaattttgccaagaatacttgaaccagtgttgccatttcactctggaagatatgctctatgctgcttcatccataaagagtaattatttggtgttcatggcggaactgttctggtggtttgaagtggtgaagccgtcttttgtacagcctcgtgttgttcgtccacaaggagctgaacctgtaaaagatatgccttcaattcctgtcttgaatgctgccaaaagaaatgtcttagatagtagttctgacttcccttcaagtggggaaggagctacatttacacagtctcatcatcatttgccttctaggtattcacgtccccaggctcattcttcagcctcaggaggaattagaaggtcttcatctatgtcttatgttgatggcttcatagggacatggcccaaagagaaaagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactaaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggtgtagtattaatctgcatagttttgggcatcttcattagatgagtgtggttgtgttggatatttttttttcagttgacatgcttgcttctttcagtagcagtcccttttgatacaagttcatccccattaactatagtaacattcaagcacactgtggtttccagtatggactcaaagctgtaataaatccttttatcacatg

SEQ ID NO: 462814 - DNA, 2985 bp, Homo sapiens
gtgacactgagaagatatgaaaaatagcaaaatatttcaatgtgataaatatatgaaaatctttcataaattttcaaatttaaatggacataaggtaagacacaccagaaaaaaaccttttaaatataaagaatttggcaaatcattttgcatattttcaaacctaactcaacataaaataatttgtactagagtaaatttctacaaatgtgaagactgtggaaaagcctttaatggatcctcaatctttactaaacataaaagaattcatattggagagaaatcgtacatatgtgaagaatgtggcaaagcctgtaaccagttcacaaaccttactacacataagataatttatactagagacaaactctacaaacgtgaagaatgtagcaaagcctttaacctgtcgtcacacattacaacacatacaataattcatactggagagaatccctacaaacgtgaagaatgtgacaaagcctttaatcagtccttaacccttactacacataagataattcataccagagagaaactcaatgaatataaggaatgtggcaaagctttcaaccagtcctcacaccttaccagacataagataattcatactggagagaaaccctacaaatgtgaagaatgtggcaaagcctttaaccagtcctcacaccttaccagacataagataattcatactggagagaagccctacagatgtgaagaatgtggcaaagcctttaggcagtcctcacaccttactacacataagataattcatactggagagaaaccctacaaatgtgaagaatgtggcaaagcttttaacaagtcctcacaccttactagacataagagcattcatactggagaaaaaccctaccagtgtgaaaaatgtggcaaagcttctaaccaatcctcaaaccttactgaacataagaatattcatactgaagagaaaccatacaaatgtgaagaatgtgggaaagcctttaaccagttctcaaaccttactacacataaaagaattcatactggagagaaaccctacaaatgtgaagaatgtggcaaagcttttaaccagtcctcaatccttactacacataagagaattcatactggagagaaatcctacaaatgtgaagaatgtggcaaagctttctatcgatcctcaaaacttactgaacataagaaaattcatactggagagaaaccctacacatgtgaagaatgtggcaaagcctttaaccattcctcacatcttgctacacataaggtaattcatactggagagaaaccctaccaatgtgaagaatgtggtaaagcctttaaccagtcctcacaccttactagacataagagaattcatactggagagaaaccctaccaatgtgaaaaatgtggcaaagcttttaaccagtcctcaaaccttactggacataagaaaattcatactggtgagaaactctacaaacctaaaagatgtaacagtgattttgaaaacacttcaaagttttctaaacataaaagaaattatgctggtgagaaatcttagaaatgtgaagaatgtaacaaaacctttaaaagttgtcacacttgattgtgcataagataattcatactaaaaaaaaacctacaagtgtgaagaatgtggcaaaacttttaaccaatgctcacaccttattgcacaggaaagcatttgtactagaaaaaaatttcaaatatacagaatgtgaaaaagccattaatatctgttcacatcttactcaacatcagagatttcatacttaataaaagcattatacatgcaattactgtcaaaaatctttcagaaaatataagcctctaaagtgaagagtattcattttgaagacacacattatgaacataaggagggttgtggtacctttacttgtatcacagatctcattgtacacattttgtgctagaggaaaaccatggagcagttgcttaaactttgtgcaacataaggaaatttatattggagaaaaaccctgcaaatgtaataaatttgggaaaacattttttcaaaaacgacagcttagaaaacactagagggttcatactaaaatctatttttgcagatgcagtaaatatgaaaaaatatttaatccaaaattctatgtaaatatcagataattcacagtagaaatagttaaggcactgacacttcaggcattacactaaatcagattgctgagtatagaaaagaatctaaaactaaagttggtaaatgaattatttgtatataacattataagaagtagaaaatttttgcagagttgtaactacattcaaactatcctttgaaaaaaattaggttttatgaaaagtgaataatgtcatttaactcaagttatgctcttcattcctattgtattcacatgtgaaagcatgtgacttaattgttgctgcatcaaagatgagagattctttgttattaggtgtgcattatttacgaccttttttagtgaaagagttaaggacattaaaatgtaagatgcaagatgaaaattttttataatgaaaataagtaaatattgattgagcccatttatttagcctgggcgacagagggagactccatctcaaaaaaaaaaaaaaaaaaaaactagcaagctgagttcataagcaaatcaaaaagttattttgccactatcatgtgagctttattttatgaatgcaaaaatgttcatatacaagtcaataagtgctgagtgcagtggctcacgcctgtaatcccaacgctttgggaggccgaggcgggtggatcatgaggtcaagagatcgagaccatcctggccaacatggtgaaacgccttctctacaaaaaataccaaaattagctgggcgtggtggtggatgcctgcagtctcagctacttgggaggctgaggcaggagactcgcttgaacctgggaggttgaagttgcagtgagccactgcactccagcctggtgactgcgagacc

SEQ ID NO: 462815 - DNA, 379 bp, Homo sapiens
catttactccatggccggtacacttaccgggagtatttagaggcacatctaaaatttctagcgtttttcttgcaagaagctactctgtatctgggctggaatcgtgccaaggagatctgggagtgtcttgtaactggccaggatgtttgtgaattagatagagagatgtgttttgaatggtttacaaaaggacagcatgatcttgagagtgatgttcagcagcagctcttcaaggagaaaattcttaaattggagtcatatgaaatcactatgaatggttttaacttatttaaaactttttttgaaaatgtgaatctttgtgatcatcgattgaaaagacaaggagctcagttggtaagtacgttattctcaaatctag

SEQ ID NO: 462816 - DNA, 3315 bp, Homo sapiens
tggctttgatcagagacctcaaacgtgacttgctcctccttgccttctgccatgattgtaaggcttccccagccacgtggaactattctgtggggatgggattcagacagcagtttatctctgctccatgatactgagaacctcagctggaagactaagtctggggatgacttgatgactgtaggctggactcatgtgaaggctcctcctctggccttcaggggctggttgtccaatgagaccttaaagaatgatgagaatggaaactgctcaggggaaggaattgaattccctacaacaaatttatatgaactggaaagccgtgttttgactgatcattggtccatcccttacaagcgagaagaatcactaggcaaatgcctgttggcatctacctacctagcaagacttggatgtagccctttagttccagctttgcgttgcatttccttcttgagtcaccctgtcccacctggggttgatgtccttttctcctgcaaatggacacttacggtcaccagggctctgcagctgcctgtgggtgaatctggcttcagagccttcctgcctgtctcacaggattcctgctttctcttctttggagaattaggtggatttgcagcaatccaagccaagctccattcagaagatatagaacttgggagattggttagcatccctgagctcttgtctgccgttaagttactttgcatgcgcttccaaccggatctggtgacaattgtggatgaccttcgactagatattctattgcgcatgctgaaatcaccacatttcagtgctaagatgaattctctcaaagaagtaaccaaactaatagaagatagcactttatccaaatctgtgaagaatgctatagatacagacagattattagattggctagttgaaaactcagttctgtcgattgcactggaaggcaacatagaccaagcacaatactgtgaccgtataaagggaattattgaactcttgggtagtaaattgtcgttagatgaactcactaaaatttggaagatacagtcaggacaatcatctactgtgattgagaacattcatactattattgctgcagcggctgtgaaatttaattcagatcagcttaatcatttgtttgttctcattcagaagcaggccttggaggagcacctgacaatccttagtgatgcatatgcagtgaaagaagcaatcaagaggagctacatcatcaagtgcatagaagatattaagaggcttaataatccccagtttgtatgggtggtaccagctttgcgtcagctccatgaaattactcgctcattcataaaacaaacctatcaaaagcaagacaagagcattattcaagacttgaagaagaattttgaaatagtgaaattggtaacgggaagtttgatcgcttgtcatcggcttgcagctgctgtggccgggcctggaggcttaagtggctcgacactagtggatggccggtacacttaccgggagtatttagaggcacatctaaaatttctagcgtttttcttgcaagaagctactctgtatctgggctggaatcgtgccaaggagatctgggagtgtcttgtaactggccaggatgtttgtgaattagatagagagatgtgttttgaatggtttacaaaaggacagcatgatcttgagagtgatgttcagcagcagctcttcaaggagaaaattcttaaattggagtcatatgaaatcactatgaatgacaaggagctcagttgtatgtagaaaagctggaattgataggaatggatttcatttggaaaatagccatggaatcacctgatgaagaaattgctaatgaagctattcagctaatcataaactatagttacattaatctaaatcctagattaaagaaggattcagtatctttacataagaaattcattgctgattgctacacaagattagaagtgagtagcaaattttatttaacatctctttgaggtattttatataagcactgcttctttttttgtttttcttcatgtttcacctagttataccataaatgttattaaaggccacagcaagacagttagtagtaggtggtattggttgtctttgtccattagaagcctgctgtgtaatgctagctcacatgtatctcttttatttccagcatgacggttaaagccttaaacattcatattcagttgatatgcttaagttttacatctaagcaaaaatgttccaaaagcataaaatgctactgcctcccaattccaataagttaagctttctggtgataaatatgtgctagaatatgtacggtatttccctaattgtgacttctatccaaatatgtcattataaaaaaaattcaagtattcgaataccccttatgaggtcccattgctttttattcggaatcatttcatatttggtggactacagagaaaaccacataataattttaaaatattataaactctaaatagggttaataagaatatatagcttcaaagtcgaatttgaaccagaacattgtagtttatctcatttcactagtttggaaagaacttttcagtatccataattgttccaacttggggtggggggggtttctgtcatctgtacagtatttcataatactgtctgtgatttaattcattattgaggcataattaaaaaatagttcactcacttattatggacttagatattttctaaaaatttttcgtctgaatttcaagttctagttcttgcccatagactggaataatttagaactctgttaagtatatttaatagaactgctaaaatgtgtttaaccagctgtttttagagtgaaatttttggtactgctaatcagcataccagaccaattgttaaaaaatggtagtacctcttttcagttttagaaatatacctctttgaaatatctagactctctggaatagaaaatgtttaaattaaggggacttggattttcatttcttaatgttaatacatgtaatgttctttttagtaaagtatggggctatgactatataagctgatgaatattgcagtctgattatttcaaatgataagtaagattccataagtcttcaaccaaaagagacctcagatctcatttttagatagcaacttttgtttgtgtcgtacttactgatttgcatttgtcttctaattctcaggcagttcagaactttgtcagatttcatgtgttcacagaattgtatatcatattttagttataagataaagtcagactcactcatttcattcttgataaattaatggacagataggcctagaaacccaggt

SEQ ID NO: 462817 - DNA, 2961 bp, Homo sapiens
gggctgacccctcctctacattctgttcccttttcgtgaccttctgggtgcatgagcaatgcagtttgttacgtttgccgggtggctgccgagcaaagagataaaggtaaaaaaaagcttaaatgggtacaaaggaaagtttgcatggataacggcatggcagaggaaaataatggatggcatcttcagaatgctgtaattggactcaatgaatcatttccaattagtattcaaaatcaccggaatatcacactcaagagagcatttactaaatgtccttgggaatgtccagtaggtcacataactgagattgcagaattgtacttgaccgctggccttctcccatgcaggttcccatcaggaagccaattgcttgctgtccaagccaaaaattttaagatgatttgtcagaaagggcacaaagtcctatcacctaatattacaagagttggtaagcgctcatcattaattttattttgtggcagctaagttagtatgacagaggcagtgctcctgtggacaggagcattttgcatattttccatctgaaagtatcactcagttgatagtctggaatgcatgttatatattttaaaacttccaaaatatattataacaaacattctatatcggtatgtagcagaccaatctctaaaatagctaattcttcaataaaatctttctatatagccatttcagtgcaaacaagtaaaatcaaaaaagaccatcctttatttttccttacatgatatatgtaagatgcgatcaaataaagacaaaacaccagtgatgagaatatcttaagataagtaattatcaaattattgtgaatgttaaattatttctactataaagaagcaaaactacatttttgaaggaaaatgctgttactctaacattaatttacaggaatagtttgatggtttcactctttactaaagaaaggccatcaccttgaaagccattttacaggtttgatgaagttaccaatttcagtacacctaaatttctacaaatagtccccttttacaagttgtaacaacaaagaccctataataaaattagatacaagaaattttgcagtggttatacatatttgagatatctagtatgttgccctagcagggatggcttaaaaactgtgattttttttcttcaagtaaaacttagtcccaaagtacatcataaatcaattttaattagaaaaatgaatcttaaatgaggggacataagtatactctttccacaaaatggcaataataaggcataaagctagtaaatctactaactgtaataaatgtatgacattattttgattgatacattaaaaaagagtttttagaacaaatatggcatttaactttattatttatttgcttttaagaaatattctttgtggaattgttgaataaactataaaatattattttgtattgcagctttaaagtggcacactccataataatctacttactagaaatagtggtgctaccacaaaaaatgttaaccatcagtaccattgtttgggagaaagaaacagatcaagaatgcatattattcagtgaccgctttcctagagttaaaatacctcctctttgtaaggtttgtaggtaaattgaggtattcactatgtttttctgtatcacagcagcattcctagtccttaggccctcggacagagtgaaatcatgagtatttatgagttcaatattgtcaaataaggctacagtatttgcttttttgtgtgaatgtattgcatataatgttcaagtagatgattttacatttatggacatataaaatgtctgattaccccattttatcagtcctgactgtacaagattgttgcaatttcagaatagcagttttataaattgatttatcttttaatctataacaatttgtgttagctgttcatttcaggattatattttctacaagttccacttgtgggactccttttgttgcccctatttttttttaaagaaggaagaaagaaaaataagtagcagtttaaaaatgagaatggagagaaaagaaaaagaatgaaaaggaaaggcagtaaagagggaaaaaaaaggaaggatggaaggaatgaaggaaggaagggaggaaggggagaaggtaggaagaaagaaaggatgagagggaaggaagaatcagagtattagggtagttaacttacacatttgcattcttagtttaactgcaagtggtgtaactatgtttttcaatgatcgcatttgaaacataagtcctattataccattaagttcctattatgcagcaattatataataaaaagtactgcccaagttatagtaatgtgggtgtttttgagacactaaaagatttgagagggagaatttcaaacttaaagccacttttggggggtttataacttaactgaaaaattaatgcttcatcataacatttaagctatatctagaaagtagactggagaactgagaaaattacccaggtaattcagggaaaaaaaaaaatatatatatatataaatacccctacatttgaagtcagaaaactctgaaaaactgaattatcaaagtcaatcatctataatgatcaaatttactgaacaattgttaatttatccattgtgcttagctttgtgacacagccaaaagttacctatttaatcttttcaataaaaattgttttttgaaatccagaaatgatttaaaaagaggtcaggtttttaactatttattgaagtatgtggatgtacagtatttcaatagatatgaatatgaataaatggtatgccttaagattctttgaatatgtatttactttaaagactggaaaaagctcttcctgtcttttagtaaaacatccatatttcataacctgatgtaaaatatgttgtactgtttccaataggtgaatataaactcagtttatcaattaaaatatgtatttgactcattttaaaactct

SEQ ID NO: 462818 - DNA, 1068 bp, Homo sapiens
gcagactactactactaaaaatgtggccgcgtcgacattttctacaagttccacttgtgggactccttttgttgcccctatttttttttaaagaaggaagaaagaaaaataagtagcagtttaaaaatgagaatggagagaaaagaaaaagaatgaaaaggaaaggcagtaaagagggaaaaaaaaggaaggatggaaggaatgaaggaaggaagggaggaaggggagaaggtaggaagaaagaaaggatgagagggaaggaagaatcagagtattagggtagttaacttacacatttgcattcttagtttaactgcaagtggtgtaactatgtttttcaatgatcgcatttgaaacataagtcctattataccattaagttcctattatgcagcaattatataataaaaagtactgcccaagttatagtaatgtgggtgtttttgagacactaaaagatttgagagggagaatttcaaacttaaagccacttttggggggtttataacttaactgaaaaattaatgcttcatcataacatttaagctatatctagaaagtagactggagaactgagaaaattacccaggtaattcagggaaaaaaaaaaatatatatatatataaatacccctacatttgaagtcagaaaactctgaaaaactgaattatcaaagtcaatcatctataatgatcaaatttactgaacaattgttaatttatccattgtgcttagctttgtgacacagccaaaagttacctatttaatcttttcaataaaaattgttttttgaaatccagaaatgatttaaaaagaggtcaggtttttaactatttattgaagtatgtggatgtacagtatttcaatagatatgaatatgaataaatggtatgccttaagattctttgaatatgtatttactttaaagactggaaaaagctcttcctgtcttttagtaaaacatccatatttcataacctgatgtaaaatatgttgtactgtttccaataggtgaatataaactcagtttatcaattaaaatatgtatttgactcattttaaaactct

SEQ ID NO: 462819 - DNA, 3138 bp, Homo sapiens
gggctgacccctcctctacattctgttcccttttcgtgaccttctgggtgcatgagcaatgcagtttgttacgtttgccgggtggctgccgagcaaagagataaaggtaaaaaaaagcttaaatgggtacaaaggaaagtttgcatggataacggcatggcagaggaaaataatggatggcatcttcagaatgctgtaattggactcaatgaatcatttccaattagtattcaaaatcaccggaatatcacactcaagagagcatttactaaatgtccttgggaatgtccagtaggtcacataactgagattgcagaattgtacttgaccgctggccttctcccatgcaggttcccatcaggaagccaattgcttgctgtccaagccaaaaattttaagatgatttgtcagaaagggcacaaagtcctatcacctaatattacaagagttggtaagcgctcatcattaattttattttgtggcagctaagttagtatgacagaggcagtgctcctgtggacaggagcattttgcatattttccatctgaaagtatcactcagttgatagtctggaatgcatgttatatattttaaaacttccaaaatatattataacaaacattctatatcggtatgtagcagaccaatctctaaaatagctaattcttcaataaaatctttctatatagccatttcagtgcaaacaagtaaaatcaaaaaagaccatcctttatttttccttacatgatatatgtaagatgcgatcaaataaagacaaaacaccagtgatgagaatatcttaagataagtaattatcaaattattgtgaatgttaaattatttctactataaagaagcaaaactacatttttgaaggaaaatgctgttactctaacattaatttacaggaatagtttgatggtttcactctttactaaagaaaggccatcaccttgaaagccattttacaggtttgatgaagttaccaatttcagtacacctaaatttctacaaatagtccccttttacaagttgtaacaacaaagaccctataataaaattagatacaagaaattttgcagtggttatacatatttgagatatctagtatgttgccctagcagggatggcttaaaaactgtgattttttttcttcaagtaaaacttagtcccaaagtacatcataaatcaattttaattagaaaaatgaatcttaaatgaggggacataagtatactctttccacaaaatggcaataataaggcataaagctagtaaatctactaactgtaataaatgtatgacattattttgattgatacattaaaaaagagtttttagaacaaatatggcatttaactttattatttatttgcttttaagaaatattctttgtggaattgttgaataaactataaaatattattttgtattgcagctttaaagtggcacactccataataatctacttactagaaatagtggtgctaccacaaaaaatgttaaccatcagtaccattgtttgggagaaagaaacagatcaagaatgcatattattcagtgaccgctttcctagagttaaaatacctcctctttgtaaggtttgtaggtaaattgaggtataaactatggatgaaccaaataattagttcaaagtgttgtcatgattccaaatttgtggagtctggtgtttttaccatagaatgtgacagaagtacagtcatagctcagtagctatatgtatttgcctttatgttagaagagactttcttgagtgacatttttaaatagaggaggtattcactatgtttttctgtatcacagcagcattcctagtccttaggccctcggacagagtgaaatcatgagtatttatgagttcaatattgtcaaataaggctacagtatttgcttttttgtgtgaatgtattgcatataatgttcaagtagatgattttacatttatggacatataaaatgtctgattaccccattttatcagtcctgactgtacaagattgttgcaatttcagaatagcagttttataaattgatttatcttttaatctataacaatttgtgttagctgttcatttcaggattatattttctacaagttccacttgtgggactccttttgttgcccctatttttttttaaagaaggaagaaagaaaaataagtagcagtttaaaaatgagaatggagagaaaagaaaaagaatgaaaaggaaaggcagtaaagagggaaaaaaaaggaaggatggaaggaatgaaggaaggaagggaggaaggggagaaggtaggaagaaagaaaggatgagagggaaggaagaatcagagtattagggtagttaacttacacatttgcattcttagtttaactgcaagtggtgtaactatgtttttcaatgatcgcatttgaaacataagtcctattataccattaagttcctattatgcagcaattatataataaaaagtactgcccaagttatagtaatgtgggtgtttttgagacactaaaagatttgagagggagaatttcaaacttaaagccacttttggggggtttataacttaactgaaaaattaatgcttcatcataacatttaagctatatctagaaagtagactggagaactgagaaaattacccaggtaattcagggaaaaaaaaaaatatatatatatataaatacccctacatttgaagtcagaaaactctgaaaaactgaattatcaaagtcaatcatctataatgatcaaatttactgaacaattgttaatttatccattgtgcttagctttgtgacacagccaaaagttacctatttaatcttttcaataaaaattgttttttgaaatccagaaatgatttaaaaagaggtcaggtttttaactatttattgaagtatgtggatgtacagtatttcaatagatatgaatatgaataaatggtatgccttaagattctttgaatatgtatttactttaaagactggaaaaagctcttcctgtcttttagtaaaacatccatatttcataacctgatgtaaaatatgttgtactgtttccaataggtgaatataaactcagtttatcaattaaaatatgtatttgactcattttaaaactct

SEQ ID NO: 462820 - DNA, 503 bp, Homo sapiens
agcggccgcggctgggaggatggtgacacctgcagtgagtgcagctgcagagagtcaggtgccagcggctcctcttttgaggagctggacctggagggtgaggggcccttggaggaaccacggctggaccctgagactgagcccctgggggctaccaagtggccctgagagcccagtaccctgagaagggcaaggagtaacccatgaccagccccctcctgcggggcagggctgcggaaccgagcagactctccagccatcttcctccttcttctgggggcgaggggttcccaggggacgtaactccccctgctctaggcctcttgtgaagccttctcctcactgtcctttaggctcccagggccaaagcagccaaagactgtatcctgcaccagccctgtgggccgacactcctgttgtatctctttttcagactgtcactggagcttccaggacccagaataaagccaatgacttacttgtttcacctggatttgggctgc

SEQ ID NO: 462821 - DNA, 159 bp, Homo sapiens
gacttcaggtggattggctgttgtggggagaggcagtgagggagtcacagcgggctccacttctctctggcctgggcaggaactgacatgatgagtgacacgagttctggaagcttggaggtgagccctggtagccgggagacttcatttgctaccgtg

SEQ ID NO: 462822 - DNA, 1936 bp, Homo sapiens
ctcattgatgtaagagtttgagaggggctgctgcacttcctacactaacagacatgtgatgatgtgtgactctaaaccacacagtacccagttcctgcctacttagtgtctgtttttctacctctgcctctgctgaactcccagccctggcacccccagcaaggccctccgaggtggagcagcagctacaagaggaggctgagcacctgagggaggagctggagagtctggcaggacagctccaagcccaggagcacctggaagctgccagccagagaaccagcagctacaggcccagctgagcctcatggctctccctgaggaaggtacgggagatcactcagaggaagaggagggagcccaggaggaaggggggactgttagcagataggagtgaggagtttagaacagctggtcactatgccgaccgggtttctgcgttaagttcggcatcaaaacggtgacctgggagtagaggggccaccaggttgcctaaggatgggtgaactggcccaagtcagaaatgaagcaggtcagaactcccctgccgggcagtagtggaactgagcttgggcaacatagtgcgactttgactggacggagggtgggggagaaggaggggcgggggggggaggaggaggaggatgaggatgaggaggagaaggagaaggagaagaagaagaagaagaaggaggagaaggagaaggaggaggaggcgtctcggcccatgaagagcatcctgcaggacctggaaagccaggagtccatggtggcatttttaacatcagctgtagccagtgcagatggggagcaggctcggctccgtgggcagctgaaggagcaaaggctgcgctgccggtgcctggctcacctgctggcctgggcccagaagcagccagaggcagcagccccagccccagggactgggatggattctgtgtgtggggggacccaccgggccctgcagggtgccatggagaaactgcagagctgctttatgcagctgatgcaggaaaaggtggacctgaaagagcgggtggaggagctggaacatcgctgcatccagctctctggagagacagacaccatcgggggagctgcccagtgggtgaagggaacccagcgtctgagccctgtcctctcgcaggagtctacactgccctctctcagccagggggcagcgctgaaggagcagcaccgagaggaggaggagcacatccacaggctagcccaggacaaggaggagatgaaggcagggcgcatggcagctgaacaccctctcctccaggtgaagctgctggagttgcaggagctggtgttgcggcttgtgggcgacaggactgagggccatggcagattcctggcagctgcccagagccctgctcatgagccagctccaggggccccagccccccagagctcagggctgccgacaagcaggatctttgccaggtgaccctcaccagcagcgtggagcctgcacaaggagaggccggggagggttctcccctcgacaaccccagtgcacagcagatcatgcagctgtttggtgagatgcagaaccctcaggagcgcccaggcttgggcagcatcccctgcattctgttttcccaccaggctgacaaaaaccaccaggcacccagccacgtggtgacagccaccttcccctacaccaccatgctgtccatctgggtggctgcctgccatatccattctgccttggacacctacatcaaggtgatgcacaggcctggagtttgtgtgttggggacagccaggtcccttgggtggagctgagtaggattgcccagagtgggaggaagaggaactgacatgatgagtgacacgagttctggaagcttggagactgtcactggagcttccaggacccagaataaagccaatgacttacttgtttcacctggatttgggctgc

SEQ ID NO: 462823 - DNA, 2471 bp, Homo sapiens
gcctacttaaaccgtccttcacaccgcggactgcacaggcacaggctgaagcgctgtggtcccgcagggatcccctcgcctgggccgttgtgtgggcggactcgcgagggaggttcacgacgctctgccccgccccgcggcccctgacgtggccatggatgatcccctcgcggccgccgagcgctgcaggcgagaagcgtgggccaaggcgtcagcagaccctgggcggcggctgtggaggaggccagcgtggagtacggctcggcccggtacctgctgctgtgcggcctgggcgggatgctgagctgcggctgacacacacggccatcgtgtccctgcacctggtcaagtgccgcatgcaggtggaccccggctggtacaagggcgtcctcagcggcttcggcgtgacggtgcacagcgacgggctgtgcggcctggctcgcggctgcgctcagaccttcttcggctactccctgcagggcttcttcaagttcggcctttacgaggtcttcaagatccgctccgcggagctcctgggcccagagaaagcctacgggtggagagccggcctgtaccttttcgcctgggccagcgccgagttcttccccgatgtctcgctggagcccatggaggcggtcaagcaccctgcgagccacggcgtccaggatgtagggcgaggagggcctgtgggccttctacaagggcgtggcgccgctgtggctgaggcagatcccctacaccatgatgaagttcgcctgcttcgagcgcacggtagaggacctctacaggtatgccgtgcccaagccccagagccagtgcaccaaggccaagcagctgggcatcaccttcgtggcgtcttctgcgctgtcgtgtcccatcccgccgactccgtggtgtctgtgctgaacaaggagaagggcatcgcggccctgggcgtcctccgaagactggggttcacgggcgtgtggaagggcgtcgttgcgcgcatcggcctctttgcgcacatccccatgatcggcaccctcacggccctgcagtggtttatctatgacctggtcaaggtctatttcaagctgcctcgccctcccgtggctcaagcgcccgaacccctgaagaagaaaaagtaggtgtgaagttctgaaccgctctagccacagtgggtccacatttccgtcaagtggggaatcgcgtgcaaacaatgctagtgtgtaagatgttaacattttgggcagaggttacttaatatgcagtctgagttctctttaaatgactgcttctttttggcaactcaagaggattgcaaacatttcgtttgggggtttgaaccattatctttggggagttggcgtggttgctttaactcaatagcttttcagcaattaaaaggaaaaaatacttaacaggaagtaatgttaggtagtttagggtctctaggtgttatctcctttgattcgccctttctgtagagattatccaagcataactactgaatagcctgcaaatgaggttttaaggtcagcacaactatatggatggggaagaaagtgagattctggtacacggtgttcatctcaatagaaatcgggcacctattgaatagatgaatgactcatcgcatatttcctgttcatgtccattacaggtaaaaaattattaaaagttaaattgtgacttatactgcctgatagcttagaatgtattcactgttttcaaagagacatgagaagatctgcattttctccttttgctttgtcccttctcttcctgatgttgctgattagaacatagctctctccaggaagtgctacaattggatcaatgtggaaagccagaaagagatgaagggcaggctctgggaataaatatgtaaagaaaagcctctgttctccagagatttcttttgtataactcagctttcaacagccatacatccaaagaagaccataccaccctgacataaaaaaaaaaaaaggaagaaaaaacccaaaatcctgcaaattccaactactgtctgttgaatattaaagaatggttttggtgactttggagggaaaatctcactttaagtgtaataaatactcttaacttaatttggtagatgtttcagtgatctttacaatggttgagattcataaaatttattgaaattataaagcatgttttttgttctctgtagccttcacatctctgattggggaaattttacaatcagtgaaattctgtgaattagggatgtttgtaaaatatgaataagaaacaaacttcaataaggcatttgatataacttaccaaagtgtaaaatgattgccttaaaaacttgtattaaattagactacaaacttagaatatgttaatgtttaaactttgtaatagtaaactcttcagtggttaacggaagtttaaaagtgtctaggtttaagtatgtcagaactgtcttgaataataaagagataaaaaagtcgacttttgaa

SEQ ID NO: 462824 - DNA, 5420 bp, Homo sapiens
gctgcagagggctaatgcaacatccagaagagcatgcagctggagcggactggacggcttccgggtttggcggggtctttgtctctcgctgtagccggagctccaggttttgctctcacttctctgtgtcttctgctcctaggggcctagcctgtgtggccctctgacctgcagatattgggagatccacagctaagacgccaggaccccctagaagcctagaaatggtgagagtgcccggtccgacatcccgagagacggcgaaagggctggttggaactggtgggaagtagctgtggcgggactcaggcctctccgcagtcagcttcacaatctgcgccttgcccagctcggcctccgtccccttcggccataagatggcggctgcgctgacagccaggaccccaggcgtcctttctcttccctgcgtagtgactgtgccttggcctggagccctctcttggcagctctgcacccgcagcgccgcgtctctctcagattgtgcagggaccacgggagggtcgtcaggggaaaatcctgactcggggtgcgggttcatgaatgggaagatctttggatgacccgaggtatggaatgtgtcctctcaagggagcaagtggatgccctggggctgagaggagtcttctggtgcagtcttattttgaaaagaaaaagaaaaaatatgtgcagagattttaccgaaaagggtcccaatccaaaccccaagagagggtccttggatttcactcaagaatcaagtatttcttgccaaaaagccacaaaagtgtccacaagtctcctggcatatcccaacccccagacaatgaatctgcagcagcaacctgttttctccaccagcctagggtcctggactacctgttcataatcttctctgcctgcatggacccagaaataaatcagagtacagcgccacctgggccactgtctgtagaacaaacaatccacttacactgcattcttccccacccatggattttctttttctacacgtgtacatgtgcagggttgttatatgggtaaaattgtgtcatgggggtttggtgtagattattttgtcactgagagaggatggctttagagtgctgaataccaatgaagttgatcagcgctgaaagaccttcttacagctgctccacacaagtctttgtcttcacataatctagaaatagcctctaggttctgtgctctttctttgctaagaggagcaaatagaaaattcaggtggtcatctgctaaggagcgatggtcaaggtagtgtttggcataaacactagcaggaacattaatattaaactgaagaagctccgaaaaatgcctttccatttcattcatgtcctcaactgtaatgtccttgaggatctggcagtagtccacattccatacagcctgatcatcccaaaccttggaggcaagaagagtggctcccagaacaatccttttctagttagtggggcaaatgtcgatttcagcataagttaaaagcctttctaagtaaaccagagttactgttgcacattcagctgttagctgtgcagcactaaaaagagtatgaacaaatctgtaaataaatttgtgctcaggatcatgcttaaactattcctgtggaactttttctcgtgtgaggggatgtgatctctcatcaaaaatatccagggatctgtttgcatctctgttctttatgtggtaatatatttctaaggtcacattttactgtggttctaaggttaggctggctgactgttctgtcacctagaaatattgttgagcatgagctatactttttagtaagctgccctggagatagatgatttaagtggttgctcttcctcttgtctcacacatcggtttgagatttgctcaggaaacttgtgcttgcccttggatggtcagaagggtttgactccaaagctaaatcttagggcatctcgtggtcgctgatgtgctgcaggtggtggccctcgcccgctgcgaaatccaactggtaggctccacagaagcgggcgctaccgccaccgcatccccgggtgccgcctcgtagatgtcggttgcgcagtacagctctggcaccacgcaccggcccagcttgaggctggtactggggggacacgcaataggtcagcgtgttccccatggggcgtctctgctcctctgggccggggctggcgccttctctagccccctactcgccgccctcagcagccgcccctcccccaacaatggcgcagcccaggctgcacccgcgcaagcaggtgcctcctcgctggcagttcacccgcccaccccgcgacccgccccgggcagggctccggcctccctgcacgctcgccgcgctgccgctgcctccgcctccccaagctgactcatctggagataattatgtgtttttctctttcgttctctttatgtgatggattacatttattgatttacatatgttgaaccagccttgcatcccaggggccattgacgtttagggatgtggccatagaattctctctggaggagtggcaatgcctggacagtgctcagcagggtttgtataggaaagtgatgttagagaactacagaaacctggtcttcttgggtattgctctcactaagccagacctgatcacctgtctggagcaaggaaaagagccctggaatataaagagacatgagatggtagccaaacccccagttatatgttctcattttccccaagacctttgggcagagcaggacattaaagattcttttcaagaagcgattctgaaaaaatatggaaaatatggacatgacaatttacagttacaaaaaggctgtaaaagtgtggatgagtgtaaagtgcacaaagaacatgataacaaattaaaccagtgtttgataactacccagagcaacatatttcaatgtgatccatctgcaaaagtctttcatacattttcaaattcaaacagacataagataagacatactagaaagaaacctttcaaatgtaaaaaatgtgaaaaatcattttgcatgcttttacacctaactcaacataaaagatttcatattacagagaattcctaccaatgtaaagattgtggcaaagccttcaactggttctcaacccttactacacacaggagaattcatactggagagaaaccctacaaatgtgaagaatgtgggaaagcatttaaccggtcctcacaccttactacacataagataattcatactggagagaaaccatacagatgtgaagaatgtgggaaagcttttaaccggtcttcacaccttactacacataaaagaattcatactggagtgaaaccctacaaatgtacagaatgtggcaaagcttttaaccggtcctcacaccttactacacacaggataattcatactggagagaaaccctacaaatgtgaagaatgtggcaaagcctttaaccagtcctcaacccttactacacataagataactcatgctggagagaaaccttacaaatgtgaagaatgtggcaaagctttttaccgattctcataccttactaaacataagacaagtcatactggagagaaattctacaaatgtgaagaatgcggcaaaggctttaactggtcctcagccctcactaaacataagagaattcatactggagagaaaccctacaaatgtgaagaatgtggcaaagcttttaatgagtcctcaaaccttactacccataagatgattcatactggagagaaaccctacaaatgtgacgaatgtggcaaagcctttaaccggtcctcacaactaactgcacataagatgattcatactggagagaaaccctacaaatgtgaggaatgtggcaaagcttttaaccgatcctcaacccttactaaacataagataactcatactggagagaaatcttacaaatgggaagaatgtggtaaagactttaaccagtccctaagccttattaaacaaaataactcatactggagagaaaccctacaaatgtgaaaaatgtggcaaagccttttaccagtcctcaactcttactaaacataaaaaaattcatactggagggaactcctgtgactgtgaagaatatggcaaagcctttaataaattctcaattcctaacagacataagataattcatactagagagaaattctacaaaccagaaagatgtgacagtgctttgaaaacacctcaaacttttcaaaacataaatcatagtgttgagaaatcctagaaatgtgaagaatgtgataaagttttaaatggttgtcacacttgattgtaggtaaggtaagttatactggagaaaacttctacatgtgtgaacagtgtgacaaaacttttaactaatgctcacaccttcacaggaaagcatttatacttgagaaatattgtacaaatataaagactgtgaaaaagccattaatacatgctcacatcttactcaacatcagagagttcatactcaataaaaacataagtgcaactactgtcaaaatatctttaagaaaatataagcttttaaagtgaagagtattttgaagaagaacattgtagtagaattgtaatatgtttacttgtatcacagatcttactgtacacgttttgtattagaggaaacctctgaagcagttgctcaaactttgttcaatatcagggaatttatattgaaaaaaactgtgcgaatgtaataaagttggaaaaatactttttcaaaaactacagcttagaaaacaccagagagttcatactaaaacatatttttgcagatacaggaaaaattttttaaaaattttaatcattaagtctgtaaatatcagagaatttacagtagaaatatgtaaggcactgatgcttcaggtattttactaaatcagagtgctgagtatagaaaataatctaaaactaaaattggtaaaatatttgtatataactttaaaagtagaaattttttgcagttattgcattcaaagtatgcttaactttttgaaaaaattagattttttgaaaagtgagtaataatgtaattcaactcttaaattatttcctgccttttcttcactcctatttacatgtgaaagcatgtgatcaattgttgctgcatcagatatgagagattcttttttattaggtgagcattatttataaactttgctatgaaaaagacattaaaatatgagatgtatgatgaaaatctaagtgaagagacttttatggttaacttataatattaagcaatgtgtgcgttaggcattcagagtaatattctgcattatgagaaaacttaatttcatttataagtaaattaaaattagtatattttactaatacttttatataaaatgcagtatattttttaaatttcagattatatgtgatgttaatatattcaacctttttaacatgtt

SEQ ID NO: 462825 - DNA, 4918 bp, Homo sapiens
gctgcagagggctaatgcaacatccagaagagcatgcagctggagcggactggacggcttccgggtttggcggggtctttgtctctcgctgtagccggagctccaggttttgctctcacttctctgtgtcttctgctcctaggggcctagcctgtgtggccctctgacctgcagatattgggagatccacagctaagacgccaggaccccctagaagcctagaaatggtgagagtgcccggtccgacatcccgagagacggcgaaagggctggttggaactggtgggaagtagctgtggcgggactcaggcctctccgcagtcagcttcacaatctgcgccttgcccagctcggcctccgtccccttcggccataagatggcggctgcgctgacagccaggaccccaggcgtcctttctcttccctgcgtagtgactgtgccttggcctggagccctctcttggcagctctgcacccgcagcgccgcgtctctctcagattgtgcagggaccacgggagggtcgtcaggggaaaatcctgactcggggtgcgggttcatgaatgggaagatctttggatgacccgaggtatggaatgtgtcctctcaagggagcaagtggatgccctggggctgagaggagtcttctggtgcagtcttattttgaaaagaaaaagaaaaaatatgtgcagagattttaccgaaaagggtcccaatccaaaccccaagagagggtccttggatttcactcaagaatcaagtatttcttgccaaaaagccacaaaagtgtccacaagtctcctggcatatcccaacccccagacaatgaatctgcagcagcaacctgttttctccaccagcctagggtcctggactacctgttcataatcttctctgcctgcatggacccagaaataaatcagagtacagcgccacctgggccactgtctgtagaacaaacaatccacttacactgcattcttccccacccatggattttctttttctacacgtgtacatgtgcagggttgttatatgggtaaaattgtgtcatgggggtttggtgtagattattttgtcactgagagaggatggctttagagtgctgaataccaatgaagttgatcagcgctgaaagaccttcttacagctgctccacacaagtctttgtcttcacataatctagaaatagcctctaggttctgtgctctttctttgctaagaggagcaaatagaaaattcaggtggtcatctgctaaggagcgatggtcaaggtagtgtttggcataaacactagcaggaacattaatattaaactgaagaagctccgaaaaatgcctttccatttcattcatgtcctcaactgtaatgtccttgaggatctggcagtagtccacattccatacagcctgatcatcccaaaccttggaggcaagaagagtggctcccagaacaatccttttctagttagtggggcaaatgtcgatttcagcataagttaaaagcctttctaagtaaaccagagttactgttgcacattcagctgttagctgtgcagcactaaaaagagtatgaacaaatctgtaaataaatttgtgctcaggatcatgcttaaactattcctgtggaactttttctcgtgtgaggggatgtgatctctcatcaaaaatatccagggatctgtttgcatctctgttctttatgtggtaatatatttctaaggtcacattttactgtggttctaaggttaggctggctgactgttctgtcacctagaaatattgttgagcatgagctatactttttagtaagctgccctggagatagatgatttaagtggttgctcttcctcttgtctcacacatcggtttgagatttgctcaggaaacttgtgcttgcccttggatggtcagaagggtttgactccaaagctaaatcttagggcatctcgtggtcgctgatgtgctgcaggtggtggccctcgcccgctgcgaaatccaactggtaggctccacagaagcgggcgctaccgccaccgcatccccgggtgccgcctcgtagatgtcggttgcgcagtacagctctggcaccacgcaccggcccagcttgaggctggtactggggggacacgcaataggtcagcgtgttccccatggggcgtctctgctcctctgggccggggctggcgccttctctagccccctactcgccgccctcagcagccgcccctcccccaacaatggcgcagcccaggctgcacccgcgcaagcaggtgcctcctcgctggcagttcacccgcccaccccgcgacccgccccgggcagggctccggcctccctgcacgctcgccgcgctgccgctgcctccgcctccccaagctgactcatctggagataattatgtgtttttctctttcgttctctttatgtgatggattacatttattgatttacatatgttgaaccagccttgcatcccaggggccattgacgtttagggatgtggccatagaattctctctggaggagtggcaatgcctggacagtgctcagcagggtttgtataggaaagtgatgttagagaactacagaaacctggtcttcttgggtattgctctcactaagccagacctgatcacctgtctggagcaaggaaaagagccctggaatataaagagacatgagatggtagccaaacccccagttatatgttctcattttccccaagacctttgggcagagcaggacattaaagattcttttcaagaagcgattctgaaaaaatatggaaaatatggacatgacaatttacagttacaaaaaggctgtaaaagtgtggatgagtgtaaagtgcacaaagaacatgataacaaattaaaccagtgtttgataactacccagagcaacatatttcaatgtgatccatctgcaaaagtctttcatacattttcaaattcaaacagacataagataagacatactagaaagaaacctttcaaatgtaaaaaatgtgaaaaatcattttgcatgcttttacacctaactcaacataaaagatttcatattacagagaattcctaccaatgtaaagattgtggcaaagccttcaactggttctcaacccttactacacacaggagaattcatactggagagaaaccctacaaatgtgaagaatgtgggaaagcatttaaccggtcctcacaccttactacacataagataattcatactggagagaaaccatacagatgtgaagaatgtgggaaagcttttaaccggtcttcacaccttactacacataaaagaattcatactggagtgaaaccctacaaatgtacagaatgtggcaaagcttttaaccggtcctcacaccttactacacacaggataattcatactggagagaaaccctacaaatgtgaagaatgtggcaaagcctttaaccagtcctcaacccttactacacataagataactcatgctggagagaaaccttacaaatgtgaagaatgtggcaaagctttttaccgattctcataccttactaaacataagacaagtcatactggagagaaattctacaaatgtgaagaatgcggcaaaggctttaactggtcctcagccctcactaaacataagagaattcatactggagagaaaccctacaaatcagaaagatgtgacagtgctttgaaaacacctcaaacttttcaaaacataaatcatagtgttgagaaatcctagaaatgtgaagaatgtgataaagttttaaatggttgtcacacttgattgtaggtaaggtaagttatactggagaaaacttctacatgtgtgaacagtgtgacaaaacttttaactaatgctcacaccttcacaggaaagcatttatacttgagaaatattgtacaaatataaagactgtgaaaaagccattaatacatgctcacatcttactcaacatcagagagttcatactcaataaaaacataagtgcaactactgtcaaaatatctttaagaaaatataagcttttaaagtgaagagtattttgaagaagaacattgtagtagaattgtaatatgtttacttgtatcacagatcttactgtacacgttttgtattagaggaaacctctgaagcagttgctcaaactttgttcaatatcagggaatttatattgaaaaaaactgtgcgaatgtaataaagttggaaaaatactttttcaaaaactacagcttagaaaacaccagagagttcatactaaaacatatttttgcagatacaggaaaaattttttaaaaattttaatcattaagtctgtaaatatcagagaatttacagtagaaatatgtaaggcactgatgcttcaggtattttactaaatcagagtgctgagtatagaaaataatctaaaactaaaattggtaaaatatttgtatataactttaaaagtagaaattttttgcagttattgcattcaaagtatgcttaactttttgaaaaaattagattttttgaaaagtgagtaataatgtaattcaactcttaaattatttcctgccttttcttcactcctatttacatgtgaaagcatgtgatcaattgttgctgcatcagatatgagagattcttttttattaggtgagcattatttataaactttgctatgaaaaagacattaaaatatgagatgtatgatgaaaatctaagtgaagagacttttatggttaacttataatattaagcaatgtgtgcgttaggcattcagagtaatattctgcattatgagaaaacttaatttcatttataagtaaattaaaattagtatattttactaatacttttatataaaatgcagtatattttttaaatttcagattatatgtgatgttaatatattcaacctttttaacatgtt

SEQ ID NO: 462826 - DNA, 334 bp, Homo sapiens
acatttatatgtctataaaggaatgagggcctttggtattttcctatgccatcttatttatgtagtttgtatattagaggttagatttgtaaactatctgtgtctagtaagtaaagtaatttgttatttttatttctttcagttatatgttctcattttccccaagacctttgggcagagcaggacattaaagattcttttcaagaagcgattctgaaaaaatatggaaaatatggacatgacaatttacagttacaaaaaggctgtaaaagtgtggatgagtgtaaagtgcacaaagaacatgataacaaattaaaccagtgtttgataacta

SEQ ID NO: 462827 - DNA, 1699 bp, Homo sapiens
gccaaattccctgcctgtgcctgctgggaccagactccgctgtcatgagggtgacatccgccacctgtgctcttctgctggctctgatctgcagcgtccagctgggtaagaaagaggcgagcagggctgggaggaagcggtggccctgctccttcactctcatcaccatcccaaggtctcattggccatgggaggtttcgctgaattctgacctcctctgttttcttatctcacctcatcctccacaggggatgcctgcctggatatcgataaactgcttgcgaatgttgtgtttgatgtgtcccaagacctcctgaaggaggagcttgctcgttacaaccccagtcccctgacagaggagtccttcctcaatgtccagcaatgctttgccaatgtctccgtgacagaaagatttgctcattcagttgttattaagaagatccttcagagcaacgattgcatagaagcagccttctgatctgaggacccctgcagatcagatattggccctcctgccttccttggggctccccgcgttcctggcctggctctgttcatcactacagagaccccaatgaacacctgcagctcagttctgtgttctggcatctgtgtggggttggctgtgaccgcatatgcagagtgtgaccagggtcccagtgtgaaaatatgcgactgaggaaaaactctacaggtgaaggtctggggcagggaatgcggcatgatgagaaaggatttgttgtgttggagaaatggccagtgcagctggaacaaggggcagcagggaaggaggtcacgtcagaaaacgaggcaagtgccagagcaacgggggcggcagtagaggcaggaagaccaactgggagtccctgtggccgtccaggtagacaccgtggccttgtcacagtgcagccctggagagacacgagggagacagaggctggggcagcactgacagcacctgctgttgaattgaatatggggagaggatgtggagagaaggggaatcaaaatgatctcatcacatttgggctggagcagctggctggatgtgatgccactgctgagaaggtgaagcctggggaggagcaggtttagggcaaagatccagagtcccatgctggcctggataagtttcccacatccaagacatccattagctatccaggaggacgggacacagggggtgtgagacgctctagtttggagctcatggaatagttgggcctggagacaaaaacatgtaaatttcagcatttcaatggaatttaaatctgtggagctaaagaaaataatgcagatcatgctacttattcagtctcaattaaaactcagcttgtagcaatcaaagatggagagtttcaaccagaagtaaatgaaaagaattagaaatgccctgagaaatttggacaaacatgttattgatataaatactttgagatgcaaaagcatttcacatgtgtttgaaagaataaggaaaatgttagaaaataattgtcactgaagatgagtctacccatgatctgtcagttgtcctgaaattgagtaatttcttaaaatgacaatgtcctgtgagtttactttaactaaaatgcttacgactctgttattcttaatgatatgtgatgatctctgtattgttggtataaggaattatattccctacttgtatgtttcatagaatattgaatttcagccataa

SEQ ID NO: 462828 - DNA, 1103 bp, Homo sapiens
taaattgactcaatttaaatggaatgaagtggaatgcacttgaacggattggaatggattggaatggaatggaatggaacggaacggaacggaacggaacggacccggaatggaacggaacggacccggaatggaacggaacggaatggaatggaatggaatggaatgaagtggactctaatggaatggaatggaatggaatagactcgaatgaaatgggatggactcgaatggaatggaacggaatggaatcgactcgagtggaatggaatggaatggaatggaatagaatggaattgactcaatttaaatggaatgaagactggaatgaaatggaatggaatggactcaaatggaatggaatggaatggaatggactcaaatggaatggactcaagtggaatggaatggaatggacacgaattgaatggaatggaatggactgtaatggaaaggaatggaatggaacggaatggactcgaatggaatggaaaggactcgagtggaatggaatggaatggaatggactcgaatggaatggagtggaatactcgaatggaatggaatggaatggaatggaatggaatggaatggaatggaatggaatggaatggaatggaatggactcgaatgaaatggaatggactcgaatgaaatggaatggactagaatggaatggaatggaatggaatggaatggaatggaatggaatggaatggaatggaatggaatggaatcgactcgagtggaatggaatggactcgaaagaaatggaatgcagtggaatggactcgaatggaatgcaatggaatggaatagactcgaacggaatggaatggaatggaatggaatggaatggaacggaatggacgcgaatgaaatggaatggaacggaatggactcggatggaacggaacggaatggaacggaatggaatggaatttactcgaatgggatggaatggaatggaatttactcgaatggaatggaatggaatggactgaaatggaatagcatggaatggaatggactcgaatgcaatggaatggaatggactcgagtggaatggaatggactcgaacggagtggagtcgaatggattc

SEQ ID NO: 462829 - DNA, 445 bp, Homo sapiens
  misc_feature (67)..(67): n is a, c, g, or t
  misc_feature (70)..(71): n is a, c, g, or t
gacctgttaaaatcctaacctccatactgggaaaagaaggagctttagctgcatggctctcttattnctnncgctcagggggtctgtatctcaaagcctttaaaatgctgatggaaggagtggagatccagcgttcagggtagaaaagaggaaaatccatggaaccataatctatggatggctttaggaatgggattgactgcaaaggagcacaagggaacttcctggggtgatggaaatgttttgtcttgattgtggtaatgattacatgactatgtttgtcaaaattccagaactttatacctaaaagggtgaattttactgcatgtaaattatacctaaacacatgactttttaaaaaggcctgaaatcttaactactcagctaaaaataaaataaaataaaataaaccaatttaggtgcaaaacaagttttgtttttggga

SEQ ID NO: 462830 - DNA, 1336 bp, Homo sapiens
gaagatgattagagggttggaaaatgagatggatgtcagattaaagtgacagtaggattggcgggtggtgagggtgctggtggtgggaatctaagcaaaggagtcgagggtgataatgctaaggggtctggattgggaagctgggtggatttcaactaagacgagagaatctgtgggaagaggagcaagggcagaaggggctcaggggaagatctgtgactatgaaagggatctgaagaaaactttcccaaccgactggcaagagaaaatgacagtgtctttgaatgtattctgtaatatcaaaaacggaatacaaatttacggaactatcagtgttatccacaatcaaaactatccatttaaaactgatggaagtgactgttgcaccttcgggtattacatctgcattccaggtgggaggaagggggatggcaaaaggatccaaggcattctcttagagaagtttacctcttattctggaaagaaagtgttcctcaaagacttccacttacagcttattggccagagctgaagtaacagccctttgtagaattataaagtcaccctttataactatgctctcattaagttttggaaggcctattttccttgtatctttaggcttttcatcatgtagtaaacaagctgagtattagaaattaaatctcatgacaaagatgacacaagatgacagggcatctgggaaggctgtttgcatctgccttgcaatcagtgggtgagagagtgggttgattctgatgactatggtgagcttttccttcctcctattctaaaaagataccaaacctggcacagaacaatggtcaatgatgttggtgaacccagttgattaattctggctccactcttggcacagttcttttccttcctcctgttctagaaagagaagaaagttttaaaagtagctatgtcattttgcaatgtttgatatccttgtgttttatctagggggtctgtatctcaaagcctttaaaatgctgatggaaggagtggagatccagcgttcagggtagaaaagaggaaaatccatggaaccataatctatggatggctttaggaatgggattgactgcaaaggagcacaagggaacttcctggggtgatggaaatgttttgtcttgattgtggtaatgattacatgactatgtttgtcaaaattccagaactttatacctaaaagggtgaattttactgcatgtaaattatacctaaacacatgactttttaaaaaggcctgaaatcttaactactcagctaaaaataaaataaaataaaataaaccaatttaggtgcaaaacaagttttgtttttggga

SEQ ID NO: 462831 - DNA, 1427 bp, Homo sapiens
cgcaacaaccccaagtctgtttccaggtggaggctgtaacagggttgaaaacttgccccaggctaccggctgctaaagaaaagggcttggttcgtcccccacctgtggagtctgcacaccagatttgcgccctcccctgagttctgaccaggaggcgtctcgccccatccaaattgttaaaaagttcagctggacatttccctctccccatggagttctacccctgctcctctggtcaccctcctgatggatccccatggtgccaggcaggaatggcctgctaggagatgcagtgagcccccaggacctctccactgcctcctccacccctgtatttcacttggctctccaaattgactcaactccagaccataaagaagatggagaggcacatggtcaggggacaattgtataagcattttgatttggagaggaagaatgccaagcaggctgaagccagactggaccaaagactgcagagactaaaggttatttgcctctaccatgtgaaattgctgacctgggagcagaggcagctccaaaaagaactgcagaggttgcagcaagaaaccatgaagaaaaagttctcctcttatttggggaatggatttcagaagagaccagaagatgttctcgtgttctcaccacagggaaggcagaagcacagagccccacaggctaagaaaatgagagcattggcaacccgtatggcccaagacacatgcaaaagcaagtcccaggtgcctccttcacatgatgctggcctcaaagaccccatgaagagcaaaaagcagccactctctcaaaataacagaactgcctgcttcataaaagagcaaccacaagcccaagagaaagattctgtgaatccatctaaggacgtagaccccagcaagggcatctctgttccatgccaaaatcaagaggtttccaccaacaccatagaacaaggtcctagttccagcccagctagtgatagtggaatggcatgtgctgatgagaccagatcaaaagatgttgctctaaagccagatgggaacactggaaaacaaattcccccaaaacacatggaatgtgcaggaagcttcgaaggcgagttcacaaagccaaccttcttagagttgctttcaaaggccagaaatgcccattatctccggcacagggtcccccctgagtctgagaggttgcttagcattggagagatatttgggcatggggaatcctcatcatccagggcaggaaaggagtgtgaaaacagggtgccttctaagtttcttcctctctaaccgtttaacatagcctgacaataacatatgccattattgctaaggaaatgtgttcctcaaatgactatattaagcaatacagagaaaaacaaacaaacataattgaattacaattttattttaaactccctattattttcc

SEQ ID NO: 462832 - DNA, 1182 bp, Homo sapiens
cctgcggctcccgggctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggagggatggatcgtgactatggccatggatcctatgggggtcagagatccatggattcctacctaaaccagtcatatggcatggacaatcacagtggtggtggtgggggtagcaggtttggaccttatgagtcttacgactccaggtcttctctgggtgggcgagatctgtacagatctggctatggttttaatgaacccgaacaaagccgcttcggaggtagttatggtggtcgatttgagagctcctaccggaatagccttgactctttcggaggtagaaaccagggcgggtctagctgggaagcaccttactcccgttcaaaattgaggcctgggtttatggaggacagaggaagagagaattactcttcctacagcagtttttcttcaccccatatgaagcctgcacctgtaggctctcgggggagaggaacgcctgcttatcctgaaagtacgtttggaagcagaaactatgatgcttttggaggaccatcaacaggcagaggccgaggccgaggagaagtaatattttgtaaattattgcttaaatgagtaaatatactagtccacaattgtttaagtttagggtacatagtgtaaacattatgctttatgttcttaggtcacttgattgacatgaaattttacctagaacaaataaattaaaatggaacataaattttatcacaatttttacaggatttttcatcggtttattaacaagtaaattgtttttaactcactggtgtcaaatggtgaatttattttctaaaactaaaacgccagttattcctaagatttttgtgttttattacttttaatcaaaagacaaataaataagagcacttccaaataggaaaaaattctatttaactgctaaatatagcataaaattaggagattttgctgtttgtaagtgattatgctcttccctaccctaaaacttagagt

SEQ ID NO: 462833 - DNA, 950 bp, Homo sapiens
cctgcggctcccgggctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggaggtctgacattcaaggatatttatctaaaaattcttcttttgagtgccagtaaagcatatgggtgattttggaagcattcatagacccggaattgttgttgactatcaaaacaaatccaccaatgtgacagttgctgctgcaagaggaataaagagaaaaatgatgcagccatttaataagcccagtggaacctttatcaagaaacccaaactagcaaaacctatggagaagataagcctcagcaaatcacccacaaaaactgatcctaaaaatgaagaggaagaaaagcggcgaattgaggctcggcgagagaaacaaaggcgcagaagagaaaaaaaacagtgagaaatacggagatggatacagaatggcatttacatgttcattttgtaaatttcgaacattgagaaaaagattttgagactgctctgggaaggttcttcacatcagggaacattggatctatacagaaacaaactaaattgagtaagaggtatggggggttgccgaggcggggcggcgaaatcccggaaacatctatttgtgaggaccccgaccaactatctacgaggtgttaatatgcgaccacgttggagggttggtggaaacacactagaaggggaagcactggcgggcgggtgtatacacactgataaaaggagcggggaaacgtctataagggggggtgttgaaaaaaaaagagggggggaaaaagagg

SEQ ID NO: 462834 - DNA, 1147 bp, Homo sapiens
cctgcggctcccgggctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggagggatggatcgtgactatggccatggatcctatgggggtcagagatccatggattcctacctaaaccagtcatatggcatggacaatcacagtggtggtggtgggggtagcagtttttcttcaccccatatgaagcctgcacctgtaggctctcgggggagaggaacgcctgcttatcctgaaagtacgtttggaagcagaaactatgatgcttttggaggaccatcaacaggcagaggccgaggccgaggacatatgggtgattttggaagcattcatagacccggaattgttgttgactatcaaaacaaatccaccaatgtgacagttgctgctgcaagaggaataaagagaaaaatgatgcagccatttaataagcccagtggaacctttatcaagaaacccaaactagcaaaacctatggagaagataagcctcagcaaatcacccacaaaaactgatcctaaaaatgaagaggaagaaaagcggcgaattgaggctcggcgagagaaacaaaggcgcagaagagaaaaaaaacagtgagaaatacggagatggatacagaatggcatttacatgttcattttgtaaatttcgaacattgagaaaaagattttgagactgctctgggaaggttcttcacatcagggaacattggatctatacagaaacaaactaaattgagtaagaggtatggggggttgccgaggcggggcggcgaaatcccggaaacatctatttgtgaggaccccgaccaactatctacgaggtgttaatatgcgaccacgttggagggttggtggaaacacactagaaggggaagcactggcgggcgggtgtatacacactgataaaaggagcggggaaacgtctataagggggggtgttgaaaaaaaaagagggggggaaaaagagg

SEQ ID NO: 462835 - DNA, 1414 bp, Homo sapiens
cctgcggctcccgggctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggagggatggatcgtgactatggccatggatcctatgggggtcagagatccatggattcctacctaaaccagtcatatggcatggacaatcacagtggtggtggtgggggtagcaggtttggaccttatgagtcttacgactccaggtcttctctgggtgggcgagatctgtacagatctggctatggttttaatgaacccgaacaaagccgcttcggaggtagttatggtggtcgatttgagagctcctaccggaatagccttgactctttcggaggtagaaaccagggcgggtctagctgggaagcaccttactcccgttcaaaattgaggcctgggtttatggaggacagaggaagagagaattactcttcctacagcagtttttcttcaccccatatgaagcctgcacctgtaggctctcgggggagaggaacgcctgcttatcctgaaagtacgtttggaagcagaaactatgatgcttttggaggaccatcaacaggcagaggccgaggccgaggacatatgggtgattttggaagcattcatagacccggaattgttgttgactatcaaaacaaatccaccaatgtgacagttgctgctgcaagaggaataaagagaaaaatgatgcagccatttaataagcccagtggaacctttatcaagaaacccaaactagcaaaacctatggagaagataagcctcagcaaatcacccacaaaaactgatcctaaaaatgaagaggaagaaaagcggcgaattgaggctcggcgagagaaacaaaggcgcagaagagaaaaaaaacagtgagaaatacggagatggatacagaatggcatttacatgttcattttgtaaatttcgaacattgagaaaaagattttgagactgctctgggaaggttcttcacatcagggaacattggatctatacagaaacaaactaaattgagtaagaggtatggggggttgccgaggcggggcggcgaaatcccggaaacatctatttgtgaggaccccgaccaactatctacgaggtgttaatatgcgaccacgttggagggttggtggaaacacactagaaggggaagcactggcgggcgggtgtatacacactgataaaaggagcggggaaacgtctataagggggggtgttgaaaaaaaaagagggggggaaaaagagg

SEQ ID NO: 462836 - DNA, 693 bp, Homo sapiens
  misc_feature (40)..(40): n is a, c, g, or t
  misc_feature (77)..(77): n is a, c, g, or t
  misc_feature (88)..(88): n is a, c, g, or t
  misc_feature (110)..(110): n is a, c, g, or t
  misc_feature (119)..(119): n is a, c, g, or t
ctcaagcagatcctcccaccatggggcgtaccgcagtgcntgggattccagcgagtgatgccaccgctctctggctnattatattttncaaagactcctcagcctgcggncatgtgcanaaccaagccacccattgtcacccccaggctgtcaccaccctaggccacatcgtccgtatctatctcatggaagacttggacagcggcctctctgctatcctttgctgcattcttttgaagccccaggcttgcttcctcagatattcacatcctgatcaaaatcaggacattcgcactgatacagtactattcactaatgtgcaagccttattcacatttcctctgttcagctctagtgtcccttttctgttccaggatttagtcctggatcctgtcttgcatgaaaaagggcagttggctaccttctgggaaactaaacttaccggtaagctccgcatctgctggggttctggtgtcttccatgagccaggtcgtggaagtggagagagcatccaggaaggcttcccgaaagaagtgccaatcaaggcggctgcaccctggggacctacccagagggctttggaggcacatgatggcctgcggacctcaagcgggctcttctttcctggggcgccatcccccatgctctgagctcccgctctccccagcctctcaggccccatgggcagggctc

SEQ ID NO: 462837 - DNA, 535 bp, Homo sapiens
agcagccggcgcggccgccagcgcggtgtagggggcaggcgcggatcccgccaccgccgcgcgctcggcccgccgactcccggcgccgccgccgccactgccgtcgccgccgccgcctggcggcgcggagttctcggctcgctccaggaagaggaaggcaaacgtgaccgtttttttgcaggatccagatgaagaaatggccaaaatcgacaggacggcgagggaccagtgtgggagccaggtaggtccgcccggggttgggcctctgtggaggtccttctccccctgggtcacatggggtttcatgctgtcttgtctcttgctggagacactctggtgagagtgaacttctctaatgcagccacagcccatatggcccagcactgtacctgtcagtgggcactggcctctgccagtcctgggattccaggaagcttggtgttcctgactggcaccgtctgagattacagatatgtgcctagcctggaagaaccagaatggacatcacagtattcagtcctccccttctgcccag

SEQ ID NO: 462838 - DNA, 2142 bp, Homo sapiens
agcagccggcgcggccgccagcgcggtgtagggggcaggcgcggatcccgccaccgccgcgcgctcggcccgccgactcccggcgccgccgccgccactgccgtcgccgccgccgcctgccgggactggagcgcgccgtccgccgcggacaagaccctggcctcaggccggagcagccccatcatgccgagggagcgcagggagcgggatgcgaaggagcgggacaccatgaaggaggacggcggcgcggagttctcggctcgctccaggaagaggaaggcaaacgtgaccgtttttttgcaggatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgtgtgaagtctataaacttcacagggagaccttttacttggcacaagatttctttgaccggtatatggcgacacaagaaaatgttgtaaaaactcttttacagcttattgggatttcatctttatttattgcagccaaacttgaggaaatctatcctccaaagttgcaccagtttgcgtatgtgacagatggagcttgttcaggagatgaaattctcaccatggaattaatgattatgaaggcccttaagtggcgtttaagtcccctgactattgtgtcctggctgaatgtatacatgcaggttgcatatctaaatgacttacatgaagtgctactgccgcagtatccccagcaaatctttatacagattgcagagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttgagacagctggttttatgagctatgtctggtaacttaagttggcgtcgccacaccacacagtgccctcaacaaggccacctaagacctctgtgggacaaatctcacagtatgcgtctgccttcctctcccaaggcacctctgccacacttcgctctgctgacccctctttccctctggaaacttcagtgccagctcc

SEQ ID NO: 462839 - DNA, 2112 bp, Homo sapiens
taggctgtgggttgattctggaccgtggctgtccatttcccgccgactcccggcgccgccgccgccactgccgtcgccgccgccgcctgccgggactggagcgcgccgtccgccgcggacaagaccctggcctcaggccggagcagccccatcatgccgagggagcgcagggagcgggatgcgaaggagcgggacaccatgaaggaggacggcggcgcggagttctcggctcgctccaggaagaggaaggcaaacgtgaccgtttttttgcaggatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgtgtgaagtctataaacttcacagggagaccttttacttggcacaagatttctttgaccggtatatggcgacacaagaaaatgttgtaaaaactcttttacagcttattgggatttcatctttatttattgcagccaaacttgaggaaatctatcctccaaagttgcaccagtttgcgtatgtgacagatggagcttgttcaggagatgaaattctcaccatggaattaatgattatgaaggcccttaagtggcgtttaagtcccctgactattgtgtcctggctgaatgtatacatgcaggttgcatatctaaatgacttacatgaagtgctactgccgcagtatccccagcaaatctttatacagattgcagagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttgagacagctggttttatgagctatgtctggtaacttaagttggcgtcgccacaccacacagtgccctcaacaaggccacctaagacctctgtgggacaaatctcacagtatgcgtctgccttcctctcccaaggcacctctgccacacttcgctctgctgacccctctttccctctggaaacttcagtgccagctcc

SEQ ID NO: 462840 - DNA, 1965 bp, Homo sapiens
taggctgtgggttgattctggaccgtggctgtccatttcccgccgactcccggcgccgccgccgccactgccgtcgccgccgccgcctgccgggactggagcgcgccgtccgccgcggacaagaccctggcctcaggccggagcagccccatcatgccgagggagcgcagggagcgggatgcgaaggagcgggacaccatgaaggaggacggcggcgcggagttctcggctcgctccaggaagaggaaggcaaacgtgaccgtttttttgcaggatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggaaatctatcctccaaagttgcaccagtttgcgtatgtgacagatggagcttgttcaggagatgaaattctcaccatggaattaatgattatgaaggcccttaagtggcgtttaagtcccctgactattgtgtcctggctgaatgtatacatgcaggttgcatatctaaatgacttacatgaagtgctactgccgcagtatccccagcaaatctttatacagattgcagagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttgagacagctggttttatgagctatgtctggtaacttaagttggcgtcgccacaccacacagtgccctcaacaaggccacctaagacctctgtgggacaaatctcacagtatgcgtctgccttcctctcccaaggcacctctgccacacttcgctctgctgacccctctttccctctggaaacttcagtgccagctcc

SEQ ID NO: 462841 - DNA, 208 bp, Homo sapiens
ggcaaatagagaggaagtctggaaaatcatgttaaacaaggaaaagacatacttaagggatcagcactttcttgagcaacaccctcttctgcagccaaaaatgcgagcaattcttctggattggttaatggaggtgagcttgagtcttcctgttcgcttcatgaaagcactgagcatttccagcatttttgtgtattaggacctctgt

SEQ ID NO: 462842 - DNA, 1971 bp, Homo sapiens
gtgctcacccggcccggtgccacccgggtccacagggatgcgaaggagcgggacaccatgaaggaggacggcggcgcggagttctcggctcgctccaggaagaggaaggcaaacgtgaccgtttttttgcaggatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgtgtgaagtctataaacttcacagggagaccttttacttggcacaagatttctttgaccggtatatggcgacacaagaaaatgttgtaaaaactcttttacagcttattgggatttcatctttatttattgcagccaaacttgaggaaatctatcctccaaagttgcaccagtttgcgtatgtgacagatggagcttgttcaggagatgaaattctcaccatggaattaatgattatgaaggcccttaagtggcgtttaagtcccctgactattgtgtcctggctgaatgtatacatgcaggttgcatatctaaatgacttacatgaagtgctactgccgcagtatccccagcaaatctttatacagattgcagagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttgagacagctggttttatgagctatgtctggtaacttaagttggcgtcgccacaccacacagtgccctcaacaaggccacctaagacctctgtgggacaaatctcacagtatgcgtctgccttcctctcccaaggcacctctgccacacttcgctctgctgacccctctttccctctggaaacttcagtgccagctcc

SEQ ID NO: 462843 - DNA, 1910 bp, Homo sapiens
tctttttggaagcactttcagaagtcatgcctagtatcttactgagttgcaggtgaatttgtaatgtttttgggtaatgtaagagctgtttgcatcttatctcacctctcctgtgtatttttcatttacagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgtgtgaagtctataaacttcacagggagaccttttacttggcacaagatttctttgaccggtatatggcgacacaagaaaatgttgtaaaaactcttttacagcttattgggatttcatctttatttattgcagccaaacttgaggaaatctatcctccaaagttgcaccagtttgcgtatgtgacagatggagcttgttcaggagatgaaattctcaccatggaattaatgattatgaaggcccttaagtggcgtttaagtcccctgactattgtgtcctggctgaatgtatacatgcaggttgcatatctaaatgacttacatgaagtgctactgccgcagtatccccagcaaatctttatacagattgcagagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttgagacagctggttttatgagctatgtctggtaacttaagttggcgtcgccacaccacacagtgccctcaacaaggccacctaagacctctgtgggacaaatctcacagtatgcgtctgccttcctctcccaaggcacctctgccacacttcgctctgctgacccctctttccctctggaaacttcagtgccagctcc

SEQ ID NO: 462844 - DNA, 2007 bp, Homo sapiens
agcagccggcgcggccgccagcgcggtgtagggggcaggcgcggatcccgccaccgccgcgcgctcggcccgccgactcccggcgccgccgccgccactgccgtcgccgccgccgcctgccgggactggagcgcgccgtccgccgcggacaagaccctggcctcaggccggagcagccccatcatgccgagggagcgcagggagcgggatgcgaaggagcgggacaccatgaaggaggacggcggcgcggagttctcggctcgctccaggaagaggaaggcaaacgtgaccgtttttttgcaggatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgtgtgaagtctataaacttcacagggagaccttttacttggcacaagatttctttgaccggtatatggcgacacaagaaaatgttgtaaaaactcttttacagcttattgggatttcatctttatttattgcagccaaacttgaggaaatctatcctccaaagttgcaccagtttgcgtatgtgacagatggagcttgttcaggagatgaaattctcaccatggaattaatgattatgaagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttgagacagctggttttatgagctatgtctggtaacttaagttggcgtcgccacaccacacagtgccctcaacaaggccacctaagacctctgtgggacaaatctcacagtatgcgtctgccttcctctcccaaggcacctctgccacacttcgctctgctgacccctctttccctctggaaacttcagtgccagctcc

SEQ ID NO: 462845 - DNA, 2298 bp, Homo sapiens
tctaggaacatggcaggagcaagagcccaaagcttggagacaaaggcagtatggaagattgcggagaaccctggagaccaagacaagggttcttggttgaaatctgggctctgacactgacaagctgtgtgatcctgaatgcatcatctaggcggctcatagctgtaagagacctaaacctcaattcaacaatgaagaaactcattgcttcacagatccacagatccacaaatccaaaggaaaagttgtaccaggcagcctgtgagaacattttcaatagaaatgagtggaccaggaacaaattttattcctactcaatggctgtgttttctttggcagaagctagaccaagtttcacatcacagttgagaggagacgtgcataggaactgcgtcatctggttccacactcgctccagtgatgctggtttctgcctgtcccaaccctggccatggctgacaaggggcccagggacactggagcagagagacctgctggtccttggggtttcttgcaaggctgatagcgggggaacctctctcacagggctgctacaaagattgcatgagattttgctcaacaaatattagctgttggctccagagtttaatacctctgatcactacaagctttgaaggcaagataaaataacttcaacatagtgaatcatctgtgaacacttcctgtgaacgtgtgactatgattatggaacactctgttgcatcaagatggccagagattgtctcagagtccaggcagtgggaggaggggggatttgtttcctggctgggtggtcgtagggcatcaagggatgagcagctttggttgtctgggatttcagcagcttgaggggagctgtagggccccagagctgtcgctgtggctgtggtgtcagaaatgtaagcaaggtgcctccatggaggttagcgagggtgcccctctgaatgccgggtggaatgcaacctttcgcatggaggaggccctcagcagctgacctctgtcttccctgtgtagagggagggaggctgaggctggggctgagcgaggggtaaagtaagccacgtgtctcatcagctagcctgcagcaagcacagccctctgggagggctggttctatcctcctccttggtgtgaaatccatcaatctaatagggatccttattttcccagccaccaagtcacaatgagcaataatctcttcttgttggtgcatataaatttgcttcattcttttttaaacagctgccttgtgtcgccttttgcattcagcccaagtccagcctaggaggacagccttatcttaagtcactgagggaactagcttgcctaactgaaagggctttgccctggaaggagaagggtcttctggaaacataaaacgtttcaggggagggcagtcctgaatgagatggctctagggggtgggggacactggaccgcctgaaggtactgggcatctggcctgggcttttgaggaaatgcaaagccatgctatagatgatgctgagcaaaggcgggagagagacgtgggggtcctaccggggtcacttgaaaaccccttctccggcctcccccacgctaacccatctctcctggcacgcaagtctggaaaggccactggccctaaccatgctggctctgcgtccaccttcctcttcaattcaaatggcttggataaagccatgggttatgacgcttaacccatcactgtgggaaactggatgacttggggaacaaagccaaccttttgctgtctcccattccctttgcttttcccctccacccccacctccactgtaacctgctatggttagtctcctcctcttcctgctgcacccctcatcaccacctcttctgaaattgcaagcccccactcctgctcctctttcccactttgctctgctccttaacgcttattgctgacatgccctgtggctgattagttgctgactgtcacgccccatttgaagggggcagtgagggcagggatttcaatgtttcttcatggctgtatcttcagcaccttaaacagtgcctggctcatagtgggtgctcaataactgcttgttggttgaattaagccatgaatgaaaataaagtgcactgggccccacccaacctccccttcccatgaccagaaggggcctgggcacaggcaagggaagggtcagcattgagtatctaggctccaatgcatccccaggcaggtcatggcagcagctgttctgaagccatttcccctctcccccatggcagccccatggcatgtctggtggccatgtcttgacaagggccatc

SEQ ID NO: 462846 - DNA, 2103 bp, Homo sapiens
cacgcctgctcgtcctgctgctgccggggtggaggggcaccagctggagcgagctcctctgcttctcgggataaaaaggggagggccagactgcaggcagccgtggggagggcccctccttctgctcctcacccaccccatgatgtgcgggtggccaagcctcaggagctcggaagctactcagaaggtggctggcctgccctggttctacaggaggaggctcgaccagctgctgcagctgcttgcaaatgacaggcccgggattgatggccgtcgagttcaggggacctggactaacctcagcaccgctgctgctggctggcccgtcagctggtgcccaaacaccaagccaaagagctggaagcagtgcggccgtcacctgcccctgaagactgacgcgtccgacagcccgatattcttgacgcaggcctcagaggacccgctgctaccttcccaggaaaatgagaaagcgggcggggctgctggtttgcctccggaggcacacattggccctgggctctgcacactcaccggccccactggcagcagtgccttccaaaagggggtgcccccaactgccccacacatctgccctgtcctgcaggccatcaccaggactggcctgtgtgggagagggctttaaagtgaaataaatttaaccttttcatgggaataaatattaatgcccaataaaacctggagatcttattacttagtatcgccacagcaccggacgtgaagagctcttcactgctctgagactgctcccagggaggccagagagagatgctgaccccacccggatctccccaggaaaagcaacaagtgaggccctccccgcccttcccctgcatccacagcccacccagacctccccgggtaaagcaccgagtgaggccctccccgctatccccttgcatcccaacccatcaccagcatccattgcccacttgggttttttggagatcaaaataaactatcaaaaaaaaaacaaaaacctggtaagaaacagaggacagagaagatttttttttttttttttttgagacggagtcttgctcttgttgcccaggttggagcgcaatggcacaacctcggttcactgcaacttctgcctcctgggttcaaagtgagatcctgtcttgaagacaacaacaacaacaacaacaacaaaaacaaaaaagacaacgtagaaaacggaggtggggaagataaagtggaacactagttctgaaagcccaatagcgagtgatgggagtttgaaatagaaacaagaaagacaggagagcaaataatcaatgaaaccattcaagaaagtttaccagaatcatgggaaaggttggaaaagatggatggaaaggcccaaggaggggcaagtgacaaaaatcagacacgtatcaggtacccaatgaggggacttcaggacacttgggacacaaaaagggttcaataagcctccagaagggagaaaaacaggtcccacaccaaggatgaggaatcagaggagcatctttgtgccagcagcactgaatgagaaccacggatgggtgcagccttcgaagggacttcgatacccagccaaactatccgccacccagacagcagcttctcctgcacaagttcttctactttgttgcctaaccatcctgtggagtttttggtttcattttcaaattctgccctttccttatttctcaaggttctggaggctggaaagtccaagatcaaagcactggcagatttggtgtctgattacgccttctgagccataacgatcccatgcaaaatgcctgaaatccaatgaaactggagtgcttttgtaaactgtaataaaaaataaaataaaaaacatactgaatgccagaccttcctttaacatcatattgcaaaagaaatccgctccccagaggccgagtcccccctgctgttaatggggcttctactgaccatgtactacacatggaggctgccacggaggctacacactgaggaagccccttggccaccagccctggcccagctgggggctgtgtctgcctctgcctctgtgccctgccttgctctgcacttggacaagcacttttgaagcccctcctggtgggg

SEQ ID NO: 462847 - DNA, 1661 bp, Homo sapiens
ctaagcttcagcctttagggaggaaagacaaggggtgctcccagggaaggcttttcaagtccccaccttttcactccacaccactcatgccctggcatattcctctgctcaccctcacagtgtgagtgcatctccatccatgtgggccaggccggagtgcagatgggcaatgcctgctgggagctgtactgcctggagcacgacatccagcccagtggcaccatgcccagccacaaggccctggggagcagtgataactccttcaacaccttcttcagggagacccagcctggcaggcatgtgtcctgggctgtctgtggacctggagcctgctgtcatagcacaatgaagtcgctgtagagggaagggaccactgaaggtgccacctgctctccccgtctcaagcccaggcaggacctggccttagaagtgggtctctggtcgggaggctgaggcaggagaatcgcttgaacccgggagacagaggctgtggtgagccaagatcgcgtgattgcactccagcctgggcaacaagagtgaaactctgtctcaaaaaaaaaaaaagaaagaaaagaaaaagaagatgccgtgcatcatcactctgttgagcagttgtacctggggaggcttagcagcaaaggttctggtgtctggcgttcccttggggaatgaaccagcttgtcttacctttgtcctttcttcccctcaagatggggtaagaactgacatttataggcagctgttccaccctgaacagctgatatctggcgtggaagatgctgccaacaactgtgcccgtggccactacactgcggggaaggagatcatcgatttgactgccttcatggtagacgaggccatctatgatctctgctgccacaacctgcgccctacctataccaacctgaactggctcatcagccagattgtgtcctccatcactgcttccttgtgttttgatggtgccctcaacgtggacctcacagagttccagaccaatctggtgccctaccctcgcatccactttcccctggtgacctactcacccattatctcagctaagaaggcctaccatgagcagctctcagtggcagagatctccagtgtctactttgagccctccaatcagatggccaagtgtgaccctcgccacggcaagtacatggcctgctgcctgctctactgtggagaagtggtgcccaaggacgagaatgccaccattgccaccattaaaaccaagcaaatatttgttggcatcaactaccagtcccccacagtggtgcccgggggtgctgtagccaaggtgcagcgggcagtctgcgtgctaaacaataccacagccatcactgaggcctgggcccgcctcaaccaaaagtttgacctgatgtatgccaagcgggcatttatgcactgttatgtggacaggggcatggaggaagtccccatagtccccaaaagacaagggcctcaacctactgtgtcatttgtcttaattcgctaatagcgtggctctgacatgggtgtgtatccttacttgtgccccctttctttcgtgtaagcaagacaagtctcccttgctatagcggttgattttttctattttactccagagtctttctccaaagctgttcctaggagactgctaacctactggttcctct

SEQ ID NO: 462848 - DNA, 1722 bp, Homo sapiens
gatccgatctctgtccagctgcgacccaatgggagtccccgccaggagacacaaccggcggctctccggggatttataaggtcccgccagcaaccgcgcgttgggattcgtggtgttgctggagacccgtatggtgtctgcagtcagcgaccctccaacttcaactactggatcaaccatgtgtgagtgcatctccatccatgtgggccaggccggagtgcagatgggcaatgcctgctgggagctgtactgcctggagcacgacatccagcccagtggcaccatgcccagccacaaggccctggggagcagtgataactccttcaacaccttcttcagggagacccagcctggcaggcatgtgtcctgggctgtctgtggacctggagcctgctgtcatagcacaatgaagtcgctgtagagggaagggaccactgaaggtgccacctgctctccccgtctcaagcccaggcaggacctggccttagaagtgggtctctggtcgggaggctgaggcaggagaatcgcttgaacccgggagacagaggctgtggtgagccaagatcgcgtgattgcactccagcctgggcaacaagagtgaaactctgtctcaaaaaaaaaaaaagaaagaaaagaaaaagaagatgccgtgcatcatcactctgttgagcagttgtacctggggaggcttagcagcaaaggttctggtgtctggcgttcccttggggaatgaaccagcttgtcttacctttgtcctttcttcccctcaagatggggtaagaactgacatttataggcagctgttccaccctgaacagctgatatctggcgtggaagatgctgccaacaactgtgcccgtggccactacactgcggggaaggagatcatcgatttgactgccttcatggtagacgaggccatctatgatctctgctgccacaacctgcgccctacctataccaacctgaactggctcatcagccagattgtgtcctccatcactgcttccttgtgttttgatggtgccctcaacgtggacctcacagagttccagaccaatctggtgccctaccctcgcatccactttcccctggtgacctactcacccattatctcagctaagaaggcctaccatgagcagctctcagtggcagagatctccagtgtctactttgagccctccaatcagatggccaagtgtgaccctcgccacggcaagtacatggcctgctgcctgctctactgtggagaagtggtgcccaaggacgagaatgccaccattgccaccattaaaaccaagcaaatatttgttggcatcaactaccagtcccccacagtggtgcccgggggtgctgtagccaaggtgcagcgggcagtctgcgtgctaaacaataccacagccatcactgaggcctgggcccgcctcaaccaaaagtttgacctgatgtatgccaagcgggcatttatgcactgttatgtggacaggggcatggaggaagtccccatagtccccaaaagacaagggcctcaacctactgtgtcatttgtcttaattcgctaatagcgtggctctgacatgggtgtgtatccttacttgtgccccctttctttcgtgtaagcaagacaagtctcccttgctatagcggttgattttttctattttactccagagtctttctccaaagctgttcctaggagactgctaacctactggttcctct

SEQ ID NO: 462849 - DNA, 1497 bp, Homo sapiens
cctcccctgccccctcagcctgcgggcagcagaaggcggcggccagcctcctcctgcccctcggccggacgaaccgcggctgccgcgcctgtcacctctgcacctgcccggctgaggtgagatgcctggcgcgcaagaaaaatctgaaatttgaaacagaaatggccacataaggacaactcagatgaagtgcaggcgggctgacatcgcgcacttgggtctttccgggaaagacagccgcgctctgggagaagcctagtcctccggcttgtccccggacccgccccaaaggccgctgggagctcggtgaggacgtggcggtccccttgctcatctgactccggaggcaggttccgcagaaagagctctcaatctcggccgctgggctccaagataatctcctggcgaaagctaagaggcggccatcccttcccggggactcagcccctagattcagcttcttccgccgcaaaaaactcccaagccctgcgaactcgcaacttgcctctccaggcttccggcgtgggcgtcccagctacactttcgagcactttgcttggccggcatctacccgctcttcgattaaggaaagcgcagtggggacagaggcaactcctgcctcctgtaccaggcctacgtagtcgcccaggtggccgggtcacaaataaacaattccaccatcaagaaacccgctaacctctgtaccccgctaacctctgaaaacctaatactgatccaggtctcccaaataatctgaatctcccccagtccttccggtggaacagctagcctgagcgcagggaaaattgacaaggagccttcagctagccttctagctttgagcttgagtaggggcatggctacttggtggcttctttgcggtttattggtgtatttggtgactctacagatccagatcagcccccaccccactcttcctcaccacgcctccccacccccaccccaccaccgcaagttggtgtctctagaagagcctcagggttctgagtcccgggggcggacatggttgagagttactagggaggacaggagggagatccaggagcagcacagagcaaacgcctgggcaacacctgcaccaaggaaacctgggcaacaccacctcacctcaacaagagttttaatgcagcatttgcacagagcaagacggccagtgagactggatttgccatcaagggagagaaaaagtagcctgagaaaagaggctgccaacattccactgagaagtccaaaatggggaaaaggcaaaaataaagaggggaggtcttcttgcatttcaccctcttcccttccctttctggatcccacaggaagcggtggtgaagccaccaaagctgactggcacccagagagaaggctgaccaagggctggtctgaggcgggcaatggggatcctgatgagcagaataagagcttagcagcatgatcccagttgattgcccatagccctaggtgactgcctccaggttgccttcc

SEQ ID NO: 462850 - DNA, 2822 bp, Homo sapiens
ttgggaggccaagacgggcggatcatgaggtcaggaaattgagaccatcctggctaacacggtgaaacccgtctgtactaaaaatacaaaaaattcgccgggcgtgttggcgggcgcttatagtcccagctactagggaggctgaggcaggagaatggagtgaacccgggaggcagagcttgcagtgagcggagatcgcgccactgcactccagcctgagggacagagtgagacctggtctcaaaaacactcctaatttcaacatcaatttccttgtgaatctatcttatttttgtgtgtcagaaacacttttggatttgaagataatttcaaaacaatactaactctgtatttttttaaggtattattgtttacttatgtttatgtgttttcattttgcccaagacctttgtccagagcagagcctaaaagattccttccaaaaagtgatagtgacaagatatgaaaaacgtgaatatggcaatttagagttaaaaaaaggttgtgaaagtgtggatgagggtaaagtacacaaaagaggttataatggacttaaccaatgtttgacagctacccagagcaaagtatttcaatgtgatacatatgtgaaagtctctcatatattttcaaattcaaacagacataagataagagatactggaaaaaaacctttcaaatgtatagaatgtggcaaagctttcaaccagtcctcaacccttgctacacataagaaaattcatactggagagataacctgcaaatgtgaagaatgtggcaaagccttcaacaggtcctcacaccttacttcacataagagaattcatactggagagaaacggtacaaatgtgaagattgtggcaaagaattaaagtattcctctacccttactgcacataagagaattcatactggagagaaacggtacaaatgtgaagattgtggcaaagaattaaagtattcctctacccttactgcacataagagaattcatactggagagaaaccctacaagtgtgataaatgtggcagagcatttatttcatcctcgatcctttatgtacataagataagtcatactgaagagaaaccctacaaatgtgaagaatgtggcaaagccttcaagctctcctcaatccttagtacacataagagaatccatactggagagaaaccctacaaatgtgaagaatgtggcaaagccttcaggcgctccttagtccttcgtacacataagagaattcatactggagagaaaccctacaagtgtgataaatgtggcaaagcatttatttcatcctcactcctttataaacataagataagtcatagtgaaaagaaaccctacaaatgtgaagaatgtggcaaagccttcaagcgctcctcaacacttactatacataagataagtcatactgaagagaaaccctacaaatgtcaagaatgtgacaaagtcttcaaacgctcctcagcccttagcacacataagataattcatagtggagagaaaccctacaaatgtgaagaatgtggcaaagccttcaagcgctcctcaaaccttactacacataagataagtcatactgaagagaaactctacaaatgtcaagaatgtgacaaagccttcaagtactcctcagcccttagcacacataagataattcacagtggagagaatccctacaaatgtgaagaatgtggcaaagccttcaagcgctcctcagtccttagtaaacataagataattcatactggagcgaaaccctacaaatgtgaagaatgtggcaaagcctttaagcgctcctcacagcttactagtcataagataagtcatactggagagaaaccctacaaatgtgaagaatgtggcaaagcttttaacttgtcctcagaccttaatacacataagaggattcatattggacagaaagcctacatagtgaagaacatggcaaatctttgaaatattcctcaacccttaataaacataagataattcatactggagagaaaccgtataaatgtgatgactgttggaaagcctttgaccacccctctactcttactaaatatgagaatttatatgaaacataactcctacaaaaataaagaatgtgacaaatcattttaaggaagttctcaacccttactacacataattcatactggacggaaactctacaggtgtgaaaaatgcagcaaagcctataacaagttctcaattctttttttttttttttaagaaggagtttcatgcttctcacccagcctggagtgcaatggcacgatctctgctcactgcaacctcttcctcctggttcaagccattaacctgcttcagcctccaccaccatgcccaactaatttttgtatttttggtagagacagggttttgccatatttaacaggctggtctccaactgtgattcacacaccttggcctcctaaaatgctgggattacagtcatgagcatccatgcccagccacaagttctcagttcttaagagacatggtgataattcatgctgaagaggaactttacaaacttgaaagatgtgacagtgcttttaccaccacctccaacttttctgtacataaagatgattatactagtgtgaaaccctagaaataatagaaaatttgacaaatcctttatatggttgcaagacttgattgtagaagaaaagcacaattattgaaacaaaacaacttattttaatttggtgaataacagaaaacaccttcaaaatgttgaaagcaaatctacactttctgctttgtattgaatttattaatgtaaaattttatagcttatgtttcaaa

SEQ ID NO: 462851 - DNA, 3070 bp, Homo sapiens
agagcagcaaccaccgtagcaccagctcccgagctcctttgcaagctccatcaacagctccagctccagggctaaggcagtcccagcaagagcaccagatccagccatgcagccactgcaggctctggccccaactccagctccagagcccaagccagttccagctccaggtcttgagacaacaacagaacctgctgctgactgccctggaggagacgactatacgctgaaagcttatgggaccttgcaggtccatgctggcaaaagcctgggcagcaggagtgggagtcgcattggcaagggaggcgccagcgtctttgaagagccctgtgcatggctgtcctttacacagtatgccacacagtatgccacgggggcaggatgggaattagagagtgtgacccacaaggatacgtggtgtggggtgaagacgctgagagcagcaaacagtgtgaaaaccaaaacttcagcgcacatgggctttcctcaaagtgtgacagtggaaccgaatgcatggagtccgaacacggctggaaaatccagacctagacagtcacaatggcttagtgaggaaataccatttaaatcagtgaaagctcagcaggcctcacttagggtggccgtccacttttccaccttgcccagagaccacctgctgaactcctgggcacaggtcattcctttccactttgatccctggatcaaaggtgccggggcccgcagaggcaaggttgaatctttccacgcctctgcccggtgtccactctggctgtgcttgaggagcccttcagcctgctactgcactgtgggagcccttctctgggctggccgaggccgcagccagctccctctgcttgtagggaggtgtagagggagaggtgtgggccggaaccggagctgtgcagggcgcttgcgggcagcacgagttccaggtggtcgccggcttggtgggccctgcactcggagcggccagccagcactgctggccttggacagtgaggggcttagcacccgggccaagagctgcggagggtgcactgggtcccccagcactgccgacctgccagtgccgtgctttaattctcgccaggcctcagctcagccgcctccccagggggcagggcttgggacctgcagctcgccatgcctgagctcccccgcccgccatgggctcccgcttgacccgagcctccctgacgggcactgccccctgctccgtggtgcctggtcccatcgaccgcccaagggctgaggagtaagggcacgtggggcgggactggtaggcagctcccctagctccccgtgcaggatccactaggttaagtcagctgggcttctgagtctggtggggacttggagaacttttatgtctagctaaaggtgtgtaaatgcaccaatcagcaccctgtgtctagctcaaggtttgtaaacgcaccaatcagtgctctgtgtccagctcaaggtttgtaaatgcaccaatcagtgctctgtgtctagctaatctagtggggacttggagaacttttgtgtctagctaaagaattgtaaatgcaccagtcagtgctctgtgtctagcttaaggtttgcaaacacaccagtcagcaccctgtcaaaatggaccaatcagctctctgaaaaatgggccaatcagctctctgtaaaatggaccaatcagcaggatgtgggtgggagatttctgatttctcagatatttcccaatagcgaattggcaaatgattggtgtcaaaataggcagaataaaaacttgggggttggagatgtgagttgaaatgtcaggaacatctctcactggcagccttgccttcgacaactctctttcccttttgttgcaagattgagttagtaattctactcttataaaccacggctaaaatactctcttcagaaacactgctaaagacagcgagcgtctctgtaattcaaggctctcattccaacgtgattctcatcattatcctccatataactgaaatgaaaaccaatcttttacagactgttcctatgaaggatccttctgccttttcataacctgtgtgctgttgtttaattctcatggagaatgacaagttccactaaaatatgcacatggcatctccaagaaacagaagcaagaattaaagtgaaggggtggtaggcaaaaaaggccaagaatgaccatgattagaccaaggaacttccacttccaagccgtagctggctgcatcctcttcatgactcttgggaaaatattttctgtggagtctaaaagaaacaaaaatacacctgaaaagaaaaaaaggtaagcattccttacaaaagagaaaatttcccttccatgttatgtgtctacagacaaatatttttcttcacatgcacttttggagtaaggactatatgcgtagctatagtttacacctgtatatactcaggaagtatttggattatgatggtatgatgatagttgttaaagaaagttcttttgcatgtgaaaaagaaagggaagacaaggcaaacagcagtctgttcagcattatcctttcaatgaattctacccttttatacaataaaaagctgtggctgtattataggccctgggttaaataaaagcaaaccacactctttgttcaataatagttttatttacttatttcactgttaacttggggataatattcaccacaaagttgcaggcatcattttatagtacagactacagacgattgactttttcaagattaaaaatgaacatggtttgtgacacacctgaaatgcctactgaggaagtgctggccacgaggtaataaaaaaaggtaaaattcagtgcctttggcaaagatgtggacactgttttagatgcgagtatgatacatgccctttgcttacaaagcaaatatacacccatctgtttttggactgcggtttctctatccaccagagagcatctttaaatgattcacagacatttccctgagagcttcctgccaagagaaatcagcatgctgattcaccatcgtggaagcccatttttatgtaattattcctcagtaggccttcaggtgtgtcacaaacg

SEQ ID NO: 462852 - DNA, 3133 bp, Homo sapiens
agagcagcaaccaccgtagcaccagctcccgagctcctttgcaagctccatcaacagctccagctccagggctaaggcagtcccagcaagagcaccagatccagccatgcagccactgcaggctctggccccaactccagctccagagcccaagccagttccagctccaggtcttgagacaacaacagaacctgctgctgactgccctggaggagacgactatacgctgaaagcttatgggaccttgcaggtccatgctggcaaaagcctgggcagcaggagtgggagtcgcattggcaagggaggcgccagcgtctttgaagagccctgtgcatggctgtcctttacacagtatgccacacagtatgccacgggggcaggatgggaattagagagtgtgacccacaaggatacgtggtgtggggtgaagacgctgagagcagcaaacagtgtgaaaaccaaaacttcagcgcacatgggctttcctcaaagtgtgacagtggaaccgaatgcatggagtccgaacacggctggaaaatccagacctagacagtcacaatggcttagtgaggaaataccatttaaatcagtgaaagctcagcaggcctcacttagggtggccgtccacttttccaccttgcccagagaccacctgctgaactcctgggcacaggtcattcctttccactttgatccctggatcaaaggtgccggggcccgcagaggcaaggttgaatctttccacgcctctgcccggtgtccactctggctgtgcttgaggagcccttcagcctgctactgcactgtgggagcccttctctgggctggccgaggccgcagccagctccctctgcttgtagggaggtgtagagggagaggtgtgggccggaaccggagctgtgcagggcgcttgcgggcagcacgagttccaggtggtcgccggcttggtgggccctgcactcggagcggccagccagcactgctggccttggacagtgaggggcttagcacccgggccaagagctgcggagggtgcactgggtcccccagcactgccgacctgccagtgccgtgctttaattctcgccaggcctcagctcagccgcctccccagggggcagggcttgggacctgcagctcgccatgcctgagctcccccgcccgccatgggctcccgcttgacccgagcctccctgacgggcactgccccctgctccgtggtgcctggtcccatcgaccgcccaagggctgaggagtaagggcacgtggggcgggactggtaggcagctcccctagctccccgtgcaggatccactaggttaagtcagctgggcttctgagtctggtggggacttggagaacttttatgtctagctaaaggtgtgtaaatgcaccaatcagcaccctgtgtctagctcaaggtttgtaaacgcaccaatcagtgctctgtgtccagctcaaggtttgtaaatgcaccaatcagtgctctgtgtctagctaatctagtggggacttggagaacttttgtgtctagctaaagaattgtaaatgcaccagtcagtgctctgtgtctagcttaaggtttgcaaacacaccagtcagcaccctgtcaaaatggaccaatcagctctctgaaaaatgggccaatcagctctctgtaaaatggaccaatcagcaggatgtgggtgggagatttctgatttctcagatatttcccaatagcgaattggcaaatgattggtgtcaaaataggcagaataaaaacttgggggttggagatgtgagttgaaatgtcaggaacatctctcactggcagccttgccttcgacaactctctttcccttttgttgcaagattgagttagtaattctactcttataaaccacggctaaaatactctcttcagaaacactgctaaagacagcgagcgtctctgtaattcaaggctctcattccaacgtgattctcatcattatcctccatataactgaaatgaaaaccaatcttttacagactgttcctatgaaggatccttctgccttttcataacctgtgtgctgttgtttaattctcatggagaatgacaagttccactaaaatatgcacatggcatctccaagaaacagaagcaagaattaaagtgaaggggtggtaggcaaaaaaggccaagaatgaccatgattagaccaaggaacttccacttccaagccgtagctggctgcatcctcttcatgactcttgggaaaatattttctgtggagtctaaaagaaacaaaaatacacctgaaaagaaaaaaaggtaagcattccttacaaaagagaaaatttcccttccatgttatgtgtctacagacaaatatttttcttcacatgcacttttggagtaaggactatatgcgtagctatagtttacacctgtatatactcaggaagtatttggattatgatggtatgatgatagttgttaaagaaagttcttttgcatgtgaaaaagaaagggaagacaaggcaaacagcagtctgttcagcattatcctttcaatgaattctacccttttatacaataaaaagctgtggctgtattataggccctgggttaaataaaagcaaaccacactctttgttcaataatagttttatttacttatttcactgttaacttggggataatattcaccacaaagttgcaggcatcattttatagtacagactacagacgattgactttttcaagattaaaaatgaacatggtttgtgacacacctgaaatgcctactgaggaagtgctggccacgaggtaataaaaaaaggtaaaattcagtgcctttggcaaagatgtggacactgttttagatgcgagtatgatacatgccctttgcttacaaagcaaatatacacccatctgtttttggactgcggtttctctatccaccagagagcatctttaaatgattcacagacatttccctgagagcttcctgccaagagaaatcagcatgctgattcaccatcgtggaagcccatttttatgtaattattcctcaagcctgcaccaaacttggtaacagttcctatatttaaaagaaagaagggctttgcccaaactgtggccatcacatagctctaagcagac

SEQ ID NO: 462853 - DNA, 982 bp, Homo sapiens
agaaagaaatattttgggtgcatttcatagtcccataatgttttataatagatttgttgaaacagaattcatataccacgaaattcattcttttaaagtgagcaattcagtggtttttagtatattcacaaaattgtgcgccatcaccactaattccagaacactttcatcacacccaaaagaaaccctttatccattagcagttactccccattccaccctcccaccttcacccaccactccagcccctgactcagcccacctgcacacaagtgaaataaacagccatgttgctcacacaaagcctgtttggtggtctcttcacatggacgcgcataaaatttggtgccatgactcggattggcggacctcccttgggagatcaatcccctgtcctcctgttctttgctccatgaaaaagatccacctatgacctcaggtcctcagacccaccagcccaaggaacatctcaccaattttaaatccgatcttctcagcttagcggctgaagactgacgctgcccgattgattgcctgggaagcctcctggaccatcacagacgccttgggtaactcttacagtggaggacaggaatgtcaggccggcctctgagcccaagcatgcatgtatacatccagatggcctgaggcaactgaagaaccacaaaagaagtgaaaatggctagttcctgccttaactgatgacattaccttgtgacattccttctccgggacagtgagtctccggagctccccactgagcaccttgtgacccccgcccctgcccgcaagagaacaaccccctttaactgtaattttccaccacctacccaaatcctaaaaaacggccccactcctatctcccttgctgactcctttttcggactcagccaacctgcacccaggtgattaaaaagctttatttctcacccaaagcctgttggtggtctcttcacacggatgcgcatgacagtgattatat

SEQ ID NO: 462854 - DNA, 1021 bp, Homo sapiens
cgcctttcatctgcatgctcacagctccagactgatggcaaatggagagatttacaggtcagaatgaccaggttcaaatccaagctttaccactacttattaactgtgtgactctagaaaactttcctaaattctctgagccttattttcttcatttggaaaatgggaatagtcatattctctatagacatattcatctcactggattgttgagcactaaagagatagctaagactgtttcaggaagccaagttcagggaaatgacactggaactgggttctcaagtataattaagagtccactggtgggtaatggaagaagccgcttctcgggaggagaagaaaaaggctttgcaaaggcctaccagacaaaaagcatggctttaacacctgtacatgttggtgtggctgcggaatgggaaaaggccactgagttccagtcccaggtgcacggctgaccatgtgatcaagagcccttcccttgttatctttgaagactcaggttctcagttctaccggtcagactccaggtcttatatcttgaaactgtaagtccctgaattcacagacaattcagagtaaggatggaggcaaagaagaggaccttgggtttactgttcacgagatgacctcataaaggtgttcagtgatgaagaggagtggctgaagagatggctgtctagagtcaacacaaacctaccccaaagtttgacctttgccttaagtcagtaactgaggagggccacggtcctgagttcagtccagaccccaggaagattcagagcctgcagttgtcctctggtttctaaagtatgttattgggctaaagatttcaagacatttatccttctttgctttctatcgcagccattaaatgttttagatattttctgccagaaggcaggaatcatgaagataacaaatattaaagacaaaaccaaataacttttaatgagaaggtcagtccgtggtttgagtctttggaaagaaatcaagaactctgactatacttgctatttga

SEQ ID NO: 462855 - DNA, 982 bp, Homo sapiens
cgcctttcatctgcatgctcacagctccagactgatggcaaatggagagatttacaggtcagaatgaccaggttcaaatccaagctttaccactacttattaactgtgtgactctagaaaactttcctaaattctctgagccttattttcttcatttggaaaatgggaatagtcatattctctatagacatattcatctcactggattgttgagcactaaagagatagctaagactgtttcaggaagccaagttcagggaaatgacactggaactgggttctcaagtataattaagagtccactggtgggtaatggaagaagccgcttctcgggaggagaagaaaaaggctttgcaaaggcctaccagacaaaaagcatggctttaacacctgtacatgttggtgtggctgcggaatgggaaaaggccactgagttccagtcccaggtgcacggctgaccatgtgatcaagagcccttcccttgttatctttgaagactcaggttctcagttctaccggtcagactccaggtcttatatcttgaaactgtaagtccctgaattcacagacaattcagagtaaggatggaggcaaagaagaggaccttgggtttactgttcacgagatgacctcataaaggtgttcagtgatgaagaggagtggctgaagagagcttcagcaagcaaccactaggataatgttaaagatcttcagtggtaagaagacaaggagcaaagatttttatcttactttgtgattttcataattaaaaaagaaagaaaggaaagagacgaggtcttgccacattgctcaggctggtcttgaactcctggactcaagcaattcttccactgtagcctcctgaggtggcaggattacagcataagccaccatgcctggcctcagtcacactttggaaaagaagactatggatctacatgttcattttgtggtcgaattataaccaacacgccactctatc

SEQ ID NO: 462856 - DNA, 997 bp, Homo sapiens
cttagctgcctcacctgcaaaatgcaaggatgtgacccactgaattctatggttcctactgaactaaaaatatttggtatccaagggtgtcagaggtgtcctcggagacgtagagtgaagaaccacccagtaggacacaagggagaccaaagtaagcaagagaagtcaaagcagggggtgattctgggaaatacctggggccagtttggaatcacggcttttgtcccctctccgagaatgaataatcaccaagaaaagagaggccgtgcagtcaccgtgggccctgagacagccttcaggatggaaaccagctatgaagatgctggggcagaaagattcatgctggctgactgccttggggggccatccaggagcagcagggagcccacctccagagctcctttattggagaaagaaataactctttctctctcttctctgtggtgctgttattctgggttttctgctatgtgtaggcaaaactaatcctaaccaagataccagcttttcattgaatctgtgtgtgaacttgaaccagacgattttttctctggaacttatttcctctacacaagaggcaggggtgtgggtgctttgtgtaattctgaagatccggagctttttcctggcccacatccatgttcacttctaattgttatagtgcctacattaccatttagggaactagccactccctgcaattccatatggttaagtgaggctaataccactttctggctgcaggggacaggacaggtgggaacagatgttggaggaaccattggtgccttgagcatgttctgtgcagggggtctcccgtgtttgccctgtctgcatcccacgtgggccccgtgtgtgtgagcattgacagtaggcacagctgctcgggaaagggtccacctgtgtcttccccaggaagacagtcccaactggaccttgattcaccatcctgcctgaccatcccctgtggaactgttagctctcagcatccacacat

SEQ ID NO: 462857 - DNA, 1216 bp, Homo sapiens
ggggagggaagagtggggtccgccattcctaggtgcttcttgagcaagcaccccacagttcccaagtggaaaaggtttttgttgttgttgcttcgttggtttgttttcagaatgggagttaaaaaccaaacaaaaggccaagcgcagtgactcatgcctctaatcccagcatttagggaggccgaggtagggttgcatgattccagaggttcaagaccggcctgggcaacatagtgagaccccattctccacaaaaagggggaaacaagacaaaaacacaaaaactgtgaagacccccaaagcctggcccccttcctccctgctgagcaggtgaggcagtgctggaaagaggacagagtggaaggtcctggaagcccagcccagcattgctgagcgcctgccgtgtgcaggggaggggtcctagcccctgggtctgccagggagaggaatggccccgcagccgaagcccagggagccctgggagccggcgcctaattgttttgttgacgcggctgccgagcacttccagtaggtttcctaatgaactggtttgttatcggcctcactgcagcgctgataattacatcagaaacagggggcccactcgtccttcccacgcgttctgtgagccatcagcgcagatgcgggcgcctctgccccttcctcggtgctgacccccggcaggccctgatcccatatgtgaatcatgcactgatgacagctgctaccaccctgcttcagaaaagctcctctgtgcaggtcatcgccgtcaccacagacagtcctgtcaccgtgcagctgatgcgtcctgtggagggtggcgcctgttgccgcggtgcccccggcggtgtcggtggtgcgtgttgccatggcgcctgcctggtggaggaagtgtcccgcggtgcccccggcggtgtcggtggcgcgtgttgccatggcgcctgcctggtggaggaagtgtcccgcggtgcccccggcggtgtcggtggcgcgtgttgccgtggcgcctgcctggtggaggaggtgtcccgcggtgcccccggcggtgtcggtggtgcgtgttgccgtggcgcctgcctggtggaggaagtgtccctccgtttctggatttgccttaatagctcagagaaggctgagggaaacctgtgagtgattgtaaacatcccatgctagggaagggcttgtgaggccacacagggtggcttccaccagaatc

SEQ ID NO: 462858 - DNA, 1196 bp, Homo sapiens
gctcgcagccatgccgtccaagggcccgctgcaatcggtgcaagtcttcggacgcaagaagacagccacagctgtggcgcactgcagacgcggcaatggtctcatcaaggtgaacgggcagcccctggagatgactgagccgcgcatgctacaatacgagctgctggagccagttctgcttcttggcaaggagcgatttgctggtgtggacatccgtgtccgtgtgaagggtggtgctcatgtggcccagatttatgctatccgtcagtccacctccaaagccctggtggcctattaccagaaatatgtggatgaggcttccaagaaggagatcaaagacatcctcatccagtatgaccggaccctgctggtagctgatccccgtcgctgcaagtccaaaaagtttggaggtcctggtgcccgtgcttgctaccagaaatcctaccgataagcccatcatgactatcaaaattcacctgtataataaacagtttttgagggattttaaagtttccaggaaaaaaaaagttcattagctttttatgaaggatttatccttttttttcagtgtgctgtttattgctgagaagtggctgccctgccagaaaactgctattctcagctgtaaccacattgactaatagtgagtggaagtgcagtggataaaaagcaaatgtgtcttctctgtatcttttttcatttattggctgaagaacaggaggatgcggaagatggaagaaaatataatctctgaaagataatgaagaagctctcctaaatagaagaaaacctcataggggatttttttttcatcattttactctctgcttctatgcgtttaaattttttttttttttttttgagacagtctcgctctgttgaccaggccagagtgcagcggcatgatcccgactaactgctccctccacctcctgggttcaagcgattctgcctcagccttctgagtagctgggattacaggtgtgtgccaccacgcctgactaatttttgcatttttagttgtggtgcggtttcctcatgttggtgaggctggtctcgagctcctggcctcgtgatttgttcaccttggccttccaaagtgctgggattacgtgcatgagcccctgcacctgatggagtctcattctgtcgctcaagctgaagggcagtgccgtgatcttgacccactgcaacct

SEQ ID NO: 462859 - DNA, 2287 bp, Homo sapiens
tgcccccttccctgtgcatctctccagggcctggtacgatacccaacacatagcagagactgctatggagctgccccctgaggcctctaaggcccccttcactcatagcgtctacctgctcaaagggccctttagctcactcaccttccccgaggactggatgcccttaacgacagccatccccacgatgctccaggccacgaggaggcacagggtcatcttccagttgaggcccccactctccgagatggagtcagagatgtccaaggcctctcggtaccagaaaggcctggctgtctcctgcatcagtgagactggcgccagtgtgagagctgagggccgcttgcttcatcagtctcacctgagcacatgtgtgcaggagcagctgctcatagagcagacccttctgggagcacagacagacacacagccagccccagcagaatacacggcattggccagtgcaaagctgatggctgactgcctgccccagcccttgactcactatgcagctggagaagccgatgccccccaggcggggacatatatagtgccacacaccgatgctgccgcggcggatcctctgacccacagccagctccaggaagaagagggggatcccgatgatgatcagcagcaccagtcccggtgctcctccatgaatgatgtggccatacgtgtggcctaccacacagcagcccacccagaccctccttctcccccttgactcccctgacccgaaacactaagggaggaagtgtatggtagttctttatgtctggtgccatggtgattggtgtcactgtgaacaatcagactgtggcaagaacactgccctgggtggaaagatgcatcctggagaggaggggactgcgtctttggaaaaggttacatggcaagagttccacaagcaaggaaggaaggactggggtaaaatgcctgccaagctggggccacccaacaggctggagcatgccatgccaggcacagggactcaggagcacaagagctcttgctagttgactttcccaggaccagaggtaggggaacctccagatgttgccgaggcccacagagaagccaatctgggccaggatgtactgcagcttactgttccaggccggccggtcctctgcatccagctcctcctccaccgccttctgcttgccgcctgcctcaccagccacattcagtacactctgcttatagtccacaggctcctcgagggccagcaggtcggccacggactcagtgacatgctcactgctgtgctcacgctgggtcactttgctgttcttcggcattgatgccacctgggccgtgtagccctgctccccagcacacagagaagatggaattcagctgctgtcagctccttctcattcagggacctaggaaaccaggtgagcagtaaaggattatctgaccacaccaggaaggtgaggagcccaacgtggacacaacccaaattaactccccatcacactgtgaggcaggtcaagggcctcatatatgcagcttgccctagctccccatcaggggctgcccggtgaggagctcaaggcctacagactcagtttctccagaggcttgacccgagcattatttgaaaagtaaacctaaaggggcaaaataggcaaagccatactccgaacccaagtagagcattatccgtgaagacatttccctcttccatactgcagagcttagagtgctcaagcccctttggaggcccatacagccttccccttccaggtgttctgcttagccaaaaccacatggcggaagccacggaagccagcgccttccttccttagggccttttcattcaaaatgcagggattgcaccaggaactggttagaaaggggcatcttaggctcgcaccagacctcctgaatcaatctctgcctttttacaggatccccaggtgatttaaaaaaaaaaaaaaggctcttgagccatcaccagggggcccctggacaccagtgccgatggcatctccattcccctagctggactggttgaccaggctcagctaaagattctggcaccagaagccaagggctgtttgctcagtgccaatgaatcttgggtcattgctcagcactgacattatctgaggacttctgcagccaagagctggttctccatccttcagcgacagttttacagcagataatgtctgcacgacatgggcggaggaggcaaaaccctcccctactcctgccagtcctcatttgtctttcatgctttcccttaaagaaataaagcaccaagaaaacgaag

SEQ ID NO: 462860 - DNA, 8092 bp, Homo sapiens
aactgggcttttctgatgaacaaatccttacagtgaagacttctggcagtgggaccccatctgggagttcagcagattcttcaaccagctccagcagcagcagcagtggggtttttagttcttcatatgccatggagcaggagaaatccctccctggtgtagtgatggctctcgtatgtaacgtatttgacatgctttatcagctcgccaatctggaagagccaaggataactctacgagtacggaagcttctgctcttgatacccactgatccagccattcaggaagcccttgatcaacttgattctttaggaagaaagaaagaagtaggcataccatttcctctgggtgaggtaggcatggacaccagctcaaagcatgagcagaggatggttgaaggaattcctgaggggaggtctggcacagagaagctgggtagggaccttgaggaggtcgaggggatgggaaatagggaaatgatggcaaaaaggattcccaagtaccgtagaagaggagcagccagcgcacacccatgcgtggggacctgcctggtgccggcagaggccacaggaggccagtgtgatgaagacctcaccaaagatggtatagaagcactttcttcccgcccattccgaaatgtcagccggcagacaagcagacagatgtccttatgtggtaccccagaaaagtcatcctaccgacagttgtccgtgtctgataggtcttctattagggttgaggaaatcatccctgctgctcgagttgcaatacaaacaatggaagtaagtgatttcacttctactgtggcttgcttcatgagattgtcatgggctgcggctgcaggacggcttgatcttgttgggagtagccagccaattaaagaaagtaattccctgtgtcctgctggaattcgaaacagactcagcagttcaggaagcaattgcagctctggaagtgaaggagaaccagtagccctgcatgcgggaatctgtgttcgacaacagtctgtatccaccaaagactcgctgattgcgggagaggctttgtctcttcttgttacgtgcctacagcttcggagccagcaactggcatctttctataacttgccctgtgttgctgatttcatcattgatattctgctcggatcaccaagtgctgagattcgccgggttgcctgtgatcagctgtacactcttagtcagacagacacatcagcgcatccagatgtgcagaagccaaatcagtttcttctaggcgtaatcctcacggctcagctgcctctctggtctccaactagtattatgagaggagtcaatcagagactgttatctcagtgtatggagtattttgatttgagatgccagttattagatgatctgacaacttcagaaatggagcagttaaggatcagcccagctacgatgcttgaagatgagattacttggctggataactttgaacctaatcgtacagctgaatgtgagaccagtgaagcggacaacatcttactggcagggcacttacgcctcatcaagacccttctttcactctgtggggcagaaaaggaaatgcttggttcatcactcattaaaccattgttagatgacttccttttccgagcttctagaattattttaaatagtcattctccagctggcagtgccgccatcagtcaacaggactttcatccaaagtgtagtacagcgaatagccgattggcagcctatgaagtccttgtgatgttggctgatagttcaccttcaaatcttcaaattattataaaagaactgctttctatgcatcaccagcctgaccctgctcttaccaaggagtttgattaccttcccccagtggatagcaggtccagttcagggtttgtggggctgagaaatggtggtgcaacttgttatatgaatgcatcattactttcagtggatgatgacacagacaatccagatgatagcgtgttttaccaagtgcagtctctctttggacatttaatggaaagcaagctgcagtactatgtacctgagaatttttggaagattttcaagatgtggaataaagaactttatgtgagagaacagcaggatgcatatgaattctttactagtctcattgatcagatggatgaatacctcaagaaaatggggagagaccaaatttttaagaatacatttcagggcatctactctgatcagaagatctgtaaagactgtcctcacagatatgagcgtgaagaagctttcatggctctcaatctaggagtgacttcttgtcagagtttggaaatttctttggaccaatttgttagaggagaagttctagaaggaagtaatgcgtactactgtgaaaagtgtaaagaaaagtttccctggatgctaaacatggagccttacacagtttcaggaatggctcgccaagattcttcttctgaagttggggaaaatgggcgaagtgtggatcagggcggtggaggatccccacgaaaaaaggttgccctcacagaaaactatgaacttgtcggtgtcatcgtacacagtgggcaggcacacgcaggccactactattccttcattaaggacaggcgagggtgtggaaaaggaaagtggtataaatttaatgacacagttatagaagaatttgacctaaatgacgagaccctggagtatgaatgctttggaggagaatatagaccaaaagtttatgatcaaaattgtcaagacaagaaaaacttttatttacagatgtgtttcttaatgtcttgttataaagcaaacccatacactgatgtgcgccgaagatactggaatgcctatatgcttttctaccaaagggtgtctgatcagaactccccagtattaccaaagaaaagtcgagtcagcgttgtacggcaggaagctgaggatctctctctgtcagctccatcttcaccagaaatttcacctcagtcatcccctcggccccataggccgaacaatgaccggctgtctattcttaccaagctggttaaaaaaggcgagaagaaaggactgtttgtggagaaaatgcctgctcgaatataccagactaaattaaagcatccatattatccttgcatggcaaaggtgagcttacagcttgctattcaattcctttttcaaacttatctacggacaaagaagaaactcagggttgatactgaagaatggattgctaccattgaagcattgctttcaaaaagttttgatgcttgtcagtggttagttgaatattttattagttctgaaggacgagaattgataaagattttcttactggagtgcaatgtgagagaagtacgagttgctgtggccaccattctggagaaaaccctagacagtgccttgttttatcaggataagttaaaaagccttcatcagttactggaggtactacttgctctgttggacaaagacgtcccagaaaattgtaaaaactgtgctcagtactttttcctgttcaacacttttgtacaaaagcaaggaattagggctggagatcttcttctgaggcattcagctctgcggcacatgatcagcttcctcctaggggccagtcggcaaaacaatcagccaaggtccagacctccaggtccagcccagccagctacccatcagggccccagagggagctttgatgcaccacagtaatcatgtggacagtagtcgctgctaccagtgtgtcaaatttcttgtcactcttgctcaaaatcatatatcatgggtagtttaagtgacatgcctagagtcatagagtgaaaacttgaacacaggctgattgactgcaaaatgaaggttcttttttttttaattgtggtgaaatgtacataacataaaatttactatttgaaccatttttaagtgtatagttcagtgactttaagtacattcacactgatgtgcaaccatcaccaccatccatctccagaactcttttcatcttctgaaactgaaactctggacctattgaagactgactccctattcctcccttcccccagcccctgggggaagcaattgtaatttctgtctccatgaatttgactactctaggaaccccatttaagtagaatcacaaatataaagacaactgaattttaatgaaactagcatttacgtttcaaaatgaagcactaggaacaagcaaagaaagaatttggctaataaaaatctcctcggtcatcaggtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggtgagagttgtctcttgtttttgcgtggtctaaatcacttatggaggattttcagtgtgtttctcagaaactgcaacctctgagaagagaggtatgagttgaagatgagaacaagcagaagaaacaattggatttctatgaaaagaaaacagattggtgtacacttacacaaatttgtgcagattatttgtctagaaggaaagtcatacaggttgggcagtctggtcacaaaaagggacaggggttgagggggttctggtgactgtgatgaaggcctcactctcaggcctccggtcccactgaaggtcagatgaaaggtagtcttccctggcggttgctgctgccactgaatgggccctaactttgtcgtcttgtgtttgaatcttctgcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatcatgtgatctgcaatcgtttgcttttgcttaaaacataattactgaaacccttggtattggttgtatatgaagttaactatttgagttggtacacactgcttgtgagtttcatagttattgtaatgcagagaaggaatttgagaatttgtttctcctcaacatgactaattaacactgaaaagtcagtcaaggtttaagatttattttcccagaaataaatataaagcaattgaataaccatccatttagtcgtatttccaaagtatagcaccattcactcatttataccagctcccttttatggtgtgggggagaggtttacacccacatatttcatatatattttgtacattttgtattttgaattgctcacattttcggccctgttttgcctttagttacaggtcctgccttattttcatctcaccatgcacagaactagggagccttaggaagtgccaggttttcactgtcagatttgccaagtcacagaggcgcagccagccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaagcttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaaaacagagttggagtcttgccgccattcttcatatatcagaacacagccgtagtgggcgggggaacacgagcctgtgcctggtgctaaatgctgttgattcctcttagtactttacactaataaaggggactgtgggtcctctgagcctgttgctgttcttttctctggaggggctgaccatttcaggattcatctgcaaagcttagaggaggatgctgaacttaggttgatggtctccattcatctccaccaaagcttttggctctcccaagtggtccccagcatagatcgtgtcgctggtcacactgggcttcttgctagatcccacaggtctcagtctcattcctagtggccagcgttgctcacatgggtccccttccctatttgctagtccagattttcgccttcctgcaagccacacccctctgtccccattttgaatgtgcccccttgtctcaataaaccctttggagtaaa

SEQ ID NO: 462861 - DNA, 805 bp, Homo sapiens
cactctgggatgggaacaagctcagtagtgatagaacattcaccacagctccacttcttgagtgctttccatgcaatctcactaattctccaagcattgctgggagacaggtgcagtttcccctatgttagagatgagaaaacagaaactcggaaacttgcccgtgacttggacctgggctacccactttccactatccctgtgctctccaatcatgctccaggctttcttgaaactcaggttacagcttccatctgcatggaccattctttcaagagttttggttatgaagagaagtggaacgaaagagcccataagagaagtggagaggaagaacaaatggtgactaatggtggctgtgggcactgccttgctgatctgggttctcttgaggctaactgtgcagaacacttctagaataaatgaagatcatgtaacaaatagagatggtagtgctgtctgaagagtctctggagtatgtcactgtgcttcttaccaacatagggatgccttgactaaagtgggcctgaaatggctgaaaagaaaaacccttagtttctacagacagaaatgttgctaccctcaaagtgccacagcatgaacagaagacttgtctcacagaagtcaacagtcattgaggagatgcatgtagacatggagcagaacccctgtgtggtgggctgcagactgcttcctccaacctccctgccccatccccacacaaaaagataaccaaatcctaatctctggaacctgtaaatgtttccttattttgaaaaagagtcattgcagatgtgattaagga

SEQ ID NO: 462862 - DNA, 2910 bp, Homo sapiens
  misc_feature (859)..(859): n is a, c, g, or t
ccgggcccttggtcccccgcgcgggcgcgggtggatctctcgggctctgacttgttttcgggtcaccttcaggcttcagccaggcacctgacgcctctttcccctcacggtgccagggccgggccgaactacatttcccaggaggctccgcggccaggtgcaaacagcgccgtgctgactacatttcccagacagccttgcggcggcccgggccttaaagcgtccatttcccagcggccctccgctgcgagaccgcagcccttctctggagtctcagagccgcaagacaccacgactcccagaggaccttgcgtcgggcaagaaagactacaccttccagaggcctctgcggcgccgcgacaggaagcggcgggcgagccgagtgtccttgcgcgtggatccgagcgaccatggtggcccgggtgtggtcgctgatgaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcaggcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagcntcccgcttgccggcccaataaaggacttcagaagtgttccctgacccgtgtgctggccccagggagcacagggttggcctggtggtgcccagagcaccgaggcctgggcttctggctcctgatggcttgtcagggcttgaccttgaccacaggccatagcactcccctttgccgtctgctctggtgcggggagtcagaggtcagagcggctgctcccggtgctccagaggctgtgctctggggccaggaaagtgctttggccaagcctgggttgtggagggtcttggttttggagggctgagaccagggtaggacagtggaagagccagagtggacagaagtggggtctgcttccctgcgggacacagggcaggagcccccagggccactggttcctgccctcctcagctcctgtccgcagtcctgtcccggcccttccttggccggactccaccctcattccaccctctcccgacaaccctagcaggggaatcctggtcattgaaggaaatccaggtgtttgttgccattcagagggtctcccggacattgcctctcccctgggacgccttccctgacacccctgccgcacactggccaggctacctggcagcctgcatggttcccccgcatcaggcatgagccctgggaggctcccagcacccagccacagagggcgatccacggggttgggtgatggcaagaggcctgtgcccagaaaccagtctggtggctccagacacatgggggtggtggggagcttgggtggggccagaggcctccgtaggatgctgccctgggagcagggagcagacaggtgatgctcaccgagctgggacagggtccccgttcccatgagttcaggggtttatgttgcttggtatagggaactgagcttaggaggggacagctgttacagaggagaggagcagagactagaggccggggcatctcccccactgtcccactcagagaggagaagccactggcctgagcagggcgtaggaggggtgtggctgggagcagcggcctagtctggtagaaggggagtccacagggcctgcccaccccattccccccaggagcgtggtcccgggacaggtcccccacatctgatatgcccctgtccttactgggccttagcagtggtgggggcaggtctagggtgagggagggatgagcagggcaggggagcatcactgaccctcagtgctgcaggaggaagccggtgctcgccggagcacccacgcactcactgtcccctgacactgtccaccaagtccttcccgaaggcccaggaaggagcagactgcaggcccattttacagacgaagaaacttgcacagacagacagttctgtctgcccagcctgtccggagcccaggctgttcaccacaaaccctcgcaggggatgcagaatttctagtcgcctcgcacccaggcacccagccccagccccagccccagcctgtgaggacaggaggggtttgcactcggtgctgtgatgccatggctgggtcagagggcgtccgtccgctccaggaggcctctgcagcctcacacctgttaccgtcactgttagaggggaaggactggacgaggccagtgagcagctgctttctggcccctcccctccatccaggcggccgggtcctgcagctccacgaatgtggcttagttcttccctggggtcacaggctttatcccatgagttcgtcctcacccatccactggcacctgtgtgcaagaacatgcctggggtcaggggagttggggggccatggaagtggagctccagaaagcagaggtggctgaggcaggtctaggggtgactttgggaaggcgggaaggggctggggaaacacctgaccacacccacagccaagaccacagagcaaggcaaggctggcatgtggcacagtgccatttgacagctggggtcactcgatagctggaagcaggacgggctaggaacggagtccagggaaagctagcccatcacgatgtgggctgggcagagctagaagagagagcagggggagtccataggc

SEQ ID NO: 462863 - DNA, 1357 bp, Homo sapiens
tcctccaccaggctccacaggaaacgccagggcagggtttaaaggaaggtttatcaccccgactttacataaccagcatggcccagtctcagtcagagtcacataagaatataccccgagtaggtacccagcttctgttggaggcctgtgtccaagctacagtgccaatcttcatctacaccagtaccctagaggtagccaggcccaattcctacaaggaaatcattcagaacggtcatgaagaagagcctctggaaaacacatggtacgctccatacccacacagcaaaaagcttgctgagaaggctgtgctggcggctaatgggctgactctgaaaaacggtggcaccttgtacacttgtgccgtaagaccaatgtttatctatggggaaggaagcccaatcctttctgccggtataaatgaggccctaaacaaccatggaatcctgtcaagtttcagcaagttctccagagtcaacccagtctatgttggcaacatagcctgggcccacattctggccttgagggccctgcgggagcccaagaaggccccaagtgtccgaggacagttctactatatctcagatgacacgcctcaccaaagctatgataaccttagttacaccttgagcaaagagttcggcctctgccttgattccagttggagcctgcctttatccctgacgtactggattggcttcctgctggaaatagtgagcttcctgccgaggccagtttacacctgtcgaccgcccttcaaccaccacagagtgacattgtcaaatagcgtgttcaccttctcttacaagaaggctcagcaagatctggcatataagtcactttacagctgggaggaagccaagcagaaaaccatggagtgggttggttcccttgtggactggcacaaggagaccctgaagtccaagactcagtgatcgaaggatgacagagatgtgcatgtgggtattgttaggagatgtcgtcaagctccatcctcctggcttcatacaggtgacaagggcaaaagtccaggtcctgctgcctccctttcacataatagccaacttattgtcttcctcatgtcatcaaaacctgcccagtccctggcccaaccagaagctttttgtcctaatcatataccagaggaaagacaatgtgatttgctttttccatatctcagtggctgattccgaacaattgtagtctcttctaacttgaggtcatttttaactactagagctccatttctactcttaaatgagaaaggatttcttttcttttaaatctcctatttcttcacgcagtccaatgtaaagagcaataaatgttttaatccttaacctggagggaggtgtag

SEQ ID NO: 462864 - DNA, 3082 bp, Homo sapiens
cggtagaccccgagcctaccgctctgcttgcgttctcgggggtcggtgtcggtcttgggtctggccatgcctgagcctgcaaagttcgcgccggctcccaagaagggctccaagaaagccgtcaccaaagcccagaagaaagacggcaagaagcgcaagcgcagccgcaaggagagctactccatctacgtgtacaaggtgctgaagcgggtccaccccgacaccggcatctggtgcaaggccatgggcatcatgaactccttcctcaacgacatcttcgagcgcatcgcgggagaggcgtcccgcctggcgcactacaacaagcgctccaccatcacgtcccggagatccagacggccgtgcgcctgctgctgcccggcgagctggccaagcacgccgtgtccgagggcaccaaggcggtcaccaagtacgccagctccaagtgagtccctgccgggacctggcgctcgctcgctccctccctccctccctccgcgggtcgccggctgctttgtctccaaaggctcttttcagggccatttaaccacctcagttaaagaatctttcttgtgttgtcagtcccagttgatgtttttggcttcacgtctggttaactttaggagagcacacaacaccaagcacagataactattttcttttcacataggcattgctataagtaagcttacatagattgatagtggtatcttactatggcatagataggttggggcttgccttagagggctgctcttgaactgtctttggcctggttacgtacccgtgaatatgtgcccaggagattgtttcctgttgagaaacgcagtgttaattttgataagtttatgtaagatcaaattgtgtatatgaacaaaggttgggtccgctcttcagtggtaaaatgaaggtagagattaaatgcattgtatgctctcagatgtgtacttaaaagggaatagctcaacttttatatatggtatcgagaaacctgaggtttttatatcattggttcacaaacacgtgcctacaccaccactcatgtgaaaattccttaaggaggtagatggaagttcgattttgataaccaggagttaacaccgataaccttctgcgctttctagttgagataccctaaaatctacccaataccattaaatggtttttttccccaagagttatcactcggaaaagcttgtccagtttaagggtttgttccatacaatagcaacaaaatatacgatttctgaagccagagtttgggatccctgaagaggagaaggaccaccaatttgcaagggaggttgattaggtttgttttctgctttgggaacactggacttggaatcacacagcctcattaacctcaaaatattatactgattgctctggggatcgtaaatcctaggctggccacaatagaagcgaggaaagcaattaggaggctgttgcagtgttgtgggctggaacagtgattaagacttaaagtctctccagaccagcagcatcagcattacttgaagttactaaaaatgaaaattcccaggttccattatttgtgttaagctttctgggtgatggtgatatatgctaaagtgtgaaaaacaacggataaatgacatgctggagtgcaatggtggtaatggaaacaaatgttggattttatctttgaggtagaattaataggtgtggctgaggaacaggatttagctaacagtgaaacccctagatttttggcttgagcaactgtgtacatagtggtactattaggatagaacactgagagaagatattcgttgggacactgaagggagatccagagttccgactgaaatttgagaagctctttgctattcaagtggatatgtgcagttgacagtttgagagatgcatctagggttcagtaaagacaacacaagcctgtctttagggtctacctgtgaactgtgaacacagcaatgagaatgatggacatcacctttaagtatttttctagactttattactcatgtgtttgtcatgaggtgtaacttagtagttcatagtcctataatgtatgttattgactaggtagcatttatttttctaattgtttctgttatagtgctgccacatgtgtttcccagaaacgcattttacccacagttcttagggttggcctgattagtttaattgctgtctgaacctgcttcttactgtgattagttcaggaatctagatcaaactcattggcatttaacatttcaggaagtgaactgagtaacaactaactcagcaggggagtgtctacaggtgcggaaggaaagtttatatggtgaggcttggtcgcaaaactattaggaatattttcaggttactacacaattttgcgagctcaatatgcagttaacactttttccctcgactctcctgagcagatttacattgaccgcacccgtagcatatcgtctcactttggaaaaggcaaattatgtgcacatgaccctgtcactacaaggtagttctcgaccaagctacatcttatagctttatcttatattcctctcccatcatctgcaggaaaagggataggtgctgagggaaaacccctaagtagaactcacagtaagcagtgggaaaacagcttatttcactaacggggttaagtggccctgaaaagagcctttggagacaaagcagccggcgacccgcggagggagggagggagggagcgagcgagcgccaggtcccggcagggactcacttggagctggcgtacttggtgaccgccttggtgccctcggacacggcgtgcttggccagctcgccgggcagcagcaggcgcacggccgtctggatctccgggacgtgatggtggagcgcttgttgtagtgcgccaggcgggacgcctctcccgcgatgcgctcgaagatgtcgttgaggaaggagttcatgatgcccatggccttgcaccagatgccggtgtcggggtggacccgcttcagcaccttgtacacgtagatggagtagctctccttgcggctgcgcttgcgcttcttgccgtctttcttctgggctttggtgacggctttcttggagcccttct

SEQ ID NO: 462865 - DNA, 4250 bp, Homo sapiens
  misc_feature (2)..(3): n is a, c, g, or t
  misc_feature (5)..(5): n is a, c, g, or t
  misc_feature (11)..(11): n is a, c, g, or t
  misc_feature (14)..(14): n is a, c, g, or t
tnnangttttnatngctcctgacatcaagtgctgttcacaagtggggtactgaaattcatgaaggaatttacaacatgttgatgctattaatagaactggtcgcagagagaataaaacaagatccaattcccattggtctcctgggtgtgcttacaatggctttcaatcctgataatgaataccattttaaaaacagaatgaaagtgtctcaaaggaattgggcagaagtgtttggagagggaaatatgtttgctgtttcacctgtatcgactttccaaaaggagcctcatggatgggttgtggatttggtaaataagtttggagaattaggtggatttgcagcaatccaagccaagctccattcagaagatatagaacttggggctgtctcagcactgattcagcccttaggagtgtgtgcagagtacctcaattcctccgtggtacagcccatgctagacccagtcattcttactacaatccaggatgtacggagtgtagaagagaaagacctcaaagacaagagattggttagcatccctgagctcttgtctgccgttaagttactttgcatgcgcttccaaccggatctggtgacaattgtggatgaccttcgactagatattctattgcgcatgctgaaatcaccacatttcagtgctaagatgaattctctcaaagaagtaaccaaactaatagaagatagcactttatccaaatctgtgaagaatgctatagatacagacagattattagattggctagttgaaaactcagttctgtcgattgcactggaaggaaatgaagctgctcttggaggtgcttttactttaagtgctggaactgtcaaagaggtgctactgccaccaaggtttccagagtcccttgcagccacagccagcatctgcatccactctgaacctaagccagacgtacttcatccttcatcctgccactcatctcccagcgcttcctctcattggcagaactcaggacaatcatctactgtgattgagaacattcatactattattgctgcagcggctgtgaaatttaattcagatcagcttaatcatttgtttgttctcattcagaagctccatgaaattactcgctcattcataaaacaaacctatcaaaagcaagacaagagcattattcaagacttgaagaagaattttgaaatagtgaaattggtaacgggaagtttgatcgcttgtcatcggcttgcagctgctgtggccgggcctggaggcttaagtggctcgacactagtggatggccggtacacttaccgggaggagaaatccctccctggtgtagtgatggctctcgtatgtaacgtatttgacatgctttatcagctcgccaatctggaagagccaaggataactctacgagtacggaagcttctgctcttgatacccactgatccagccattcaggaagcccttgatcaacttgattctttaggaagaaagaaagaagtaggcataccatttcctctgggtgaggtaggcatggacaccagctcaaagcatgagcagaggatggttgaaggaattcctgaggggaggtctggcacagagaagctgggtagggaccttgaggaggtcgaggggatgggaaatagggaaatgatggcaaaaaggattcccaagtaccgtagaagaggagcagccagcgcacacccatgcgtggggacctgcctggtgccggcagaggccacaggaggccagtgtgatgaagacctcaccaaagatggtatagaagcactttcttcccgcccattccgaaatgtcagccggcagacaagcagacagatgtccttatgtggtaccccagaaaagtcatcctaccgacagttgtccgtgtctgataggtcttctattagggttgaggaaatcatccctgctgctcgagttgcaatacaaacaatggaagtaagtgatttcacttctactgtggcttgcttcatgagattgtcatgggctgcggctgcaggacggcttgatcttgttgggagtagccagccaattaaagaaagtaattccctgtgtcctgctggaattcgaaacagactcagcagttcaggaagcaattgcagctctggaagtgaaggagaaccagtagccctgcatgcgggaatctgtgttcgacaacagtctgtatccaccaaagactcgctgattgcgggagaggctttgtctcttcttgttacgtgcctacagcttcggagccagcaactggcttcagaaatggagcagttaaggatcagcccagctacgatgcttgaagatgagattacttggctggataactttgaacctaatcgtacagctgaatgtgagaccagtgaagcggacaacatcttactggcagggcacttacgcctcatcaagacccttctttcactctgtggggcagaaaaggaaatgcttggttcatcactcattaaaccattgttagatgacttccttttccgagcttctagaattattttaaatagtcattctccagctggcagtgccgccatcagtcaacaggactttcatccaaagtatggaaaatgcacgtgtagtacagcgaatagccgattggcagcctatgaagtccttgtgatgttggctgatagttcaccttcaaatcttcaaattattataaaagaactgctttctatgcatcaccagcctgaccctgctcttaccaaggagtttgatattttcaagatgtggaataaagaactttatgtgagagaacagcaggatgcatatgaattctttactagtctcattgatcagatggatgaatacctcaagggcatctactctgatcagaagatctgtaaagactgtcctcacagatatgagcgtgaagaagctttcatggctctcaatctaggagtgacttcttgtcagagtttggaaatttctttggaccaatttgttagaggagaagttctagaaggaagtaatgcgtactactgtgaaaagtgtaaagaaaagtttccctggatgctaaacatggagccttacacagtttcaggaatggctcgccaagattcttcttctgaagttggggaaaatgggcgaagtgtggatcagggcggtggaggatccccacgaaaaaaggttgccctcacagaaaactatgaacttgtcggtgtcatcgtacacagtgggcaggcacacgcaggccactactattccttcattaaggacaggcgagggtgtggaaaaggaaagtggtataaatttaatgacacagttatagaagaatttgacctaaatgacgagaccctggagtatgaatgctttggaggagaatatagaccaaaagtttatgatcaaaattgtcaagacaagaaaaacttttatttacagatgtgtttcttaatgtcttgttataaagcaaacccatacactgatgtgcgccgaagatactggaatgcctatatgcttttctaccaaagggtgtctgatcagaactccccagtattaccaaagaaaagtcgagtcagcgttgtacggcaggaagctgaggatctctctctgtcagctccatcttcaccagaaatttcacctcagtcatcccctcggccccataggccgaacaatgaccggctgtctattcttaccaagctggttaaaaaaggcgagaagaaaggactgtttgtggagaaaatgcctgctcgaatataccagactaaattaaagcatccatattatccttgcatggcaaagaaacgcaagtctcttcccacaaggcgatcacagtctgctgctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggcctccggtcccactgaaggtcagatgaaaggtagtcttccctggcggttgctgctgccactgaatgggccctaactttgtcgtcttgtgtttgaatcttctgcaggacacgttagcgtatgccacagctttgttgaatgaaaaagagcaatcaggaagcagtaatgggtcggagagtagtcctgccaatgagaacggagacaggcatctacagcaggtataac

SEQ ID NO: 462866 - DNA, 904 bp, Homo sapiens
  misc_feature (2)..(3): n is a, c, g, or t
  misc_feature (13)..(14): n is a, c, g, or t
cnnaactgtgaannaggaaagccctgtcaaagcaagagatggctagtgtttcatccagccaaagaggtgaagtggttctggaaactttggtggtggtcgtggaggtggtttcagtgggaatgacaactttggttgtggaggaaactttagtggtcatggtggctttggtggcagctgtgatgtcagtggatatggtggcagtggggatggttataatgggtttggcaattatggtggttatggaggaagtggccctggttactctggaggaagcagaggctatggaagtggtggacagggttatggaaaccagggcagtggctatggcgggagtggcagctatgacagctataacaatagaggtggaggtagctttggcagtggcagtggaagcagttttggaggtggtggaagctacagtgatttgggcaattaaaacaatcagttttcaaattttggacccatgaaggggggagattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagagaagagccagagaagtgacagggaagctacaggttacaacagatttgtgaactcagccaagcacagtggtggcagggcctagctgctacaaagaagacatgttttagacaaatactcatgtgtatgggcaaaaaacttgaggactgtatttgtgactaattgtataacaggttattttagtttctgttctgtggaaagtgtaaagcattccaacaaagggttttaatgtagatttttttttgcacccatgctgttgattgctaaatgtaatagtctga

SEQ ID NO: 462867 - DNA, 1680 bp, Homo sapiens
agggagccctcacaatcatggtagaagatgaaggaagcgaaagggacattttacatggcagcaggcaagaggatgaaaccatctgcatttttcaagaggcttgtgaaatatctaccaactcttttggaatgcaacggaaagtgactgctgaaaagaagtccttgaatcttcaatgcaattcaggttcttgctatattaaggcactcaagagtgactacagccagatcattgttgttgaatggaaaaccatgctgatgaatccacaaaaaacttccatcactattgccatggcagctttcctcatgagctcattggaaaaagaaactgaccaacattcccagtacaatgccaaggttcatttctttacatgtgttttatgtgtttttaaattttctgcattgcaatttgattcaaaatcatccctttctcccttgaatgggtttatataataattatggaaaatacaggtcctgtataaaagaaataaatatttaaaaatttaaggcaatcagtatggcctttcaacaaagtctgtactaatttacattcttatgatttgttatatgagaattcccacttcactgagcaccaaaaactagtgttgtcatttttctgctctacaccaatttgatggcttggaaattgaatcttatttattcatatgtgtattttccagttacacttatttttataatgtattcttagaaaatgtcaagtttctttaggatgttactgttcggcttttagtttttaaaagccattctttgcgaaatatattaacttttttccctactttttgcaaatacttactccaaggtcatcatgtattatttaattttttgattataaaagctaataagtattgttttaactgataattttgcttaatgttacattacatggaatatgtttggaagttaatatcggaattaaaggcttagagaaatattagaggaactatgagaggaaaggtcagggaagctaactctaaacagcaagtaattcagcaaaaatttcaggaaagcaaccagagatctcagccagaagctcccagtaactgtcttggaaactgctgctgtgctaacggttctatgtgaaactctcactaattgtctttgtgtgcaacagccaagcagctcacaccagtgttttttgctggcaaagcctaacatagaaacatacagagagaaggttttgggaaatgcggaggagaccttggaaagctgcggtaatgatgtcaagttgacaatagccaaacatcacaagaagaaatcaaattttgtgaatgaagcaataatacagtgaagttgttcaacatttcacagctattaaacagcacagtaatttttttcagtattgaaatatagaataaaatagctctttttgtaatacatctggttagaagggatgatttccttacttttaaaccataaaaatatatataaataattaaagaaatattaacttttaataatagagaaatagaagagaatattatactttgggttctacctatattcctaagtactataatcagtgctatacagaatttatgttaaatatcctttgccataactcctggagtaggaattataacctttaatttacaaacatcgatgcttgaaacttaactagtttccccaagttttcagagcccctctgaagtcttttctaggatgg

SEQ ID NO: 462868 - DNA, 1554 bp, Homo sapiens
ggacagaggaatggagccagtgaaacgcggaggaggatgcagccagctgcctgtgggaactgggaaggcacacagggagctgctgcctgagctgtgactcgaagacaacgtgggaggtggcaggattgtggggtggggaatgtgtcagtcagggtcctggcaggaaacagagtatgtgagtaggctgaagagagtttaatacaggactgttcacaaagggcaaggatgggagtctaagcagggggatcacatggctggtagtcatggtggtgtggaggatggattggaggagggcaggagcagaaggaaggccaccaagagcctactgcaatacagaatgcttaggggaatcaacagaatctggacctggggcttgctgtcagaagaaccggactcaaatccccattctgctgcttacatttgtgagctactgggcaagaaacactggaggcctaacaaaggcaggggcagccaccatggggagagcaggtggacacaagaatcatttctctgggtgtgataatgagagggaaggatatgattctgagctgtgtaacttggcagatggactaaacattaatggggtcaagggccacagaaggaaaaaagaactaaggaacatggaaggaggaggagtggtgtggctctggacaggtcagatttgagaaggcaaaagccagatggaatttattttggtggcccttatgaagtagctaagcctttccctgcgagagagctaatgccgttttgatgtggaagtaggagtggggctggttaaggcaagaggtcagtttaatgtttagtaaagtgtcctgataaaaagcaagggctgttgtaactgccccagacctgcatttcacccatctgttactgacttccctttctcataggaaggaaccagaaacgtgacatggatcaaaaggacatgtttgagtctgaggacacaccactggcccagaccctggacggctgctccgactctggaaggaaatgcacctgcactacctcatctcccccagcaatcaggtccatctccaacaattaattatgtgctgatgggagacactgagcaacgatgagctcatgtgtagatctcatctgtcaggggctgccattctgaggttcttcttgctcacctcctccaaaaaaccttttattggagcaattaatacaaacaagatgaacacatttaccctttatgatggcttcatttctcccacccacccccttatcattatgaattatcagtaaaaactgcaacaaatgagacaagagatgaggtcaatgtcaggcctctgagcccaagctaagccatcatatccccagtgacctgcacatatacatccagatggcctgaagcaactgaagatccacaaaagaagtgaaaataaccttaactgatgacattccaccattgtgatttgcttctgcccaccctaactgatcaatgtactttgtaatctcccccacctttaagaaggttctttgtaattctccccacccttgagaatgtactttgtgagatccaccccctgcccctaaaacattgctctt

SEQ ID NO: 462869 - DNA, 1543 bp, Homo sapiens
ataaaacccgatcgtacattcgttctattctaagataggagaaaactgccctgtggctggagaagtaaacactatgtccaaaagtagatcattcgaacaaatattagttaaatcaatcaaaagacaagattcttttcctggtgaatcttacattatagtaggatccccgatgagctccttaaaaggattactggttcccaccccagagttcctgagtcaggaagaccgagaggccagagaagagcaaacttggccctttggggacagcaaaaaacagtctgttagctgtttagacctagagaaggcagctgaaagtgtttggttaccaaacagcgttcctaagcacctagataactggtgtgatcagtactcaaccctgctgttggctgatgacagggaagagactggagtgagagtgtcagaaaaaaaaaacagcattgaaaagagatctttgtttccttatttttcaggtaaggaagtggaggattaaatgatttgcccaaagtctcacagtaatttgtagagctgagattgaaattcgggtgaaacttcacatatcacattctttttatcagatggcagtttctggatttactcttggtacctgcatacttctgttgcacattagttatgtggctaattatcccaatggaaaagtaacacagtcatgccatggaatgattcctgaacatggtcatagtccacagtctgttcctgttcatgacatttacgtgagtcagatgacattcaggccaggagatcagattgaaggtaccgtgctgggattaactgtttacattttggatttcactcttttactgtttattgaatctttattattacttgatttagaagatttcacttaaatctgttttcttttgtaagatactatcatacttcttatttttggttccagatgactgtattacttaagtagtctgtgtattccccatccagaacaggctttaaaataagtttttatcgttatttactatttttattaattgtgctatcacttcaagagaagagaaaaatgaagtttattttatcttgtttaaaatataataaacccttgtccttcttgatatcatataattttaagaacaattctctaatttctctggtaaaatgtaggctgattattaaagataaatctataacagcattttgcaaactattttttgcaactctagaaatgcaaaatgttaacaggtactctgttacatagagagtatatagaaaaataagtttggaatattctgtgtgatatataatataccttagagttcacactgtacagtaggatattaaatatcctaagaaatttgcagtaaagaaacaagtatttactttcatccagtgtttttctttttttgtaattcaataagaatttattgagtgtcactgtgagccagacactgtgttaaatactgcaattcaaaagaaaacacctcatgttttttcctctaatgaggtcaagtaaacattttttttttaaacttttattttgggttcaggggtacatgtgtaggtttgtttatag

SEQ ID NO: 462870 - DNA, 1099 bp, Homo sapiens
tggttaggctgccttcgcttctcaaggtaaggaagtggaggattaaatgatttgcccaaagtctcacagtaatttgtagagctgagattgaaattcgggtgaaacttcacatatcacattctttttatcagatggcagtttctggatttactcttggtacctgcatacttctgttgcacattagttatgtggctaattatcccaatggaaaagtaacacagtcatgccatggaatgattcctgaacatggtcatagtccacagtctgttcctgttcatgacatttacgtgagtcagatgacattcaggccaggagatcagattgaaggtaccgtgctgggattaactgtttacattttggatttcactcttttactgtttattgaatctttattattacttgatttagaagatttcacttaaatctgttttcttttgtaagatactatcatacttcttatttttggttccagatgactgtattacttaagtagtctgtgtattccccatccagaacaggctttaaaataagtttttatcgttatttactatttttattaattgtgctatcacttcaagagaagagaaaaatgaagtttattttatcttgtttaaaatataataaacccttgtccttcttgatatcatataattttaagaacaattctctaatttctctggtaaaatgtaggctgattattaaagataaatctataacagcattttgcaaactattttttgcaactctagaaatgcaaaatgttaacaggtactctgttacatagagagtatatagaaaaataagtttggaatattctgtgtgatatataatataccttagagttcacactgtacagtaggatattaaatatcctaagaaatttgcagtaaagaaacaagtatttactttcatccagtgtttttctttttttgtaattcaataagaatttattgagtgtcactgtgagccagacactgtgttaaatactgcaattcaaaagaaaacacctcatgttttttcctctaatgaggtcaagtaaacattttttttttaaacttttattttgggttcaggggtacatgtgtaggtttgtttatag

SEQ ID NO: 462871 - DNA, 1110 bp, Homo sapiens
ctctttggctgcctcagttcatttcattttaatcaaggtgccaggagggaatttaggttaaaaaatccaacctccttcttgtcacaagttccctgacacggactatagttgtagatgttgccctggctgcgtatcaacaatgacttcttttccttgatgtttcttcacaggaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaagagaaaaaccaggctagataatttaatagcctctccagatctcagagatgcttatactgaaggcagccagatagcaaagtcacgagtgttcctggctcttcaagtgccctatgcacatttcaccaaagagcccattggaggaattcagctacaatcctgcctgggaagtagtttccaggaccttcgcaattccacatagcatctttaacatgtttgagagtacgtaaggaggcagcatagtgcagcggaaagaacactcaagtgagtgttgagggggctggattctaatattaatattagccaacatttattgaacaggctaggtgctagattctgtttaaagcactttatgtggattatctcactattcttattatcctattttacagatgtggaagctgaagcatagagggtttaaatataatttacccaaggtcatcaattggggagtagaagtaggattcaattcctgctccagagcctgcatgttcagctctcttttaatactgcatgtggtccttgataggctactgaccctggaaaagtcatttcaacttttagggctcattggtgaaccataaccaaagggagctcattgtggctaacctctgatggagtttccacttttaataatttatatgatgcaatgcagctatattgtttagttcttgtcattatgtgaaagcatagtatttaaactttgatctcattgattcagcaactgattattttatggccactgtgcacaaagcaatgggctgggtaccacagaggattc

SEQ ID NO: 462872 - DNA, 739 bp, Homo sapiens
tccataaaccattcagtgtgcgttcgcttcggcccacctaagtaacgctcgatagtgggtcatacactgtactcctcaactgacattcctgagtcatgactagtgacttgtcattctcaccaataaaatatgcccggatgtcaagcaccgaagtcgttctagagacgagacatccataatgcagttgcgtagaaggtcattcctgtgtctagtcaggacagggagctcgcgaatgcgagctactgatatttaaagtcacgcactctctgtccgagacaggctaggtgctagattctgtttaaagcactttatgtggattatctcactattcttattatcctattttacagatgtggaagctgaagcatagagggtttaaatataatttacccaaggtcatcaattggggagtagaagtaggattcaattcctgctccagagcctgcatgttcagctctcttttaatactgcatgtggtccttgataggctactgaccctggaaaagtcatttcaacttttagggctcattggtgaaccataaccaaagggagctcattgtggctaacctctgatggagtttccacttttaataatttatatgatgcaatgcagctatattgtttagttcttgtcattatgtgaaagcatagtatttaaactttgatctcattgattcagcaactgattattttatggccactgtgcacaaagcaatgggctgggtaccacagaggattc

SEQ ID NO: 462873 - DNA, 3685 bp, Homo sapiens
agccagtggtttggctggatggtcagggacttggaagaggcatgatcagaaaattggtgacaaagaagtttggggaagaggctaacctggctacagccactgctgagtgcccaattggccagcagcagctaccaacactgagccctcgatatggcaccattcctcgggatgatcagctagctagttggtggcaggttgattatattggatttcttccatcatggaaagggcagaggtttgttctcactggaatatatccttactctggatatgggtttgcctatcctgcatgcaatgcttctgccaagactgccatccatgggcccacgcaatgccttatctaccgtcacagtattccacaaagcattgcctctgatcaaggcactcactttatggctaaagaactgaagcagtgggctcatgctcatggaattcactggtcttagcataaatgttttaaaaattggattttaaagactgtttttaaagatcgtataaccagaattattatatttagaaatgttactaaagctgttaatctgtatagcctaagtaaaagtaatttttaaagcagccttgataatagataattctttgaatggagaaaattttaatattttggtaagagggttaagcagtatgctaaatgattatccaatttttttttgtcttttctaaactactgaatttaaatagcatttaaacttctgcttctatctcattttccaatgtataacaatttatcagatatcagaaatgatgtcaatttagtagtttattagtttcccaatggctgtgtgttaacactgttttagaattgtgtgtacatcattgatttaaaaaacagaaagaaaggaaacaagaaaataaaaagaagggaggaaagaagtaaggaaggaaaaaatgaaggaaagaagaaaggagaaaggaaggaagaaaaaaggaagggagagagaagagacaaagaggatgagacagaggaaagaaggaaaggatgaaataagaaagagagagagaaagaaagaaaaaagagaaaagaaaggcaagaggaaaaggggaaggaagtaaagaaagaagggaggagggaaggaaggaaggagggaaggaaggaaagaaggaaggaaagaaggaaggaatgaagaaaggaaggaaggaaggaggaaaggaaggaaggaaggagggaaggaaggaaagaaggaaggaaagaaagaaggaaggaatgaagaaaggaaggaaggaagggagggaggggaattttgaggaaacctatccaaatttattacactttacaatttttttttatgaacacacattttctgttttcatactgagttatttaaattaattgacagttgtgttgtaattcttaatatagaatggtagtttaaaaacatatttgagaaaatccttatgttttctttagaattataaatttctgttccattttattttcattttgatattttacactattggtatattttgaaagctatacttttttcactttggagaacttatgcaaagattttaaacgtatacagtagatgggcaacattaatagaacactaaatgaaatattttaaattgggaatgttagcaaataataaattctaataattgagaactctaaaatttagtgcattttgtattctttatgacaccagtaataatcttttttaataaattattttttaaatttctgtaaatagggtaaaactacttacttccatgatagtttttcaatataatatcaaatttatattgactattttatattaacctgatttttcaaatgaaaacgctaacttctaacatattttgctatcgactaacaaatacgaatgatgattaaagtccactgattcagaagtgaactatagtttacactttagtcatatgaattgatatgttacatgaaactgttttctagtaaatctattttcaagcaggttgctagttaaatttttaagagaggtttgatataaaagggtaagaaagaaacaactgactggcttagtagatatcaacatgaaaaaatactgctagataaaaacatatttagcaaagatttgaaaaatgtatgaggtagaagttgatattcagaccagactgaattttagtaaaacaattatttgttttgaaaaaaaacacagatcagaaatctggatttcataatgtactggcacttagaccagaattttattaacactacaaaacaagtttatcttcaggaagatttcacgctttcttcttgaaaagagaactacacatccacagaaaggagaactaatgatttggagagaaataaggtatttagtggagaatatttaagttattaagcttgtaagactttcactatgcctgtagatgacaggacaagaaagaaacccaaaatggaatcagatttcttcctttataatcacttaacatataatttagattaagtcattttaagtaaagaacaaatactattctgaaataaacaaagaagcaaggtcaaatttgatcatatgaattgataagacaatggatgaagttttgccattaagaatcctggtaagacctttttatgtatagaaatgccacaggtaaactaaaggtttgaatacaggaaagtgttatactggtcaattgactcaaatctgtgttaaaaattattaagaagcctatccgtgcttccaactcatattgacaagccttactcttgatgtaaagaaaattaattcttatatacccgagtagttatactagtaatttttaagcaaaattatttgactgaatgataattggctacaaataaaaagacatagttcaattaaatcaattttgacttaataaaaataaggtacactatatacttgacatatggagtttgtgataaattatgggtcaagacattaatttaatatgttctattctttacctctgaggcaaatatcacatatagtagcatttaaaaaaaatggacatactgcataatatattaatattagatgtattttaaatatcaaattaatactttaatatgtataatcaaaatagtttgtttaattattttcatgagtaaggcaaaggtaaaccattagattttattttaaatatcaaattaatactttcatatgtataataaaaatagtttgtttcattattttcatgagtaaggcaaaggtaaaccattagatctttgtatcataagattataacttgtaataaaataattaaggtcattgaagatgttttagaatttcatagttatttactttcaaataattattatgtgagtaggttgtgcaaatgataatacagttctagtagaatattaaaatgactattgtctatggtaattattatggagtgtgattaagttgagtttgaagtggtattgtttgcaaatatatggtttatgatataaccaatagaaagatacattaattagaattactaagagcagtttcatatttattataaatttcaaataaaatattgagaaaaaagtttacttttctgttctgattattttatagttagtaaaagggatctgcaaaactagtggatttctttcaaacatgaaatgtctaacaaagacattttaaaatatttgtattaaaccataaaaataaaatacttttagatcttctgacatatgccttgccatgcatctgtgtataagaacattttctcctct

SEQ ID NO: 462874 - DNA, 1758 bp, Homo sapiens
cccaaggacccagcccctccagctcttgtcccctaatgtggaggcacctcctcttcagaggcctcccgaatgtgccccttgcacctggagtcagctccctactccccctctgtcttctcagcctgcagaccacttccagacatggtggatgctcatggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccaccccacctgttcacctatggggccctaccttctgaccaatgtccccacctcctcatgctgccccaagacccctcctaccccaccatggctatgcctagcctgctgatgatggtcaatgagctggggcaccccagcgctcggtgggagaccctgcttccctacccaggggccttccaagcctctggccaagctctgccttcccaggcccgaaatccaggtgctggagctgccccaaccgactccccaggcctggagcgtggtggcatggcatctccagcaaagcgggtcccattgagttcccagacaggcaccgcagccttgccttacccgctgaaaaagaagaatggcaaaatcctgtacgagtgcaacatatgtggcaagagctttgggcagctctccaatctcaaggtccacctgcgtgtgcacagtggagagcgtccattccagtgtgccttgtgccagaagagcttcactcaacttgcccacctgcagaagcaccacctggtgcacactggggagcggccccacaagtgctcggtgtgccacaagcgcttcagcagctccagtaacctcaagacccacctgcgcctgcactccggggcccggcccttccagtgcagtgtctgccggagtcgcttcacccagcacatccacctgaagctgcaccatcggctgcatgccccacagccctgtggcctggtgcacacccagctgcccctggcctctctggcctgccttgcccaatggcaccagggggcactagatcttatggcggtggcatctgagaaacacatgggctatgacatagatgaggtcaaagtgtcctcgacatcccaggggaaagcaagagcagtgagcctgagcagtgccgggactcccctggtgatggggcaggaccagaacaattaaaaatgtttcttctgtcaaaaagctttgaggcttcctgagcttcaacagtttaggtgtggggtgggggtaatgggggaaagccactgtgtttgccagacctcacacttcacccgggagcaggtcaggggactcagccaggaagagcctgtgctgcctgtgtgtgcggtgcttgcctgcagccatctgcttcagcaaggcttgagttccactccccgtctaggaccaggctctcctcgtctattcacc

SEQ ID NO: 462875 - DNA, 1818 bp, Homo sapiens
cccaaggacccagcccctccagctcttgtcccctaatgtggaggcacctcctcttcagaggcctcccgaatgtgccccttgcacctggagtcagctccctactccccctctgtcttctcagcctgcagaccacttccagacatggtggatgctcatggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccaccccacctgttcacctatggggccctaccttctgaccaatgtccccacctcctcatgctgccccaagacccctcctaccccaccatggctatgcctagcctgctgatgatggtcaatgagctggggcaccccagcgctcggtgggagaccctgcttccctacccaggggccttccaagcctctggccaagctctgccttcccaggcccgaaatccaggtgctggagctgccccaaccgactccccaggcctggagcgtggtggcatggcatctccagcaaagcgggtcccattgagttcccagacaggcaccgcagccttgccttacccgctgaaaaagaagaatggcaaaatcctgtacgagtgcaacatatgtggcaagagctttgggcagctctccaatctcaaggtccacctgcgtgtgcacagtggagagcgtccattccagtgtgccttgtgccagaagagcttcactcaacttgcccacctgcagaagcaccacctggtgcacactggggagcggccccacaagtgctcgataccgtgggttccaggaagaaatcactggaaaagcttccaggcctggagggaaagagaggtgtgccacaagcgcttcagcagctccagtaacctcaagacccacctgcgcctgcactccggggcccggcccttccagtgcagtgtctgccggagtcgcttcacccagcacatccacctgaagctgcaccatcggctgcatgccccacagccctgtggcctggtgcacacccagctgcccctggcctctctggcctgccttgcccaatggcaccagggggcactagatcttatggcggtggcatctgagaaacacatgggctatgacatagatgaggtcaaagtgtcctcgacatcccaggggaaagcaagagcagtgagcctgagcagtgccgggactcccctggtgatggggcaggaccagaacaattaaaaatgtttcttctgtcaaaaagctttgaggcttcctgagcttcaacagtttaggtgtggggtgggggtaatgggggaaagccactgtgtttgccagacctcacacttcacccgggagcaggtcaggggactcagccaggaagagcctgtgctgcctgtgtgtgcggtgcttgcctgcagccatctgcttcagcaaggcttgagttccactccccgtctaggaccaggctctcctcgtctattcacc

SEQ ID NO: 462876 - DNA, 551 bp, Homo sapiens
aaccctggagaaattgcttagcctcgctgtgacttcttaagcccgcatctctcatcatcagctcatgcatagccttcgagagccctgcactcctgtagttccagcgggtagcattgctatgagtgatgaagcccccggatggtctcagtggaacaatggtcgtgccaaaaagggccgcggccacgtgcagcctattcgctgcactaactgtgcccgatgcgtgcccaaggacaaggccattaagacattcgtcattcgaaacatagtgaaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccatcccgatttagacctgcgggtgctgccccacgtcccccaccaaagcccatgtaaggagctgagttcttaaagactgaagacaggctattctctggagaaaaataaaatggaaattgtacttaaa

SEQ ID NO: 462877 - DNA, 481 bp, Homo sapiens
tgtggtgcacatggggcatgtacgggcaacactcaatcctgcccaggaagcttccttgagccttgagggctgcctcacaatggatcctaggcttcttttttcccttgctgcttgcctgtcagcagtccaactaccagggccagagccccatcaaagaatcttcagtgccagccagaaagaatgatgaactcctcgtgtcaagggagtttggggcaaccagtcaaaccatggcctcatgggaagcagctgactaggcaatgagagaggaatacaaaagacaaggcactgtgaagccaagtctggttggggagaagaaaccaatatgcctgaaacagggaaccagaaaggactcagacaaaactgctgacaagtatggggtttcttggggtaggtggtgaaaatattccaaaataagattatagcgatgttttaataatcccctggatataataaaaaaacatcgaattgtacacttaaaatg

SEQ ID NO: 462878 - DNA, 1018 bp, Homo sapiens
gctgaaaacgtaatacccaaaataggcctggcatggtggttcatgcctgtaaccctagcactttgggaggccgaggaaggcagatcacttgagatcaggaaagcaggatacccttctcagctttgcccagtgaatcacatgacccctgagatatgtaactcaggaggaattgcctttcagggcctctcagctgtgttgtgtggggggcatgtacagtcaagactccaaccttcccagacagctgtcttgagccttgaggactgcctcacaatggatcctaggcttcttttgtcccttgctgcctgtctgtattatactaaagccacttcacattacttgttgcatatgctgtttcctttgcccagcacacctgtcactcacctcaaccctttctctcttttccccatctttctgtggctagctcctcctcattctttaggtctcagtgtagatagcaccactatcaggaaggagtccagacactgccaggcctaagaaatgtaaattaaatgctctcaagggatgagagacactggaagctgggacgctcttggaactctgttgccatcatcaaggcttccagatacagccctctaggtcatccagaggtgccagccagccctcaccagtggtcagcttttcctcagtggagtggtcagcagtccaactaccagggccagagccccatcaaagaatcttcagtgccagccagaaagaatgatgaactcctcgtgtcaagggagtttggggcaaccagtcaaaccatggcctcatgggaagcagctgactaggcaatgagagaggaatacaaaagacaaggcactgtgaagccaagtctggttggggagaagaaaccaatatgcctgaaacagggaaccagaaaggactcagacaaaactgctgacaagtatggggtttcttggggtaggtggtgaaaatattccaaaataagattatagcgatgttttaataatcccctggatataataaaaaaacatcgaattgtacacttaaaatg

SEQ ID NO: 462879 - DNA, 1194 bp, Homo sapiens
gctgaaaacgtaatacccaaaataggcctggcatggtggttcatgcctgtaaccctagcactttgggaggccgaggaaggcagatcacttgagatcaggaaagcaggatacccttctcagctttgcccagtgaatcacatgacccctgagatatgtaactcaggaggaattgcctttcagggcctctcagctgtgttgtgtggggggcatgtacagtcaagactccaaccttcccagacagctgtcttgagccttgaggactgcctcacaatggatcctaggcttcttttgtcccttgctgcctgtctgtattatactaaagccacttcacattacttgttgcatatgctgtttcctttgcccagcacacctgtcactcacctcaaccctttctctcttttccccatctttctgtggctagctcctcctcattctttaggtctcagtgtagatagcaccactatcaggaaggagtccagacactgccaggcctaagaaatgtaaattaaatgctctcaagggatgagagacactggaagctgggacgctcttggaactctgttgccatcatcaaggcttccagatacagccctctaggtcatccagaggtgccagccagccctcaccagtggtcagcttttcctcagtggagtggtaggtgagccagtggagcttgctctgaagatactagagggagccaaagctgtctggcccttcagtgtgactcagtttccagactctttctctttagacataaatgaagaacaagtcaaccttgatgcctttgagggttggttcagcggatgatgtgttgtggggttttcccacaggtcagcagtccaactaccagggccagagccccatcaaagaatcttcagtgccagccagaaagaatgatgaactcctcgtgtcaagggagtttggggcaaccagtcaaaccatggcctcatgggaagcagctgactaggcaatgagagaggaatacaaaagacaaggcactgtgaagccaagtctggttggggagaagaaaccaatatgcctgaaacagggaaccagaaaggactcagacaaaactgctgacaagtatggggtttcttggggtaggtggtgaaaatattccaaaataagattatagcgatgttttaataatcccctggatataataaaaaaacatcgaattgtacacttaaaatg

SEQ ID NO: 462880 - DNA, 4621 bp, Homo sapiens
agcccaggctttcttggaaaactggctggagcaccactgactggaataggagctgcgatcccgggaagaggagctgactcgggcggctctgcagcagaagtctcaggaggagctgctaaagcggcgtgagcagcagctggcagagcgcgagatcgacgtgctggagcgggaacttaacattctgatattccagctaaaccaggagaagcccaagatttccagcacaagataaccgtgcaggcctctcccaacttggacaaacggcggagcctgaacagcagcagttccagtcccccgagcagccccacaatgatgccccgactccgagccatacagtagaaagaaacttaccagagattgggtgaaataaataattttctcattgttttcatgttttgagtaaggtagtttcacaactgatatgattcatttagcttttttaacaaagccaatattggttaatatgattgttgtggttaatatggttaataatgttctttttagtgacttcagatgaaagcaataaaacttggggaaggaacacagtctttcgacaagaagaatttgaggatgtaaaaaggaattttaagaaaaaaggttgtacctggggaccaaattccattcaaatgaaagatagaacagattgcaaagaaaggataagacctctctccgatggcaacagtccttggtcaactatcttaataaaaaatcagaaaaccatgcccttggcttcattgtttgtggaccagccagggtcctgtgaagagccaaaactttcccctgatggattagaacacagaaaaccaaaacaaataaaattgcctagtcaggcctacattgatctacctcttgggaaagatgctcagagagagaatcctgcagaagctgaaagctgggaggaggcagcctctgcgaatgctgccacagtctccattgagatgactcctacgaatagtctgagtagatccccccagagaaagaaaacggagtcagctctgtatgggtgcaccgtccttctggcatcggtggctctgggactggacctcagagagcttcataaagcacaggctgctgaagaaccgttgcccaaggaagagaagaagaaacgagagggaatcttccagcgggcttccaagtcccgcagaagcgccagtcctcccacaagcctgccatccacctgtggggaggccagcagcccaccctccctgccactgtcaagtgccctgggcatcctctccacaccttctttctccacaaagtgcctgctgcagatggacagtgaagatccactggtggacagtgcacctgtcacttgtgactctgagatgctcactccggatttttgtcccactgccccaggaagtggtcgtgagccagccctcatgccaagacttgacactgattgtagtgtatcaagaaacttgccgtcttccttcctacagcagacatgtgggaatgtaccttactgtgcttcttcaaaacatagaccgtcacatcacagacggaccatgtctgatggaaatccgaccccaactggtgcaactattatctcagccactggagcctctgcactgccactctgcccctcacctgctcctcacagtcatctgccaagggaggtctcacccaagaagcacagcactgtccacatcgtgcctcagcgtcgccctgcctccctgagaagccgctcagatctgcctcaggcttacccacagacagcagtgtctcagctggcacagactgcctgtgtagtgggtcgcccaggaccacatcccacccaattcctcgctgccaaggagagaactaaatcccatgtgccttcattactggatgctgacgtggaaggtcagagcagggactacactgtgccactgtgcagaatgaggagcaaaaccagccggccatctatatatgaactggagaaagaattcctgtcttaaactaagtgccttactgttgtttaagcatttttttaaggtgaacaaatgaacacaatgtatctacctttgaactgtttcatgctgctgtgttttcaaaagctgtggccatgttcctaaattagtaagatatatccagcttctcaaaaaatgtatatgattgctgttagccatgtctattgtttttcctctggattcttttcttataacttggaatacacaaaagtgtaaaacaagagatgtgcaccaatgaaaactatgctgggtcgaattaccttcagcacaatgttaatgtttttgttctcatttatgcctttgtccatttgcacacaacagaaattgtaatgagcttcactatttttgtttctttccttccttttttttcttttttcctttctttcctttttcttgtcttgtttcttgtttttttttcttgtagtttcttttcttaattgtcatttttgcaacaaaaagccaagaaagagctttagtttcttggcaagaataatgtgatattagtaagtaaaggtcttaaaagtctgacgactggaatagatataaagtcctgtttaaactacctaaccttggctgtgggccgataatgcatatgtccagttctcacttaaattatgcaatgatatttctctctgaggaaattatacggaatgtaacttataaaagctttactgaatataagttataagcattttattcattagaactccaaaatagatgttcaaagttcagtccttgccatttgactgagaccacatggtgtgccccttgagtgaggctaatctttaggtttttcctatagaaaacattcttcctccatcagtagccctttatttgatattcagaagtggaaagctttttcattctccagtagaacttttaaaaattgttacagatacctagctcttcacagatatcatgtactgtaaacagtcatgtgtcttaattttattttctctatttgagtgcataattatcctaataatcccaaagacactgacaactcaaggaacagcagtacagtactattagaagttaagtatgttgttgttatttcacatttcatttaattgtggataaatgttagacatctgttgaaataagctcatatggtggaaacgacaactatattatgaattattttcagaaatggatctttgaatagcagatcaggatttaaataataaaattatctatgaatcacttttatggtcatacatatatgatacaaatccagagttattggtgcagaaatggctacccgagagcttggtaaatttgccttggtttcttatgttaaatgtattgtgcttcccttctgtctctagaatgtggctcttcagaagacagacaatcgacatttaaatttttccaaacaatgaaaaactaaattaaaaacattgcttgatatttcatttaaaattgcaccttgcttaaggtttactgaataactgaaatgtcagcaatttaaaataaattcaattgtgtgataaaatatctcacctataatagaagaaaaggaaaatcatattatttggcaattttgcagcattgtggttgcctaacaggtatatccagcagatgagaaacagtatgaaaggattgtattaacatggtaagttttgccctaaggaaaacgatcttgcattctggattcttgcagcaaagtctcagatacttaatacgttttcttgttttatcatctgttctatgattcggcttcactttgtgtggttattgaattatgtaacagagatttggttttcccaaaatgttatcacatttgaaactatgattgctttgtgttcagtccttttggaacacgtagcttccagcttaagggtagagaaatatatacctaaaatcatcaatacatgaaagaaaaaggatggaaactatgtcctcagttttacttctaccaaaacatccctgtatgtgtgtgcatgtatgttggcgtgtgtgtgtgtgcatgcatattagtaaatgtgtgtttgcatgtgtgtgttggggagtgtatgtgatctgggtgtttgtttatctctgttattattcccctttagctttattttagtcaactctacattatgatgaatttcaaaatgaagctgtattaaaataattgtaatataacaattcaatctcacatgttactgcagatagttaacttttgctgcaatctattgtacatttgcaattttctgtgttagtaaacttagcagaatctggttatttatttttgtgtaggcttaatgttcactgaaagataagtcaattactgttagtaaaaaattaaggtactctcactgcagagatttaaggcctgggcctaatgtgctgtattatgaagccttgtgactgaaaaatatgtttacatatgttgtctatttttttaataaacttttatagctggtctatttgctcagtagctttgatcctctcttgattattgtgactatagtttgcaatggtttattttgtattcaataagaaaaattgtgttaataaagattattgtttaataagccaggtattaacctgctaaatatattaaactgaaaatcactaaatgagtcattcaattaaatacatcaaaaaaggtagaatgaaatgttttatttcaaatttttttggtttacatatgcattgaaaagttatatttcatggtgagc

SEQ ID NO: 462881 - DNA, 4530 bp, Homo sapiens
agcccaggctttcttggaaaactggctggagcaccactgactggaataggagctgcgatcccgggaagaggagctgactcgggcggctctgcagcagaagtctcaggaggagctgctaaagcggcgtgagcagcagctggcagagcgcgagatcgacgtgctggagcgggaacttaacattctgatattccagctaaaccaggagaagcccaaggtaaagaagaggaagggcaagtttaagagaagtcgtttaaagctcaaagatggacatcgaatcagtttaccttcagatttccagcacaagataaccgtgcaggcctctcccaacttggacaaacggcggagcctgaacagcagcagttccagtcccccgagcagccccacaatgatgccccgactccgagccatacagttgacttcagatgaaagcaataaaacttggggaaggaacacagtctttcgacaagaagaatttgaggatgtaaaaaggaattttaagaaaaaaggttgtacctggggaccaaattccattcaaatgaaagatagaacagattgcaaagaaaggataagacctctctccgatggcaacagtccttggtcaactatcttaataaaaaatcagaaaaccatgcccttggcttcattgtttgtggaccagccagggtcctgtgaagagccaaaactttcccctgatggattagaacacagaaaaccaaaacaaataaaattgcctagtcaggcctacattgatctacctcttgggaaagatgctcagagagagaatcctgcagaagctgaaagctgggaggaggcagcctctgcgaatgctgccacagtctccattgagatgactcctacgaatagtctgagtagatccccccagagaaagaaaacggagtcagctctgtatgggtgcaccgtccttctggcatcggtggctctgggactggacctcagagagcttcataaagcacaggctgctgaagaaccgttgcccaaggaagagaagaagaaacgagagggaatcttccagcgggcttccaagtcccgcagaagcgccagtcctcccacaagcctgccatccacctgtggggaggccagcagcccaccctccctgccactgtcaagtgccctgggcatcctctccacaccttctttctccacaaagtgcctgctgcagatggacagtgaagatccactggtggacagtgcacctgtcacttgtgactctgagatgctcactccggatttttgtcccactgccccaggaagtggtcgtgagccagccctcatgccaagacttgacactgattgtagtgtatcaagaaacttgccgtcttccttcctacagcagacatgtgggaatgtaccttactgtgcttcttcaaaacatagaccgtcacatcacagacggaccatgtctgatggaaatccgaccccaactggtgcaactattatctcagccactggagcctctgcactgccactctgcccctcacctgctcctcacagtcatctgccaagggaggtctcacccaagaagcacagcactgtccacatcgtgcctcagcgtcgccctgcctccctgagaagccgctcagatctgcctcaggcttacccacagacagcagtgtctcagctggcacagactgcctgtgtagtgggtcgcccaggaccacatcccacccaattcctcgctgccaaggagagaactaaatcccatgtgccttcattactggatgctgacgtggaaggtcagagcagggactacactgtgccactgtgcagaatgaggagcaaaaccagccggccatctatatatgaactggagaaagaattcctgtcttaaactaagtgccttactgttgtttaagcatttttttaaggtgaacaaatgaacacaatgtatctacctttgaactgtttcatgctgctgtgttttcaaaagctgtggccatgttcctaaattagtaagatatatccagcttctcaaaaaatgtatatgattgctgttagccatgtctattgtttttcctctggattcttttcttataacttggaatacacaaaagtgtaaaacaagagatgtgcaccaatgaaaactatgctgggtcgaattaccttcagcacaatgttaatgtttttgttctcatttatgcctttgtccatttgcacacaacagaaattgtaatgagcttcactatttttgtttctttccttccttttttttcttttttcctttctttcctttttcttgtcttgtttcttgtttttttttcttgtagtttcttttcttaattgtcatttttgcaacaaaaagccaagaaagagctttagtttcttggcaagaataatgtgatattagtaagtaaaggtcttaaaagtctgacgactggaatagatataaagtcctgtttaaactacctaaccttggctgtgggccgataatgcatatgtccagttctcacttaaattatgcaatgatatttctctctgaggaaattatacggaatgtaacttataaaagctttactgaatataagttataagcattttattcattagaactccaaaatagatgttcaaagttcagtccttgccatttgactgagaccacatggtgtgccccttgagtgaggctaatctttaggtttttcctatagaaaacattcttcctccatcagtagccctttatttgatattcagaagtggaaagctttttcattctccagtagaacttttaaaaattgttacagatacctagctcttcacagatatcatgtactgtaaacagtcatgtgtcttaattttattttctctatttgagtgcataattatcctaataatcccaaagacactgacaactcaaggaacagcagtacagtactattagaagttaagtatgttgttgttatttcacatttcatttaattgtggataaatgttagacatctgttgaaataagctcatatggtggaaacgacaactatattatgaattattttcagaaatggatctttgaatagcagatcaggatttaaataataaaattatctatgaatcacttttatggtcatacatatatgatacaaatccagagttattggtgcagaaatggctacccgagagcttggtaaatttgccttggtttcttatgttaaatgtattgtgcttcccttctgtctctagaatgtggctcttcagaagacagacaatcgacatttaaatttttccaaacaatgaaaaactaaattaaaaacattgcttgatatttcatttaaaattgcaccttgcttaaggtttactgaataactgaaatgtcagcaatttaaaataaattcaattgtgtgataaaatatctcacctataatagaagaaaaggaaaatcatattatttggcaattttgcagcattgtggttgcctaacaggtatatccagcagatgagaaacagtatgaaaggattgtattaacatggtaagttttgccctaaggaaaacgatcttgcattctggattcttgcagcaaagtctcagatacttaatacgttttcttgttttatcatctgttctatgattcggcttcactttgtgtggttattgaattatgtaacagagatttggttttcccaaaatgttatcacatttgaaactatgattgctttgtgttcagtccttttggaacacgtagcttccagcttaagggtagagaaatatatacctaaaatcatcaatacatgaaagaaaaaggatggaaactatgtcctcagttttacttctaccaaaacatccctgtatgtgtgtgcatgtatgttggcgtgtgtgtgtgtgcatgcatattagtaaatgtgtgtttgcatgtgtgtgttggggagtgtatgtgatctgggtgtttgtttatctctgttattattcccctttagctttattttagtcaactctacattatgatgaatttcaaaatgaagctgtattaaaataattgtaatataacaattcaatctcacatgttactgcagatagttaacttttgctgcaatctattgtacatttgcaattttctgtgttagtaaacttagcagaatctggttatttatttttgtgtaggcttaatgttcactgaaagataagtcaattactgttagtaaaaaattaaggtactctcactgcagagatttaaggcctgggcctaatgtgctgtattatgaagccttgtgactgaaaaatatgtttacatatgttgtctatttttttaataaacttttatagctggtctatttgctcagtagctttgatcctctcttgattattgtgactatagtttgcaatggtttattttgtattcaataagaaaaattgtgttaataaagattattgtttaataagccaggtattaacctgctaaatatattaaactgaaaatcactaaatgagtcattcaattaaatacatcaaaaaaggtagaatgaaatgttttatttcaaatttttttggtttacatatgcattgaaaagttatatttcatggtgagc

SEQ ID NO: 462882 - DNA, 647 bp, Homo sapiens
tgtgtgactatatccaacatataagctctgattcattatttgtgtgactatatccaacatataagctcagaatcattatttattgacctgaaccccgagaagtaagaaaccaaaataagaaatcgatcctgcaatattctttgcagttagggtctgaccatttttgtttttattgctgtgtgctaaatacatggctatgaagataaaggaaaaccatgaaataccagttctccctttttgcctccaacagatttccagcacaagataaccgtgcaggcctctcccaacttggacaaacggcggagcctgaacagcagcagttccagtcccccgagcagccccacaatgatgccccgactccgagccatacagtgtgagctttctgcactgccacgggggctcctgtgttgacttctctcctttcacttgacttggattcaaattgagcagatgtgttttcatagcaggttgtagatgagtgtaggacatttcgtaggtgccacaactatttgagaaacaaaacttgagcataggttccttagtctaattttcttctactcacaaaaaatgaattttagatgctatgcagttggtgatgcgacctggccccggagtagaaagtgaaacaccacatctcgagacattct

SEQ ID NO: 462883 - DNA, 653 bp, Homo sapiens
agcccaggctttcttggaaaactggctggagcaccactgactggaataggagctgcgatcccgggaagaggagctgactcgggcggctctgcagcagaagtctcaggaggagctgctaaagcggcgtgagcagcagctggcagagcgcgagatcgacgtgctggagcgggaacttaacattctgatattccagctaaaccaggagaagcccaaggtaaagaagaggaagggcaagtttaagagaagtcgtttaaagctcaaagatggacatcgaatcagtttaccttcagatttccagcacaagataaccgtgcaggcctctcccaacttggacaaacggcggagcctgaacagcagcagttccagtcccccgagcagccccacaatgatgccccgactccgagccatacagtgtgagctttctgcactgccacgggggctcctgtgttgacttctctcctttcacttgacttggattcaaattgagcagatgtgttttcatagcaggttgtagatgagtgtaggacatttcgtaggtgccacaactatttgagaaacaaaacttgagcataggttccttagtctaattttcttctactcacaaaaaatgaattttagatgctatgcagttggtgatgcgacctggccccgga

SEQ ID NO: 462884 - DNA, 3306 bp, Homo sapiens
agcgtgaacctgggaggcagagcttgcagtgagcctagatcgcgtcactgcactccagcctgggcgacagagtgagactctgtctcaaaaaaaaaaaaaaagtcaaaacaagagaacatactaaatgattccatttttttatttatgacttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttattgcaactgcagacggttacctggcacgctggccacaatctacctcactcttatcagagtctgagctactggcagtgctttcagctctgagttgaggcacctcaaaccttgtttttgtggtgaaggatcctaaagtgctgtgggagtgatcacatttttcacaacagtaagtccctggccccacctcttctgccacaaacgtcagcatggtggtatcagccggcccttggtccagcgagaaggcagagatgaacattctagaaatcaacgagaaattgcgcccccagttggcagagaacaaacagcagttcggaaacctcaaagagagatgttttctaactcaactggccggcttcctggccaaccgacagaagaaatacagcaatataaagtcctggttcactctcaggaacgagagctgacgcagttaaaggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtcgctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttggcctcgtacaagtcttacagcagcacatttcactcattagaggaacagcaagtctgcatggctgttgacataggcagacatcggtgggatcaagtgaaaaaggaggaccacgaggcaacaggtcccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccagtgtctgctgttgcaaaaagaagaaaacattctctgcctgagttttaatttttgtccaaagttaattttaatctatacaattaaaaccttttgctatcactctggacttttggattgttttttacattcagtgttataatatttgattatgctgattggttttggtgggtactgatgc

SEQ ID NO: 462885 - DNA, 342 bp, Homo sapiens
gggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtc

SEQ ID NO: 462886 - DNA, 495 bp, Homo sapiens
aaccagagtcacagaatatcagagccaaaggaacatttgcagacggttacctggcacgctggccacaatctacctcactcttatcagagtctgagctactggcagtgctttcagctctgagttgaggcacctcaaaccttgtttttgtggtgaaggatcctaaagtgctgtgggagtgatcacatttttcacaacagtaagtccctggccccacctcttctgccacaaacgtcagcatggtggtatcagccggcccttggtccagcgagaaggcagagatgaacattctagaaatcaacgagaaattgcgcccccagttggcagagaacaaacagcagttcggaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctga

SEQ ID NO: 462887 - DNA, 2613 bp, Homo sapiens
agcgtgaacctgggaggcagagcttgcagtgagcctagatcgcgtcactgcactccagcctgggcgacagagtgagactctgtctcaaaaaaaaaaaaaaagtcaaaacaagagaacatactaaatgattccatttttttatttatgacttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttattgcaactgcagacggttacctggcacgctggccacaatctacctcactcttatcagagtctgagctactggcagtgctttcagctctgagttgaggcacctcaaaccttgtttttgtggtgaaggatcctaaagtgctgtgggagtgatcacatttttcacaacagtaagtccctggccccacctcttctgccacaaacgtcagcatggtggtatcagccggcccttggtccagcgagaaggcagagatgaacattctagaaatcaacgagaaattgcgcccccagttggcagagaacaaacagcagttcggaaacctcaaagagagatgttttctaactcaactggccggcttcctggccaaccgacagaagaaatacagcaatataaagtcctggttcactctcaggaacgagagctgacgcagttaaaggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtcgctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttggcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttaacatggatgaaattgaaaagtaccaagaaataaactcgtaaccctgtccttc

SEQ ID NO: 462888 - DNA, 685 bp, Homo sapiens
atatctggagaaaccatgtcaaagctttccaagagagactgtgaacagtacctggggaacaccaaaaagagagatgataaagaagggatgacaagtccctgcaggcctggaccaagtgcaacacagaacaagcaacaagaccaaaagaaagcagtgtgtcttgttaagtttctttgcaaggctttaaatcagctgatcgaataccataagaggaattctggactgaagagttatgaagtcatttcagacacttccagacaatttgtgttaattaaattctcactggttgagttccattctacactggaagagcatttttcctggaaaggctcctcaaaatggacaccatcaagagtcacctcctcagtgaagccttccatggtttcataccacccatccctatcggaatgaatgtatccttgttctccgttatcccagtattttgcctgggcttctgtcacactactttcaatgtctatacctcagttatcgaatcgaaaaacaagagtcatcagtctctaaggtccttgcaagcttcaaaactttatatttttgtcaattacaactgaataaagctgaacaacttattatttatggatacttgctcaagcaccatataactctttcagatattttaaaagaatatgtttgcaaaagactccaaatcaatgtattaaattgaaat

SEQ ID NO: 462889 - DNA, 1267 bp, Homo sapiens
tggagacatggaatttttgcaaaaaaaatggggtagaggaaaataagacatctgtgtgagtatataaccatttgatctctttttttagccctctccagggtcaccctagaatcagatctgctccccagcatcttctgtttcctggagtgtgttgtctgctactttggattggccatgacaggctggagctgccttgtgacaggagcaggagggtttctgggttagagtatcatccgcctcttggtggaggagaaggagctgaaggagatcagggccttggacaaggccttcagaccggaattgaggaaggaattttctgaaattgcagaatttgctgtagcaacttcttgtgcaaataactccatgaggaaagtagaaaaggagtcatatccaactggacaatgaactatcaagatccagaaacataaaacaacttgctaagaccatctggttaatgtgtagcagacctcagaccagagcttcatccagaagcatcatcactttactctggagctgatccttggcaaagtgggtcttcagtctctccctttgcctctctgggtgcccaattccctgtcctcctccccaacccagggggagacagacatagagaggttaattaactcgttgaaagtctcagagttagaatatggcaaagctggatttgaacccagacagtctacccagatccagtaggtatcaggaccttcaagccatcctcgaacatctatgtaacaacatctttatcagtttcagaaatcgtttcagaaatcgttctgataacctgaccggtgttcacacagagctccagaacaagaccaagctgacggtgctggaaggagacattctggatgagtcatgcctgaagagagcctgccaggacatgtcggtcatcatccacaccacctccatcatagacatcatcggtgtcactcacagagagtccatcatgaacatcaatgtgaaacgtacagtagcctggggaggagatgaagcaaggtggggaattaaggatcacaaagaaggacaggaagggaaaagaagtctctccactgaacacctgctatgctctggaccaagtgtctttgctgatcactaccaactgggggagttcaaagctgctatcttcagttttttacatgaggaaaccagtgctacagatggcaagtaacttgtccaaggcccccccaggtaagtaagtaaataggagagttagactttaaactcacccctgtgtgactccaaaggctgtggacactctttctat

SEQ ID NO: 462890 - DNA, 452 bp, Homo sapiens
tggagacatggaatttttgcaaaaaaaatggggtagaggaaaataagacatctgtgtgagtatataaccatttgatctctttttttagccctctccagggtcaccctagaatcagatctgctccccagcatcttctgtttcctggagtgtgttgtctgctactttggattggccatgacaggctggagctgccttgtgacaggagcaggagggtttctgggttagagtatcatccgcctcttggtggaggagaaggagctgaaggagatcagggccttggacaaggccttcagaccggaattgaggaaggaattttctggtaagtaaacttgattcatgggtgtgtggttccattttagacactgcatgggtgcaggaaggtggaccttttctagcaagttacagagaacagtagtcaaatctaagccaatctcacatcgatagtcttaaaa

SEQ ID NO: 462891 - DNA, 1390 bp, Homo sapiens
ttcacaaaggacaccatttacctgaagacctcaccagtgggtccctgcctctctagacttccctgagctttgttttgttttgtagcaaccttggcacctttggtgaaggcaaaataaaaggaagtgaagttatagatgagtgtgtaagtgtgtgtgtttgtgtgtgtgagagagagagagcaaaagagagagaaaatgagggggagagaaaatcagagagagagaatgagaaagagaaagaatgcatgagaaagagtgagagagagagggagaggataggagaaagagacagcatcagtgagagagagagagcatgcacaagtgcacagcacagagcagagacagagtaagaggcagtataaggccggatatccctcttttcgatttttcatttatggctttattttttaaccatttgcttctgttgctcaatacccccaagaaattgcagaatttgctgtagcaacttcttgtgcaaataactccatgaggaaagtagaaaaggagtcatatccaactggacaatgaactatcaagatccagaaacataaaacaacttgctaagaccatctggttaatgtgtagcagacctcagaccagagcttcatccagaagcatcatcactttactctggagctgatccttggcaaagtgggtcttcagtctctccctttgcctctctgggtgcccaattccctgtcctcctccccaacccagggggagacagacatagagaggttaattaactcgttgaaagtctcagagttagaatatggcaaagctggatttgaacccagacagtctacccagatccagtaggtatcaggaccttcaagccatcctcgaacatctatgtaacaacatctttatcagtttcagaaatcgtttcagaaatcgttctgataacctgaccggtgttcacacagagctccagaacaagaccaagctgacggtgctggaaggagacattctggatgagtcatgcctgaagagagcctgccaggacatgtcggtcatcatccacaccacctccatcatagacatcatcggtgtcactcacagagagtccatcatgaacatcaatgtgaaacgtacagtagcctggggaggagatgaagcaaggtggggaattaaggatcacaaagaaggacaggaagggaaaagaagtctctccactgaacacctgctatgctctggaccaagtgtctttgctgatcactaccaactgggggagttcaaagctgctatcttcagttttttacatgaggaaaccagtgctacagatggcaagtaacttgtccaaggcccccccaggtaagtaagtaaataggagagttagactttaaactcacccctgtgtgactccaaaggctgtggacactctttctat

SEQ ID NO: 462892 - DNA, 1455 bp, Homo sapiens
cctgggccaccatttcctcatctaaagataggacctggtttaatccattcagcaactcaaggaccactctttattctgcttggtaaagcttcattcttaacctgactcccctgatggtcaaagatggctgtcagcagctcctgctactacatgttcctaaagaggaggaggaagagcagggaggagaaggagacacaggaaggcggcagggtgtcacactcttcccctacatccaagatgatctggaccaccctctttcagccaccctgcagcagaattctcccagcctacaggctaaatctgaagtcctcagcacacaattcaaagcgcgcattagccagagttctctctgctccctgagaatgccagacccattccagaagctgtgccccgatcacactgttgcctcttctgaaacagcctctccctgctttcatgtcaaactctcatgcctcatcaagacccagctcatgctatctcctccaaaaagctttctgaaccctttccttccacaaaaaaaggacatcattgctccttctattttgctctaaagttcttcatgcctagtctgatgcaagcccacacaagaacactggtgttgtcataatggatggcctctggtggcagtagtgaaattcctccaacagctttgtgggccctggattggagctggaaagaaagaccatggtgaatgccacttgtgatgggtccagctgacagtcggacttgggggcccttgggaaactgcctttgaagatcctcagaaatacttgggagggtggtgagtttatgaaggactcacagaggctaccatatggataggaataaaaccagttgtgttgttgcaagaccaattatgggatgaatgatgaaggaactgtggaaatacagaactaagtaaatcaccttctgctgtcatcagagaaggctcaatgcaggggcatcactggcactagctctggaaggttaagggacatggcacaggtgattaactgccacagcaatagatgcctttgaatgaatacactgacctccatgctcagttccgcctggctgatgtgcatgcagattgttcccctgtggcttgagtagcatcttctgctctaggagacaatgggaaacaggatctcattgacacaggccacctcctttcccaagagcccttcattttgatgacaaaggactcttaccttgcaatatgaacaaaggccaaatggcttgtcttcatccagcatcctcattcagaactagccaactgagatctgtcacatggggccatggtagtggggcctgccacatcccacctccctataagctgtcacaccagctcttggcagtgtgagcctgggctgctggccactctgtaaatgtagctacatgaggaagaaaaatagacattaaagcagaaaaggaggtacgatccctagggctgctttcaggatgacaaagggtcgg

SEQ ID NO: 462893 - DNA, 1049 bp, Homo sapiens
gagatggggtcagcagggctggttccttccgagggtgggagggggaacctgttccatgcctctctcagccctagtgctccttggctcacagatgcaatgctccagtcctcacaggtgcagtgctccagtcctcacaggtgtgctccctgtgtatcttcacaccatcttccctctgtgtggacctgcgtcctaatcccttcttgttaggagggcactagtcatataggaccaggggccagcttaatggcctcactttcacttgattccttctgtaaagaccctatttcccattaaggtcacattctaaggtcctggggattaggatgtcaacatactttttagggagccataattcagtccataacatatctcaaaataaatacatccaaaataaatcccactgccttcccctgaaacctccccttcctcctgatttccatatgaccaacaccatctgaagctcagctttgtctttttcctcttctttagaatatttgcgttttccttattccctatcccacccatagagacagaataagctctttaaaggcaggacaagcgtggatataagtccagcaagaagcatggcacgtagcaggcatttccgtatcctctttggtgtgagtaggactgactcaagtcgggctgactttgcaggcttctgtgtgatgcaattcttcatgacgggagcaggacatttagacttaataatgacacccccatcttcaggagatgatggccccttccctgtcacaaagggaatggcagtgaagctgaagtttttacgcttctctgacagccatcaatcaaaaactaaattggcagatactcatcatcggttggtgggtggtaagtacctgcacccagccatccaggggaggtctccctgggttcacgtgtcagtggctcctctctctctgtcccctacttgggtaacgaacatgaaagcaattacgtgtaggtcctctgaacactccgtcactaacagggaatgccttggacttccatttcattgcagcaacaccactacagaacttttgcaatagaaa

SEQ ID NO: 462894 - DNA, 1147 bp, Homo sapiens
gtcctcacaggtgcgatgctccagtccttgcaagtgtgcttcagtcctcacagatgcaatgctccagtcctcacaggtgcagtgctccagtcctcacaggtacagtctttagtcctcacaggtgcagtgctccagtcctcacaggtgcagtgctgcagtcctcacagatgcagtgctccagtcctctcaagtacggtctccagtcctcacaggtgcagtgctccagtcctcacaggtgtgctccctgtgtatcttcacaccatcttccctctgtgtggacctgcgtcctaatcccttcttgttaggagggcactagtcatataggaccaggggccagcttaatggcctcactttcacttgattccttctgtaaagaccctatttcccattaaggtcacattctaaggtcctggggattaggatgtcaacatactttttagggagccataattcagtccataacatatctcaaaataaatacatccaaaataaatcccactgccttcccctgaaacctccccttcctcctgatttccatatgaccaacaccatctgaagctcagctttgtctttttcctcttctttagaatatttgcgttttccttattccctatcccacccatagagacagaataagctctttaaaggcaggacaagcgtggatataagtccagcaagaagcatggcacgtagcaggcatttccgtatcctctttggtgtgagtaggactgactcaagtcgggctgactttgcaggcttctgtgtgatgcaattcttcatgacgggagcaggacatttagacttaataatgacacccccatcttcaggagatgatggccccttccctgtcacaaagggaatggcagtgaagctgaagtttttacgcttctctgacagccatcaatcaaaaactaaattggcagatactcatcatcggttggtgggtggtaagtacctgcacccagccatccaggggaggtctccctgggttcacgtgtcagtggctcctctctctctgtcccctacttgggtaacgaacatgaaagcaattacgtgtaggtcctctgaacactccgtcactaacagggaatgccttggacttccatttcattgcagcaacaccactacagaacttttgcaatagaaa

SEQ ID NO: 462895 - DNA, 1168 bp, Homo sapiens
tgtggcccacatgagagctgacagcagcctctggatgtactcccgtgcatctggaaggggagagaatcacagacgatgtaatttcaacaaggacgatttcggtcttttgcaaagacccttctattagcaggagcagcttggatgctcctcctcatggccagtctccagagaggcctactgctcaccagatgtgtggatgaacaaacctgaacagcctggaggctggtgatatctacccccacagcgcttcttccttggtcccccaagcaggctccataactccaagacttcacgcagccttttctgaacttggaagtcaagagaaaattcacagaactttggaaaatacattttcttttaaggaagaattttttgttttcatttcaacagccctggctggtgatgaggggtgatgcgaggtgccctgttttccatcctaacacctatttccaggtgggggcagggagggctccaacctgaaatgttatttcaaaacctttccgggccttgcagctccatttccaggccacatgctgcaaagcacggcacgatttcccattacgtgctgttgccctttctcgtctgagcacctttcaaagtgggaagacccagcctgctgcaacaccctccctcctgtccccataaattaagtctcactgcctgatgtgaggcttaaataaatagccttgcccggcacccgatggccacactcctgatagatgggcttgccaagagcagcaaactcagctcgctcctccttgcccctccacagagagaagatgaaactggtgttttgcaaatgcttcctgcctgctttctgccagccaaggcacattccaagaaggagcaggccagcaaagtcttgtcatctgacggggctgctatgacaaaatactatagactgagtggcttaaacaacagacatttatttctcatagttttggaggctgtgaagtccaagatcaaggtgccagcaactttggtttctggagaggagctctgtcagctctggagccaagagattgctcaactggcatttcaggggcctgatgggctcctcctccagagaaacttcttccctgttggaggcttcagaaaatggcaagcccatcaatgaaggcacaggacacatccacacaagcacaaatatttcctcatttacataaac

SEQ ID NO: 462896 - DNA, 729 bp, Homo sapiens
gtgcctcttgttggggaagatgagactgctgggtgtggatgtctgagaagccaaagtggtggtggtttcagaacagtggctgagtacccaccgtgggccaggcccctgccctcgagaactcagaatctggggacatagacaaatgtgtcatgccatgtggcagcatcatgtgacaacagcatgtgcccagtaccttctccaacagtgcttgcggatagtaggaacacaataaacatgtgttagttaatgaatttcattaaatatttatacaacatttactctttgccaggcttcattcaagtggtttgcaaacatttaattcatggaagctgtaataaccctggtcagcccatcttcccagggcccgttggcacccccgttttgctcctggcccactgtggcaataggcagaaggccatcttggggggtggtagtggaagatttagggaaagcttgttgcaaagtcacgaccagagagtctcggaggtctgggtgggacactgggctctgagggacatcctgtcccccatccctcagccagatgctgggccctggcttgggagccatatggacctggatttgaccttgaacaggtcatttcacctgagtgtgtatagtgggaatgataacatccggctcacagaactgtggtgagaattagagatggtgggtgtcgaatgattagcacctaatcagcattttacaataaatgcaaattcttcccttctc

SEQ ID NO: 462897 - DNA, 1033 bp, Homo sapiens
tcatttcaatttaatcagtatatgctaagaccaagaaaatgcagctggttggtggacccgagccctaatcatatggctgacaccaaagtcatgaagaaacatgaatcctattgtgaattgtgcgtgcctgatgatctgaggtggaacagttaccttccaaaaccgtccccacttcacccccggattgtggaaaagttgctttacacaaaaaccatccctaagtgccaaaaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttttacatgggcagcaagaccctgcgaggcaggaacacatcctttgaatactaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagaactgtgtgtctcatggtatataactcttaaggcaaataaatgaactgacttcaaaaaaa

SEQ ID NO: 462898 - DNA, 454 bp, Homo sapiens
gtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcagga

SEQ ID NO: 462899 - DNA, 2811 bp, Homo sapiens
  misc_feature (2)..(3): n is a, c, g, or t
  misc_feature (7)..(9): n is a, c, g, or t
gnngcannnccagagtttgttccttctgatgttcgaatgtgttcggagtttcttccttctggtgggtttgtggtcttgctggctcaggagtgaagctgcagaccttcgtggcggcgtgtctggagttgttcattcctcctggtgggttcgtggtctctcgctggcttcaggagtgaagctgcagacattcgcggcgagtgttacagctcataaaggcagtgtggacccaaagagtgagcagcagcaagatttattgcaaggagcaaaagaacaaagcttccacagtgtggaagtggacccaagcaggttgccactgctggctcgggtagcctgctttttttcttttatctggccccacccacatcctactaggctcataggcagaagggacttgcctggtctcaatgagactgtgaacttaagacttttgggttaatgctgaaatgagttaagactttggtgaactgttggcataattgtgtctgttctcatgttgcaataaagaactgcctgtgactgggtaatttataaaggaaaaaggtttaattgactcataattccacaggggctcaggaaacttacaatcatggcagaaggggaggcaaatgtgtccttcttcacatggtggcgagagagaagtgccaaacaaaggtggaaaaacacttgataaaaccatcagatcttgtgagaactcacttgctatcattagaagagcatgagagaaccatcccataatctaatcacctcccatgagttccctccccaacaggtggggattacaattcagattacaattcaagatgggatttcagtggggacacagatccagaccatatcattctgcccctggtccctcccaaatctcacctttctcacatttcaaaacacaattatgccaacagttccccagcataataaagtgcacaataaatgtaatgtgcttgaatcatgctgaaaccatcacctgccggcactccccctgcccaccccctatggtttgtggaaaaattgtcttccacaaaaccagtccctagtgccaaaaaggttgggggactgctgatctatgggactattgggttggtttcagtgtgaggtgctggtgactggcaccagagtgggagcagtcaatacaccagggtattatcattggttgtctctgagtgttaagattatggactatttttctgcttctttgtgtatttttagtctttgcacatgttctacaaagaataaattacttgtgtaatcataggaaataaatactacctcttaccctctcccctgccccagtctggcataattgaaaaatgaacgcttagagaaaggaggtcacccaagatcagacttcagaattcaaatttaataagatctacttgttattcacgatagagtttgtcaaacattttcaccaaattttagcaacaagtttgagtgctgcaggagataacgagaagtgaaaagatggtgagggagacaaaacaaaacaaaattggcaaagaaaaagatggcattttaaatagcaacacgaacagtctgcctaaggactaatctactgtgtgagaaaatgatttttaattgaaaagttctttttgagaaagttttttaaaagtcttatataaaaatatggaatatataagaatttaactaataccttgtgtttagggtgcattataactgtataaggaatttttacatgaaaatttgggagaacaagagagaacatcatgtaataatgtgattaaacttgttactcagccattttacaaattctggaatataaaggacaaggtagagtatgttccaaggcaggcagtggccacacactgcttggcttgtaggccctattagggattttggtgtttctcctaaaaaccagtggaaaaccactgaagtattttaagcaagaagtagcttgatcaggcttgagtttcaaaaggttcacttttttttttttttaaacaggggtcatatcagaaagatatgtttgatgaaattaactacagaatcaagaagtatatactcaaaaatgcaaatactacaatatataagacaatgctggagtgcaatggtgcaatcttggctcactgcaacctccgcctcctgggttcaaatgattctcctgcctcagcctcccaagtagctgggactacagaccgcaaccaattgctcttccttcccattgaaagaaacccaggctgtacctgctctttcatctcctgtgtggaaaacatctatcggctggaagccctgagtcttcattttcaaggattttagttgtaagctgtttaaggcataagctaaagtttcaggcagaggtaattttagtagttaagcctgatttttacttccaccctctgtcctccagggctatatgggaagctttctgtgagtggataagctctttagctaagatgtaaacatgttccctgctatctgataaaggttcctggagactgacactttaaaaaaaaaaaaaaaaagaaagtgaggaaaaaaagaaaaggagaaactgaatccaaggcttacaaagggattagaaaactgtaccccagatggaaaattttatgggctctggagaaaatgtgtaagtgaaatatcggtatcataaaataacaggaaatagtgtaatctacctgatggagaaaattgtcactttaaaaaaactatcctaatttccttcaaaattgttcttgtttttgagccaataaacttcagctaagctcaccatgggtctttcttctgccaaactcctacttaccaacagaacctttgtgtgtttacaattgaaacttttccattctatttttttct

SEQ ID NO: 462900 - DNA, 920 bp, Homo sapiens
  misc_feature (25)..(26): n is a, c, g, or t
  misc_feature (41)..(41): n is a, c, g, or t
  misc_feature (60)..(62): n is a, c, g, or t
aaaataaataaaaaaaaaaaaaaannaattaaaaaatatanaattaaaaaataaaataannntattttgaggggtcatatcagaaagatatgtttgatgaaattaactacagaatcaagaagtatatactcaaaaatgcaaatactacaatatataagacaatgctggagtgcaatggtgcaatcttggctcactgcaacctccgcctcctgggttcaaatgattctcctgcctcagcctcccaagtagctgggactacagaccgcaaccaattgctcttccttcccattgaaagaaacccaggctgtacctgctctttcatctcctgtgtggaaaacatctatcggctggaagccctgagtcttcattttcaaggattttagttgtaagctgtttaaggcataagctaaagtttcaggcagaggtaattttagtagttaagcctgatttttacttccaccctctgtcctccagggctatatgggaagctttctgtgagtggataagctctttagctaagatgtaaacatgttccctgctatctgataaaggttcctggagactgacactttaaaaaaaaaaaaaaaaagaaagtgaggaaaaaaagaaaaggagaaactgaatccaaggcttacaaagggattagaaaactgtaccccagatggaaaattttatgggctctggagaaaatgtgtaagtgaaatatcggtatcataaaataacaggaaatagtgtaatctacctgatggagaaaattgtcactttaaaaaaactatcctaatttccttcaaaattgttcttgtttttgagccaataaacttcagctaagctcaccatgggtctttcttctgccaaactcctacttaccaacagaacctttgtgtgtttacaattgaaacttttccattctatttttttct

SEQ ID NO: 462901 - DNA, 884 bp, Homo sapiens
ggaccgcccaaacacgaggacgagggccgcgtcaggggtcatatcagaaagatatgtttgatgaaattaactacagaatcaagaagtatatactcaaaaatgcaaatactacaatatataagacaatgctggagtgcaatggtgcaatcttggctcactgcaacctccgcctcctgggttcaaatgattctcctgcctcagcctcccaagtagctgggactacagaccgcaaccaattgctcttccttcccattgaaagaaacccaggctgtacctgctctttcatctcctgtgtggaaaacatctatcggctggaagccctgagtcttcattttcaaggattttagttgtaagctgtttaaggcataagctaaagtttcaggcagaggtaattttagtagttaagcctgatttttacttccaccctctgtcctccagggctatatgggaagctttctgtgagtggataagctctttagctaagatgtaaacatgttccctgctatctgataaaggttcctggagactgacactttaaaaaaaaaaaaaaaaagaaagtgaggaaaaaaagaaaaggagaaactgaatccaaggcttacaaagggattagaaaactgtaccccagatggaaaattttatgggctctggagaaaatgtgtaagtgaaatatcggtatcataaaataacaggaaatagtgtaatctacctgatggagaaaattgtcactttaaaaaaactatcctaatttccttcaaaattgttcttgtttttgagccaataaacttcagctaagctcaccatgggtctttcttctgccaaactcctacttaccaacagaacctttgtgtgtttacaattgaaacttttccattctatttttttct

SEQ ID NO: 462902 - DNA, 1895 bp, Homo sapiens
agtttctctttctctctctcctctttcacttctctctctctgtctctctttctctctctctctctctttctttttgacacagggtcttgctctccttctgctcctccctgatgagccaggtacttttcctggtgtttagctttgctaggtacttcctaattcctctgcttgttgcctctttgctatttatctttcctaacaagaacctaaagacaaatgtggagaaagcagctttgcacctcctcctggttttcacaacaggggagaacaggtcttctctgtgtgtgcaggaaatccacggggctggtgagtttatcgagggtcatgcttacagaagtgttcgttcagatatttcccacttcacactctgcaagcacagtcagcccaatgtgcacagatacatgaacatctatgtatggaagagaacaaataaacttctcccacagtcctccacatgtcaggggattttgctggccctccatgtggcttctgctgtgttattcagagacattctctgcatggggagtgctccagtctgaagcactttcaaccatcaaatgcctccatatcaagtgccttctccaacaccatatggtgaggggctttatctcattttgaaaagcaggtctttcaaccccacctaggttttgtgagcctggaacttgggagactgttcggtagcccaggtctcctaagagtgggtgcagtggctgtgaccctgggctgctcagcattcatgtggaaatgaaggaaggaggactggatcaatcccatttgaaagcatccttctctgcagcccacacaatcctccaatgacactgacagaggtgtaccctcctagtgtactgggaccaaaattcggaagtgtctgcaaacttgctttaaccgtatgggaaataacctctatcacctggaatttccttgggactttggaaaatacaagagaagtatgagacttgggtcttcccttggctgtgtttaattcactcttctatggaataccaatgattctcactaagacttttgcctttttataaccacaatgtatgctttatggagaagattttactctttgctctacttagaaagaataaatatgagcaatgctttaggttttatgccctggacttaatatttttctgatttctgttttgagattaaattctcattctctgacaaccactaatctactttctctatatatagatgtacttgttctgggcacttcctctatatggaataacaaattgtggcattttgcatctgcttctcagcatagtgtcctcaagtttcatcctttttagcctgcagcagtacttcaacattttatggccaaataatattccactatatggttatacctaattttgtttattcatttaacaatgttttcactttttaactattatgaataatgctgctatgaacagctttgtacatgtttttgagtgaacatctgtttttcatttttttggttataaacctaggagtgcaattgctgcatcatatatcactttatgtttaacttttttatgtttaatttttttatgtttaacttcttgaggaactcacacactgttttccaacctcagtggctatgctactttacattcccactagtaatatatgagaattccatattctccataactttccaaacatgtattgtctttatttttttcttaagtcatactaatgggtgtaaagtggtatctcattttggtttgaatttacattttcctaatgatgaaaaacatcgaacatctttgcatgtgcttcttggccatttgtgtgtttcctttagagaaacctctactcacaacttttctcccattgttaaatgtggttgtcttttattgctcagttatatgaatcccttatatactctaggtatt

SEQ ID NO: 462903 - DNA, 2154 bp, Homo sapiens
cttctttctgtgtggaacctggaattcaagctgtgggtgagaagctctctagcagggactctgaccttatggaggatcgctgtttcccccatttttccttttcacccaaaaaagtcctgcttctctcacccttcaaacagcctgtgagcctaaatttttgtggccatgggacagacaaggaccccgtcttcagctgaactaaggaaaagtcctgcgacatctttggtacgcactgtggaggctctacaaacagccatcaaactccaaccagtcacccaaccagagcctctgaggatggccccttctgcggggaacccttacatgggcctctgactgatgcttccccaaaacagtgccccctgtcatcaggaagcagttaacactggtcttcattcttacgcttatccttattctaacagcagttatatgtacttctttagacgggggaataagacagccaggtgggagggggtctctggaaaactccatctggcctgtgcactagggtggaacctcaggaagttgatgacatttgtagctgggagcagcctggcccctcctcttcctgtgtggaacctgaaattccaccggcttggcaggaagcgctctagcagggactccggctttgcagagcatccctgtttccccgtttttcccttttcacccaataaaaccctgcttcactcacccttcaaaccatctgcaagcctaaatttttgtggctgtgggacggacaaagatgcctttagctgactgaggaaaagtcctgcaacacaggtatcactgcacatttataatattgtttctctgttttaaaccttgtataaataggaaaatattgtatataatctcaagcagattgttttcttttgaaaagtattcatatatgttaaagatgtagttctagttcattcattttctctgttttgactcttttatacatatactacagctcatttatccattttcctactgttgcaacatagattgcttataattcttctaattactaacaatgctggtatgaaattgttgtgtatatctctggtagatatgtgttatttcttttttgcaatgctagattataattatttgtctaaggtggagattaccagggtagactcgctctggccgtatgtaatgatgtctgtggctacataacctgccaacacttagtcttatcacacattttattttaaaatcaatatgtaaaaaatactaatttacttggtagtaatttaaatttttctgattattactgaggttgaatatgttttcatatgtttactgaatattcctgttaattttctcatgaatttcagttaatgtttctgttgattttattaatttgtagtggttttgaaacatattctagaaaccaatattttgtctgttgtatgtgttacaaatatatttattttgtatagcttcttcatatttagtacttttacaattttaacagtaaaattagtttcatgttttatagctataattattataacttttaaataaatatttcctcaattaaaataaaaatgcattatccttaattttcttcgaagatttttgaaatgtgtatgactttttcattcttgtgctggatttctacctgaaaaatatttctcccttctgaggttcagtacctgttttttgatttagatctatgattcctgtgactctgatttgatttgataatttgtattgtctaatagtaacgtttttaaagcaggcaaagatagattaagcctgactttcaagtttaatgcattcctttaattctcatatgcctgaaactgtctcagtaaggctccaatgagaaatctctcctttcttacttattttaaaattctgacgataaagtaacacaggcctctaagattatcacaatcaataaatggatcttttatatcactcaacagaattatgtggtgatatggtcttgctaccataaattttcatatcattgttcattttaaaaaaataataataaaccaggaattagaatatcattgatgctattatttataatgtgaagcccaagaggaacatacttaatttaatgttatgttcactacaatgacaaaatgttacgtttgatttaatatgcagtttgtgtgatgccaaaataagctgtgaattatgcaaaaagaaatc

SEQ ID NO: 462904 - DNA, 2127 bp, Homo sapiens
cttctttctgtgtggaacctggaattcaagctgtgggtgagaagctctctagcagggactctgaccttatggaggatcgctgtttcccccatttttccttttcacccaaaaaagtcctgcttctctcacccttcaaacagcctgtgagcctaaatttttgtggccatgggacagacaaggaccccgtcttcagctgaactaaggaaaagtcctgcgacatctttggccatcaaactccaaccagtcacccaaccagagcctctgaggatggccccttctgcggggaacccttacatgggcctctgactgatgcttccccaaaacagtgccccctgtcatcaggaagcagttaacactggtcttcattcttacgcttatccttattctaacagcagttatatgtacttctttagacgggggaataagacagccaggtgggagggggtctctggaaaactccatctggcctgtgcactagggtggaacctcaggaagttgatgacatttgtagctgggagcagcctggcccctcctcttcctgtgtggaacctgaaattccaccggcttggcaggaagcgctctagcagggactccggctttgcagagcatccctgtttccccgtttttcccttttcacccaataaaaccctgcttcactcacccttcaaaccatctgcaagcctaaatttttgtggctgtgggacggacaaagatgcctttagctgactgaggaaaagtcctgcaacacaggtatcactgcacatttataatattgtttctctgttttaaaccttgtataaataggaaaatattgtatataatctcaagcagattgttttcttttgaaaagtattcatatatgttaaagatgtagttctagttcattcattttctctgttttgactcttttatacatatactacagctcatttatccattttcctactgttgcaacatagattgcttataattcttctaattactaacaatgctggtatgaaattgttgtgtatatctctggtagatatgtgttatttcttttttgcaatgctagattataattatttgtctaaggtggagattaccagggtagactcgctctggccgtatgtaatgatgtctgtggctacataacctgccaacacttagtcttatcacacattttattttaaaatcaatatgtaaaaaatactaatttacttggtagtaatttaaatttttctgattattactgaggttgaatatgttttcatatgtttactgaatattcctgttaattttctcatgaatttcagttaatgtttctgttgattttattaatttgtagtggttttgaaacatattctagaaaccaatattttgtctgttgtatgtgttacaaatatatttattttgtatagcttcttcatatttagtacttttacaattttaacagtaaaattagtttcatgttttatagctataattattataacttttaaataaatatttcctcaattaaaataaaaatgcattatccttaattttcttcgaagatttttgaaatgtgtatgactttttcattcttgtgctggatttctacctgaaaaatatttctcccttctgaggttcagtacctgttttttgatttagatctatgattcctgtgactctgatttgatttgataatttgtattgtctaatagtaacgtttttaaagcaggcaaagatagattaagcctgactttcaagtttaatgcattcctttaattctcatatgcctgaaactgtctcagtaaggctccaatgagaaatctctcctttcttacttattttaaaattctgacgataaagtaacacaggcctctaagattatcacaatcaataaatggatcttttatatcactcaacagaattatgtggtgatatggtcttgctaccataaattttcatatcattgttcattttaaaaaaataataataaaccaggaattagaatatcattgatgctattatttataatgtgaagcccaagaggaacatacttaatttaatgttatgttcactacaatgacaaaatgttacgtttgatttaatatgcagtttgtgtgatgccaaaataagctgtgaattatgcaaaaagaaatc

SEQ ID NO: 462905 - DNA, 1043 bp, Homo sapiens
cttctttctgtgtggaacctggaattcaagctgtgggtgagaagctctctagcagggactctgaccttatggaggatcgctgtttcccccatttttccttttcacccaaaaaagtcctgcttctctcacccttcaaacagcctgtgagcctaaatttttgtggccatgggacagacaaggaccccgtcttcagctgaactaaggaaaagtcctgcgacatctttggtacgcactgtggaggctctacaaacagccatcaaactccaaccagtcacccaaccagagcctctgaggatggccccttctgcggggaacccttacatgggcctctgactgatgcttccccaaaacagtgccccctgtcatcaggaagcagttaacactggtcttcattcttacgcttatccttattctaacagcagttatatgtacttctttagacgggggaataagacagccaggtgggagggggtctctggaaaactccatctggcctgtgcactagggtggaacctcaggaagttgatgacatttgtagctgggagcagcctggcccctcctcttcctgtgtggaacctgaaattccaccggcttggcaggaagcgctctagcagggactccggctttgcagagcatccctgtttccccgtttttcccttttcacccaataaaaccctgcttcactcacccttcaaaccatctgcaagcctaaatttttgtggctgtgggacggacaaagatgcctttagctgactgaggaaaagtcctgcaacacaggaggtgcctgggaaagacagaaaaagatgatttgttcaaaaactcttgcaaaattgctaatggcaatacagtaacaatatgtggtagtaatagaatccttacatatgaaatgcttctagccggttgtacctggtctacacaggctaatgaaatgttaataggaaataatccttaacaaaagggttacctttgtgcaagtaatgtcctgatgcatgtattagccccttacatgttaattttgaaataaaaaatgtgttaatagaaga

SEQ ID NO: 462906 - DNA, 787 bp, Homo sapiens
ctacagttactaagcgcccactgtgtgccctggaagggactagactcagcaggaaaaacatccaggcaagtggacagcatttgcaacagcccagcaataagaaggaccatattctacttgggaaaaggtaaagtcgtttcatatggacggagcctgccaggaaacctgtcattcaaccctttgcaataaaacagctcctcatgaatgaagcaaaataaatcagaagttgtgggcttttaaactcactaaatgaaagcacagcatgcatgcagcctccctccaaattaatcaccagattaaatgcaagatgtgcacaccaaatcaatagcttgtgacggggacctcctgcctgtgcttcaggaaaattccatttcctttcagatgttgtcgcttgaaatgtcaggaagtttccattcatcacccgcccttgaaaatgccaccatcaccatacttcatggactaatcctattcacaagggctgtgctctcaggacacaatcacctcccaaatgccccacctcttaatgccatcaccttgggggtcaggatttcaacatatggatttggggagaacataaacactcagatcacagcaactggaaagcagggaattgaagttgccactagaacctcagtgaatggtacatgtgattgtcacacatggatatgcccagtaaacggcaaaggaaaacttcttgaggctctaatcccagagtgctggctcagccattcttaacaaattcttttgttcttctcacatattcttgtgttgaaaaatttcatggggt

SEQ ID NO: 462907 - DNA, 1175 bp, Homo sapiens
tgtccaggtgctctcctgccgccaacacagccctaatgagctctgcatattcaaaacacaagtaattgatagtccaatttaaagtgtgcagaggccaaatttctttccagacgctgaaggaaaaacaccagctgaggaagaatgaagaactgcctgttctaagttattctccttctgtggtcattcgagcaccaggaagaccaggtttgccccatcaagtacctcaagaaagaagtcaattacctaaagaagtcaagcaaagaggaaaggacaaaatgaaaatcatgtaccagggtacacgtcgaggctccaagctggaatgaatatggccttcaacatactctttatcatacagaagcttgtgttcagggcttggattttgaagtcagacagacctggattaaaaaccaattcaactacctattacatatgtgacctaggaaaaacatccaggcaagtggacagcatttgcaacagcccagcaataagaaggaccatattctacttgggaaaaggtaaagtcgtttcatatggacggagcctgccaggaaacctgtcattcaaccctttgcaataaaacagctcctcatgaatgaagcaaaataaatcagaagttgtgggcttttaaactcactaaatgaaagcacagcatgcatgcagcctccctccaaattaatcaccagattaaatgcaagatgtgcacaccaaatcaatagcttgtgacggggacctcctgcctgtgcttcaggaaaattccatttcctttcagatgttgtcgcttgaaatgtcaggaagtttccattcatcacccgcccttgaaaatgccaccatcaccatacttcatggactaatcctattcacaagggctgtgctctcaggacacaatcacctcccaaatgccccacctcttaatgccatcaccttgggggtcaggatttcaacatatggatttggggagaacataaacactcagatcacagcaactggaaagcagggaattgaagttgccactagaacctcagtgaatggtacatgtgattgtcacacatggatatgcccagtaaacggcaaaggaaaacttcttgaggctctaatcccagagtgctggctcagccattcttaacaaattcttttgttcttctcacatattcttgtgttgaaaaatttcatggggt

SEQ ID NO: 462908 - DNA, 2119 bp, Homo sapiens
cgggaaagtgccaggctgaatagatttagcgtgcttggaacgctcgagtgaaggagggggagaaggcagaagggagagcatgggcggagcagcagagatggtgactgtcttgagtcatggtccacctggagcaagggctggcatcatctcaacaatggctgggttgttgacaaactgcctggaggaaggggtaagaaacttcaaggaacttcgagccaaatttcaaaatcttgatgctccacctcttccaggacctattaaattcccagcaggtgtttctccaaagggtgacattggaggcacacagtcaactcaaattttggccaatgggaaacccctctcatccaaccacaagcagcgcacaccatactgttccagtagtgagtcccagcctcttcaacctcagaaaataaagttggctcagaagagtgaaattccaaaatgttctaactccccagggcctctgggaaagtctactgtatgttctgcaacaagttcacagaaggcttctctgctgttagaggtgactcaatcaaatgttgagataatcactaaggaaaaagtaatggtggccaatagcttcagaaacaaactctggaactgggagaaggtttcatctcagaaaagtgaaatgtcttcagcccttctccttgccaactatggaagtaaggccatccatctggaagggcaaaaaggcatggggcttactccagaggaacccaggaaaaagctggaaacaaaaggagcccagactcttccttcccagaagcacgtggtggcccccaaaatattacataacgtctctgaagatccctcttttgtaatttctcaacatatcagaaaaagctgggaaaacccacctcctgagaggagcccggcaagcagcccctgccagcccatctatgagtgtgagcttgccagtcaggccccagaaaaacagccagatgtcaggcatcaccaccttcccaaaacaaagccattgccctccatcgactccctgggtcctcctcccccaaagccttcaagacctcccatcgtgaacctccaggcctttcagaggcagccagctgctgttcccaagactcagggggaagtgactgtggaagagggctccctgtctccagagagagggctgcacagttgctgctgccgctcacattttacagctcaagatacttgggctcagaaagtttgccacttgctgagccatgattccaacccagatgtgccataactacactgattatatacctcacctcccacacaaagatgttcctgttctcaaaaagctgccactaaattttagtgctttcttttaagcatggagtgtgtatctgtttgccaaaacaggaaactgaaatggtttcacatgcttcatcgactgtaaattccattctggaaatccccacagaaattaaaaccatgatcactgaccccataatttcccaaactttctagatagagctttacatagtctgatgttcttaaaggtgagaaaactgaattctggaatcttttataactgctttaatcctgggtgctataagaaatgggtggatcagctgccttgaaataatttttttatgtttactttagcaacttatgaagttggaattgaagaactccaaaagaagaactagttcccttcacaccaaactaccacaagtcagttttttgtattcttttccctttttttctactgtcacgatctttgtgtctagcaatgagtttttcatgtggtcaaacatgtaccaagtccctctggtgtgatagcacttgtgcatagacagtagtgcttaacccttatagttaccctgtgagctgatatcactgctcccatattacagatgacattaaggttcagagaggtttagtaacctgtaaatcatgtaacaaagatataaaacaaggtctgtctgacttgtcattctaccagtgctgcatctaatttgctagaattatgtgagagtataatgagctatgatacctggattttgtgatggcattttagatgcttagatattttctattcttctcagagttcttagacagattccaaataatgaatgtcaccagatctataatcactgaataaatgaggggctacattgtgatcatt

SEQ ID NO: 462909 - DNA, 972 bp, Homo sapiens
ctcagatgttgagagaatgccaaggaagaagtacattggtgtgtggaggcttttatccaggtggatgacactgataatggtgacattgccactaagaatgactagatacagaaaaagaaaaactacaaagagggccagctgaatttcaccaaggctggaaaaacccagcaacaggaattcggtgaccatggtgaggttttctgccaagatctgcaaagggggaaagaagtaaaacatattcagatagaactacgaaaatagaatacacactcaatgggctgaccaactgattcataacatctttattggagaatgaactttctttttctctccaggccccctgtaacccctgtctggtattttctacatgactgattcctctctagagccagaactatggaatcttaagagaatctgtatttctttaaaaagaataaatatcttatgacactctttatttttgtttgcctttcctctcttatctctcacaacactgcaaacatttattccagttcccagattttatcccaatgttttaatcttatggaacttcttagttcactgaacatgcaaagagccatgtcttataacaacaatgccttttcctgtgttagggcagatcctctaatctttcaaatcacttccctggaaggaatatattttgagaaatggcagagcaatggactgacaggtgcttgtagatccagcagtgacagcagcaaggagcaaatatgggaaatgaggcagaatgtgggagaactcaacttccctggcagcagtgtgaagaatggattggggaccaagggacttgaagtttttgcagtaatccagaaaagacaggatgatcctgtaaaaacagaaaaggaatgtgattgaggaacttttagccagtggaatctataggacacaatgggtggtatgaggattaaaaaaaaaaaagtagtgaagatgacttccatgtgcttggcatgg

SEQ ID NO: 462910 - DNA, 945 bp, Homo sapiens
attactgaaacatacaagcacataatcagacacatttttggagcagaatatagaatagctcagatgatttgagaagcactgatggagaagtcgagttccttattcagatattaagccaatcttactctttccaatgtcatcttggtgacccaattgtgacaagaatgtccagatacagtttggtgttgtgaactggttggcttccccgttttgcagatagaactacgaaaatagaatacacactcaatgggctgaccaactgattcataacatctttattggagaatgaactttctttttctctccaggccccctgtaacccctgtctggtattttctacatgactgattcctctctagagccagaactatggaatcttaagagaatctgtatttctttaaaaagaataaatatcttatgacactctttatttttgtttgcctttcctctcttatctctcacaacactgcaaacatttattccagttcccagattttatcccaatgttttaatcttatggaacttcttagttcactgaacatgcaaagagccatgtcttataacaacaatgccttttcctgtgttagggcagatcctctaatctttcaaatcacttccctggaaggaatatattttgagaaatggcagagcaatggactgacaggtgcttgtagatccagcagtgacagcagcaaggagcaaatatgggaaatgaggcagaatgtgggagaactcaacttccctggcagcagtgtgaagaatggattggggaccaagggacttgaagtttttgcagtaatccagaaaagacaggatgatcctgtaaaaacagaaaaggaatgtgattgaggaacttttagccagtggaatctataggacacaatgggtggtatgaggattaaaaaaaaaaaagtagtgaagatgacttccatgtgcttggcatgg

SEQ ID NO: 462911 - DNA, 925 bp, Homo sapiens
gaggagccgtggcgcggcggcgggcgcgggactgacagccccaggccccgcctccagaccccgggccccgccccttcctggccgcgcggcttgccccgcctcctccgcccaccgccggggtcaaactgggtccatcggcccggagggcggggatgctcgctttcgattggcctcaaagaggcgcgtgcgccgtggctggggagggtagcggttacgctgagcgccggcgttgctggtccccgacccctggtacccgggcatcgttttttcatcccgggcagctgggaccccgggatgacctaaggaacaaggattcagacgcagactccacggtgaattggccttattcacgtgtgaacgaacgtccaggagaaaaccaaacccgaatgggccaggctctaaccagaggagaccccaaaactgtgatctgcatcagaaaacgaaccagccagccggttcccggctctgccaggtctaggggtgctttattcaagccctgggttcgctccctggtcagcaagtatgaggtatttgcagagggtctagaagatgtgaagggagattagcccgcatttaggactgtgccaaacagagagtgagtgatgctgaagaaagtggcctcctctgctccagccctccctcctcctccccaacccctggctctcccacctctccctcagcaccggcgccctaccctcagcctgtaaacagtatcaggtctcgcccaacaaaaatcaatggagacccagcaattccactcaagagaactagaaacatgtctgtactaaaacttgtacacaaaatgttcatagcggtgtattcagaaggccaaaaaaggaaacaactgaatgtccactgattgacaaatggatgagcaaattatggtctatccatacaatggaatagtattctgccataaaaaata

SEQ ID NO: 462912 - DNA, 775 bp, Homo sapiens
gaggagccgtggcgcggcggcgggcgcgggactgacagccccaggccccgcctccagaccccgggccccgccccttcctggccgcgcggcttgccccgcctcctccgcccaccgccggggtcaaactgggtccatcggcccggagggcggggatgctcgctttcgattggcctcaaagaggcgcgtgcgccgtggctggggagggtagcggttacgctgagcgccggcgttgctggtccccgacccctggtacccgggcatcgttttttcatcccgggcagctgggaccccgggatgacctaaggaacaaggattcagacgcagactccacggtgaattggccttattcacgtgtgaacgaacgtccaggagaaaaccaaacccgaatgggccaggctctaaccagaggagaccccaaaactgtgatctgcatcagaaaacgaaccagccagccggttcccggctctgccaggtctaggggtgctttattcaagccctgggttcgctccctggtcagcaagtatgaggtatttgcagagggtctagaagatgtgaagggagattagcccgcatttaggactgtgccaaacagagagtgatgactgcttaatgagtacaaagcctctttggggggtgattaaaatgttaaggaattagacggtggtgatgactgtacaactttgtgaatataataaaaaaccacataactgtataaaagggtgaattttatggtatgtgaatgatattttaatttaaaccaaaaatccaaatgacc

SEQ ID NO: 462913 - DNA, 1362 bp, Homo sapiens
atttaaagaattatcatgatcaactgggatttatcctggactacacagggcctggaattcccgtcactccaggatgtaatcctcacatctgaaagaagaaaatgctacatcaagattgaaggtcatgtcttacgatatttgtggaaagctgaaacttgggacaggatgcttgagacaggggaaattacatttctccaaggtgttcattctctgaaataccagccctggagcactatgtccccaggaatgttcacaaaaggtcagcagaagcaccagaagggccagagtagcactgagtcaggaattccacacagtgtttggaacacaaggatgaatcctgatggctcccgctggttgctaggtaacgtctgtttggtacaatctggttcacatcataatggttcttttgccaacaggagctggtaatcaggatggcagtgaggcaggcacttgcttgcagaagaacaggcctagttttttaagaagccacaaaagtgtctttggatgattaggatctaaggggccaacagctttgcaataacagcataaatattgtgggctggatggacaggcaccaaatggggacattccatcctgctgtgtgatgagaaagctgccacttttgaggccttccaaaacaaatcaacactccatatgccagaaggaaaagcccaggaaagacctattccaactggagatggaatacgaagggagaatgaaacaaaactgctccgcttagggaacttggaaaggaaattgaaaaggcaaggcacaggctggaagaaaatatttgaaaaagatttatgtgaacttctttctggattatacaaaatatttttagatattcttacaactctaaaataagataactccttaaaaatctaaattctaccaaaggagagataaagatgacgaatacattcaaagatgctgaaaatcacttatttattattaggaagttacaagctaaagcataatgagataccactacaacctactaaactgactaaaattaatcagactaaccaggtgttggcaagaaacagggacactgagactctcacactgctggaaggaatgtaaaatgctaaaacttctttggaaatgagttcagtaactttttaaacagttgaaaatagacctatcatgcaaaccagcaatcccacttccaggtatttatacaaggaaaatgacaacatatgcccacataaagacttgtgcacaaatgaccgtagcagctttgtgataattgctaaaaactagaaacttgtcaagtgtccaacaggtgagtggacaaactcactatagtatatccatacaattaagtactaaatagcaataaaaaggaactattaatacatt

SEQ ID NO: 462914 - DNA, 1523 bp, Homo sapiens
atttaaagaattatcatgatcaactgggatttatcctggactacacagggcctggaattcccgtcactccaggatgtaatcctcacatctgaaagaagaaaatgctacatcaagattgaaggtcatgtcttacgatatttgtggaaagctgaaacttgggacaggatgcttgagacaggggaaattacatttctccaaggtgttcattctctgaaataccagccctggagcactatgtccccaggaatgttcacaaaaggtcagcagaagcaccagaagggccagagtagcactgagtcaggaattccacacagtgtttggaacacaaggatgaatcctgatggctcccgctggttgctaggtaacgtctgtttggtacaatctggttcacatcataatggttcttttgccaacaggagctggtaatcaggatggcagtgaggcaggcacttgcttgcagaagaacaggcctagttttttaagaagccacaaaagtgtctttggatgattaggatctaaggggccaacagctttgcaataacagcataaatattgtgggctggatggacaggcaccaaatggggacattccatcctgctgtgtgatgagaaagctgccacttttgaggccttccaaaacaaatcaacactccatatgccagaaggaaaagcccaggaaagacctattccaactggagatggtgaatgtcatttcttcaagaagctgagatccagctggtactgccaggtggagagtgagttgggtagctgacctcgggcatggcagccttggtttttggccacttcatggggtgacctgttgagcaaacagcagtggaattctgcagctgtggaccaagatgaatacgaagggagaatgaaacaaaactgctccgcttagggaacttggaaaggaaattgaaaaggcaaggcacaggctggaagaaaatatttgaaaaagatttatgtgaacttctttctggattatacaaaatatttttagatattcttacaactctaaaataagataactccttaaaaatctaaattctaccaaaggagagataaagatgacgaatacattcaaagatgctgaaaatcacttatttattattaggaagttacaagctaaagcataatgagataccactacaacctactaaactgactaaaattaatcagactaaccaggtgttggcaagaaacagggacactgagactctcacactgctggaaggaatgtaaaatgctaaaacttctttggaaatgagttcagtaactttttaaacagttgaaaatagacctatcatgcaaaccagcaatcccacttccaggtatttatacaaggaaaatgacaacatatgcccacataaagacttgtgcacaaatgaccgtagcagctttgtgataattgctaaaaactagaaacttgtcaagtgtccaacaggtgagtggacaaactcactatagtatatccatacaattaagtactaaatagcaataaaaaggaactattaatacatt

SEQ ID NO: 462915 - DNA, 1362 bp, Homo sapiens
gatgtgtatgcctttttctcctattaatctgcctttttttagttcattttcaatgaaccttcagaggatgaaggggaaagctgtccttgctcacccctgcacaagaggatacccgcatttaccagaaacacatgccaactcaattagccaaatgaactggatcagttcccgaaagccctgtgctttcttcctcaccagacctttagtcttcaaaatggtcgtgcctgtgatctcagttccttttttctgctggactctaagggctgcagcagtgctggccccttgcacagccatatgtgaccactgcagaacaatcagttggagagacagtttggactacatggagggtggagataaggacaaagtgaagaatacacaggaaccagtgcctcctcctggaactatgcaactccaagctgcttccatcagctgctaggtccagtagggagggacctactgagaggtgattggattatgggggcggtttcccccatgctgttctcatgatcgtgagtgagttctcatttgatctgatggtttcacgaaaggctctttctcctttgctttctcttctctctcctgctgctatgtgaagaaggtgcctgcttccctttccgctgtgattgtaagtttcctgaggcctcctcagccatgtggaactagctaattaaaaatgtggtgtcctggactcacgaagccagaattgctgaggagatagcccgagaatctgaatttttagcagacatttttttaggtaccttacccgcaggatcatttctgtgaatatccatgaggtgaaaaagtctgggaaacactgtcctagggtgtggggaagagcgagaaaaagatttccgctctggaaggtaaacaaatactctctggagagagaagaggaatgtccctagcagatgtctccagagaagacaagactttaaattccgccagggaaatatacaatgtctaacttctaaggcacatttgccattcaatcatgctttaacccacgttgccagaaatttttgctcactaggttttgactgtacaggaatgtgaaaatattcatgaagagttgttttccaatgctaaagaattgatgtgttttaacagttgaattaattgtattgattatgatcacacctactttttatatatcttcatttctaacgtttctgtacaatcctgcctttccacctgatatagttaggccttgtgtcatcaaccaaatctcatcttgaattgtaatcgccataatccccacgtatttagggagagacctggagggaggtgtttggatcatgggggcggtttcccgcatgctgttctcatgaccatgagattacaattgtttcatacctgaaaatc

SEQ ID NO: 462916 - DNA, 1846 bp, Homo sapiens
  misc_feature (2)..(2): n is a, c, g, or t
  misc_feature (7)..(8): n is a, c, g, or t
  misc_feature (11)..(11): n is a, c, g, or t
anttctnntancagcagtagagatggatggaaccaatggcagcacccaaacccatttcatcctactgggattctctgaccgaccccatctggagaggatcctctttgtggtcatcctgatcgcgtacctcctgaccctcgtaggcaacaccaccatcatcctggtgtcccggctggacccccacctccacacccccatgtacttcttcctcgcccacctttccttcctggacctcagtttcaccaccagctccatcccccagctgctctacaaccttaatggatgtgacaagaccatcagctacatgggctgtgccatccagctcttcctgttcctgggtctgggtggtgtggagtgcctgcttctggctgtcatggcctatgaccggtgtgtggctatctgcaagcccctgcactacatggtgatcatgaaccccaggctctgccggggcttggtgtcagtgacctggggctgtggggtggccaactccttggccatgtctcctgtgaccctgcgcttaccccgctgtgggcaccacgaggtggaccacttcctgcgtgagatgcccgccctgatccggatggcctgcgtcagcactgtggccatcgaaggcaccgtctttgtcctgaaaaaaggtgttgtgctgtcccccttggtgtttatcctgctctcttacagctacattgtgagggctgtgttacaaattcggtcagcatcaggaaggcagaaggccttcggcacctgcggctcccatctcactgtggtctcccttttctatggaaacatcatctacatgtacatgcagccaggagccagttcttcccaggaccagggcatgttcctcatgctcttctacaacattgtcacccccctcctcaatcctctcatctacaccctcagaaacagagaggtgaagggggcactgggaaggttgcttctggggaagagagagctaggaaaggagtaaaggcatctccacctgacttcacctccatccagggccactggcagcatctggaacggctgaattccagctgatattagcccacgactcccaacttgcctttttctggacttttgtgaggctgtttcagttctgacattatgtgtttttgttgttgctcttaaaattgagacggggtctcactctgtcacctagggtggagtgcagtggtgccaccatagctccttcgactattgggcttaagcgatcctcccccacctcagccttccaagtaactgggactacaggtgtgcatcactggcagtgggaattgtggcttttctgtcttctatggagacggggtcttgctgtgttgaccaggctggtcccaaactcctggcctcatgtgatcctcctgccatggcctcctaaagttctgggattacaagtgtgagtcactgtgactggccaacattatgtgatttatgtgtgaactatataacacaaatcatccccaaaacccatcatgatctgtaaagcagctgcaaagaatgaagtgagagaaacagttgtaaagatgagtttccacctacttataccagagtgctaagaggaaataactcttctcaatcagagctttgctttgtttgttgttgtttgctttaaagtctaacacacctgacatgtttcagtcagaatgaccccaaatgcatcactgttctccacgtggtcccaagtgcctctctgtttagggccatcaaatcatggaatgcagcacagtttgatattttctatattcccaattcctacccaaaccttttcatgaaatcgtagagtttgttttaccctttatctggtgtaagattctgcataaaccaagaagtgaacctgtaagttatgatg

SEQ ID NO: 462917 - DNA, 5364 bp, Homo sapiens
tgcgccttgggctctcctgacgcgctgagcgggaccctgaggagccagctggcgcaggctatgggctgggcggcggttgagacagcggcggtattgggaggggtagtgaacgcggtgcttttgggaacgcgggacgggcgacctgtggcgccaggagcgggccgaggcgcggcgcacggatgccgtctggatgggaagttacggtttacagcgaagtccacccagcgtttccgaggtgaaggcgccgcgccaggccggggggcgctgcggctgtcgcaagttttgttgcgagcgacggagggcgaggcggggtggggggttgggagggcatgtgttccggccccgccgaggcttaagttccatgcgttcgattcctcgcttgccgctgccgcccgcagccctcatctcttgggcgctggggaagaaactcgctggcgggtgttctgtggcatcccagggggtggagggacgagcagcttcgggggcacgtcctcgtgtatcctgtggaggaccctgaccccgcaccccaccctcgaggccagaaatcagttgcctctggggacctgagaggcgagaccactcgcgcccctgacttgcaaagttggggtctttattggcctccgggattctgctcctggcggtttctccaggctggtgatgggcaacacatgaggcgcgtttgtagccatcactgaatcacctcatgactagcggggcaggcctctaattcaccgcaggatttccagtaggttggattgtggggttggtgtttgcactccaaagagttggcgtgatttccctgtatctgtctttctggcttgttagatcttctcatttggcgtcctttctccgaagagttaaccaagacgtttggcgtggttttcttgctttcctcctatcttttgctgctagagctgctttcaaaaagaagtcttttcttgcagtgataccttttctttgggttacagtgttgttcatcctttctttgccgaaagaatgaatcccagtgcttcacgaagttaaaggaaagatctgctggtagtgtttagtctttgttctgagctgatatgtgttagtagctttttgtttttaaattttattagtaaaatttcaccagtgaaccagaagctctttttttctgttgtgaaatgctagctttaagatttctgagaactttgtgtcaaagaaatctttgaaaagttactgaagtatacagagaggttcacaattttaaatgtgcaggtggtccgggcgcggtagatcacacctgtaatcccagcactttgggacgccaaggtgggcggatcacttgagcccaggatttccagaccagcctgggcaacgtgccaaaaccctatctctactaaaattacaaaagttagctgtgtgtggtggtgtgtgcctgtagtcccagctacctggtaggctgaggtgggaggatcaccagagcccaggaggttgagattgcagtgagccgtgatcatggcagtgcactcccgcctgggtggcagagtgagaccctgtctccaaaaaaaaaaaaaaaaaaaaaaaagtacagataatgaatttttaccaagtgaaccaccacagatcaagaaatagaacattactagactggggtatatttgtaggagtgacattgttggttttagaggtatatgaatgataaaacttagtattacatattgttgaacgttttcccaaagtggttgtaccatttagcagggatattctggttaccccacaaccttgctgatgcctgtcagttaaaaattattttgccattctagtaggggtgcagtaatgtatcagtgtgatttcattttgcattttcctggtattgagattgagtatcttttattgtcatttgtgtgtcctcttttgtgaagtgcctgttaaatctttttatccagttttcattgatatgcttgtttttctgttgatttgtaatacttttttccggatatgtgtcctttctacgatatatatgtattgcatttccctttttttcaatctgtagcttgccttttcgctcttttaatggtgcttattcatgaatggagattctctaactttttttttttctttttgagacaagatctcactctgttgcccaggctggagtgcagtggcacaatcacagctgaccgcaaccttgacctcccaaggctcaggtgatcctcctgcctcagcccccaggtagctgggacctacagacagggcctcactctattgcccaggctagagtgccgtggcaggatctcagctcactgcaacctccacctcctggctcaagcgatcctcccacctcagcctcctgagtagctgcgactataggagtgtgccaccatgcctggcttaattttcatattttttgtagagatggggattcaacatgtttcccaggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctgggggtgccaccaactcccactgtccagggcttccagtggactctccgaggtactgatgtagaaacttccccattcggtgcaccaagagcaacctcacacggtgtgggccgaatgaagagctgccagatcccacagaaatgtgattgataacagtaaagccacactcctcaagtgcctgaaatacccctcattgtcttcttcaggtggcaagggctctggaacagccacataaaggtgagggcaatatttttactgtagttctttcattgattggttgattgatttttttctcttagagggttagcatacatttatctgaaattgaaattcaagaggagagacaggcacctgtactagttttctcttgctgcctattatcacattaccacaaaccagtggtttgaaaccacagaagtctggaatgaagtggccgggttctctgatcagagtcatgtgaggctaaaatccgggaatgggctggctgtgtttttttcctagagctcaagctatttttccaggttcactacagataatgaaagagttcctattcttgtttgtgggggactgagggccctttttctgtgctggctgtcagcggggagacagtctactctgactccagaggccacgtgctttcctccttacctgtctgtttcatctttcaaccaataacaactcatggagtccttctcaagctcccaccttctctgacttcatcttctccaaccagccacacaaagctctgtcatgtatggagtgatgtgattagatcgagttcatgcggtaacctcaccatcttaaagtcatataactggcatataacaacatagtcacaggaatggtgtctcatcaccttaagaggctttagagacaagggtgtggcatgtttggggaccatttcagaaattccatctaccacagtaggacactcacattcccccatctgcaaagtgcatttaccctctcccctgaggtttccagatttcatgtcattaaagcattagttcaacatgaaaaatgtcatgtagaccacatcagatcaaaagtttaaaatcccatctaaaacatccacaccaggtgtgaatgaggcttccgagagtgtccattaagtgcagatccttgacataattcccttacctctgtcgacctgtgaaactgaacaaacagcttatctgcccctaatgtgaaatgatgggacagacatagaataaccactacagtgattctagttcaaaatgagggaacatggaggggataaagaagtcaataacccaaaatagtttggaaatggagctgggcaaaatccagcaggagtttcttagttaggatccacagcctgggactgaccctctgtcctgtgggtctttgcctctgggctctctgctctgcatttcttgaaaccattattatttatcatttttctcacactgttttgcgtatggctcctattgcactcaaaatgtttttgagattcatccatgttgttttgtgtgtcaaaagtttgttcctttagccattccatggaatgaatgtatcacagtttattgatccattcttgtattgatagatatttgaatgtttccagtttttcctattatgaataaaactgctatgaacattcttgtataaatcattttctggacatatgttttaatttctcttggataaatgcttaggaattagtgagtcatagaatagatagttgtttagttctgtaagaatatgccagacattttttcccaaagtgtttatactattgtacattccaaccattaatgtatgaaggtgagaaagcttttgctacttccaaagaggcctctctatatacatgtaattttttctaactggagacaggctgatgacttcagggacatgagcatgggatacctgtcatcaccaccaccataaagttgggattcaggaaggaggttaatcatataaagaatcctgtgaccagtatgagcttctctcaggccacacagggcactcaagtgaacagggcatgggggccctggggtcatggtaagaaagtgtctcattggtaaaaccttttcctctggggaggtaaataaatgatttgtttcttcttggtagcccttgaagataaggatggtcaaacaaaataatatcatacctggagaaactcagatcttgctaagatttactggttgggaatccaaagttaatgccaagaagcagccgccagttgggatcaaatgtgagcctatggatcaaggtgcgtactcaaacacagagagctttctgaaagatgctaccagtagtttttccagggcagagatgggtcctttatttttctctctaatctagcccatatgcttagctgagttttctttgtatcactttaaatgatgatgtcccttgttcaacaattttctaaacattctttagataataattttatgggcattctttattgcattaggcttaaattttttaatgcatcttaaggttttattgcaaaatattgccttgtttcctttttaagatgatacagtttataatatgcaaatttgttgtctgtcccctccctttatgtacatagaaaatgagcaaacaggtggccatgaaacagatggtcatagaattggttcagtggttgtgagtgcagcaacccaagagtgtcttatctgaaataccaccaggaatgtctggacacagtagacaaaggtttttcaactggacgccttaggatacatgcttgcaaaaacaaagtagccaaaaagaaaccagagtcacagaatatcagagccagaggaacatttggaggtaattcagtacctcctccttttcaacctacagggga

SEQ ID NO: 462918 - DNA, 5186 bp, Homo sapiens
tgcgccttgggctctcctgacgcgctgagcgggaccctgaggagccagctggcgcaggctatgggctgggcggcggttgagacagcggcggtattgggaggggtaggtgagggtcgcgaggctgcgtgagcatctgagtgaacgcggtgcttttgggaacgcgggacgggcgacctgtggcgccaggagcgggccgaggcgcggcgcacggatgccgtctggatgggaagttacggtttacagcgaagtccacccagcgtttccgaggtgaaggcgccgcgccaggccggggggcggtgagtccgggacccgcgggtacacagctgggtcctgcggctgtcgcaagttttgttgcgagcgacggagggcgaggcggggtggggggttgggagggcatgtgttccggccccgccgaggcttaagttccatgcgttcgattcctcgcttgccgctgccgcccgcagccctcatctcttgggcgctggggaagaaactcgctggcgggtgttctgtggcatcccagggggtggagggacgagcagcttcgggggcacgtcctcgtgtatcctgtggaggaccctgaccccgcaccccaccctcgaggccagaaatcagttgcctctggggacctgagaggcgagaccactcgcgcccctgacttgcaaagttggggtctttattggcctccgggattctgctcctggcggtttctccaggctggtgatgggcaacacatgaggcgcgtttgtagccatcactgaatcacctcatgactagcggggcaggcctctaattcaccgcaggatttccagtaggttggattgtggggttggtgtttgcactccaaagagttggcgtgatttccctgtatctgtctttctggcttgttagatcttctcatttggcgtcctttctccgaagagttaaccaagacgtttggcgtggttttcttgctttcctcctatcttttgctgctagagctgctttcaaaaagaagtcttttcttgcagtgataccttttctttgggttacagtgttgttcatcctttctttgccgaaagaatgaatcccagtgcttcacgaagttaaaggaaagatctgctggtagtgtttagtctttgttctgagctgatatgtgttagtagctttttgtttttaaattttattagtaaaatttcaccagtgaaccagaagctctttttttctgttgtgaaatgctagctttaagatttctgagaactttgtgtcaaagaaatctttgaaaagttactgaagtatacagagaggttcacaattttaaatgtgcaggtggtccgggcgcggtagatcacacctgtaatcccagcactttgggacgccaaggtgggcggatcacttgagcccaggatttccagaccagcctgggcaacgtgccaaaaccctatctctactaaaattacaaaagttagctgtgtgtggtggtgtgtgcctgtagtcccagctacctggtaggctgaggtgggaggatcaccagagcccaggaggttgagattgcagtgagccgtgatcatggcagtgcactcccgcctgggtggcagagtgagaccctgtctccaaaaaaaaaaaaaaaaaaaaaaaagtacagataatgaatttttaccaagtgaaccaccacagatcaagaaatagaacattactagactggggtatatttgtaggagtgacattgttggttttagaggtatatgaatgataaaacttagtattacatattgttgaacgttttcccaaagtggttgtaccatttagcagggatattctggttaccccacaaccttgctgatgcctgtcagttaaaaattattttgccattctagtaggggtgcagtaatgtatcagtgtgatttcattttgcattttcctggtattgagattgagtatcttttattgtcatttgtgtgtcctcttttgtgaagtgcctgttaaatctttttatccagttttcattgatatgcttgtttttctgttgatttgtaatacttttttccggatatgtgtcctttctacgatatatatgtattgcatttccctttttttcaatctgtagcttgccttttcgctcttttaatggtgcttattcatgaatggagattctctaactttttttttttctttttgagacaagatctcactctgttgcccaggctggagtgcagtggcacaatcacagctgaccgcaaccttgacctcccaaggctcaggtgatcctcctgcctcagcccccaggtagctgggacctacaggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctgggggtgccaccaactcccactgtccagggcttccagtggactctccgaggtactgatgtagaaacttccccattcggtgcaccaagagcaacctcacacggtgtgggccgaatgaagagctgccagatcccacagaaatgtgattgataacagtaaagccacactcctcaagtgcctgaaatacccctcattgtcttcttcaggtggcaagggctctggaacagccacataaaggtgagggcaatatttttactgtagttctttcattgattggttgattgatttttttctcttagagggttagcatacatttatctgaaattgaaattcaagaggagagacaggcacctgtactagttttctcttgctgcctattatcacattaccacaaaccagtggtttgaaaccacagaagtctggaatgaagtggccgggttctctgatcagagtcatgtgaggcccaggttcactacagataatgaaagagttcctattcttgtttgtgggggactgagggccctttttctgtgctggctgtcagcggggagacagtctactctgactccagaggccacgtgctttcctccttacctgtctgtttcatctttcaaccaataacaactcatggagtccttctcaagctcccaccttctctgacttcatcttctccaaccagccacacaaagctctgtcatgtatggagtgatgtgattagatcgagttcatgcggtaacctcaccatcttaaagtcatataactggcatataacaacatagtcacaggaatggtgtctcatcaccttaagaggctttagagacaagggtgtggcatgtttggggaccatttcagaaattccatctaccacagtaggacactcacattcccccatctgcaaagtgcatttaccctctcccctgaggtttccagatttcatgtcattaaagcattagttcaacatgaaaaatgtcatgtagaccacatcagatcaaaagtttaaaatcccatctaaaacatccacaccaggtgtgaatgaggcttccgagagtgtccattaagtgcagatccttgacataattcccttacctctgtcgacctgtgaaactgaacaaacagcttatctgcccctaatgtgaaatgatgggacagacatagaataaccactacagtgattctagttcaaaatgagggaacatggaggggataaagaagtcaataacccaaaatagtttggaaatggagctgggcaaaatccagcaggagtttcttagttaggatccacagcctgggactgaccctctgtcctgtgggtctttgcctctgggctctctgctctgcatttcttgaaaccattattatttatcatttttctcacactgttttgcgtatggctcctattgcactcaaaatgtttttgagattcatccatgttgttttgtgtgtcaaaagtttgttcctttagccattccatggaatgaatgtatcacagtttattgatccattcttgtattgatagatatttgaatgtttccagtttttcctattatgaataaaactgctatgaacattcttgtataaatcattttctggacatatgttttaatttctcttggataaatgcttaggaattagtgagtcatagaatagatagttgtttagttctgtaagaatatgccagacattttttcccaaagtgtttatactattgtacattccaaccattaatgtatgaaggtgagaaagcttttgctacttccaaagaggcctctctatatacatgtaattttttctaactggagacaggctgatgacttcagggacatgagcatgggatacctgtcatcaccaccaccataaagttgggattcaggaaggaggttaatcatataaagaatcctgtgaccagtatgagcttctctcaggccacacagggcactcaagtgaacagggcatgggggccctggggtcatggtaagaaagtgtctcattggtaaaaccttttcctctggggaggtaaataaatgatttgtttcttcttggtagcccttgaagataaggatggtcaaacaaaataatatcatacctggagaaactcagatcttgctaagatttactggttgggaatccaaagttaatgccaagaagcagccgccagttgggatcaaatgtgagcctatggatcaaggtgcgtactcaaacacagagagctttctgaaagatgctaccagtagtttttccagggcagagatgggtcctttatttttctctctaatctagcccatatgcttagctgagttttctttgtatcactttaaatgatgatgtcccttgttcaacaattttctaaacattctttagataataattttatgggcattctttattgcattaggcttaaattttttaatgcatcttaaggttttattgcaaaatattgccttgtttcctttttaagatgatacagtttataatatgcaaatttgttgtctgtcccctccctttatgtacatagaaaatgagcaaacaggtggccatgaaacagatggtcatagaattggttcagtggttgtgagtgcagcaacccaagagtgtcttatctgaaataccaccaggaatgtctggacacagtagacaaaggtttttcaactggacgccttaggatacatgcttgcaaaaacaaagtagccaaaaagaaaccagagtcacagaatatcagagccagaggaacatttggaggtaattcagtacctcctccttttcaacctacagggga

SEQ ID NO: 462919 - DNA, 3479 bp, Homo sapiens
tgcgccttgggctctcctgacgcgctgagcgggaccctgaggagccagctggcgcaggctatgggctgggcggcggttgagacagcggcggtattgggaggggtaggtgagggtcgcgaggctgcgtgagcatctgagtgaacgcggtgcttttgggaacgcgggacgggcgacctgtggcgccaggagcgggccgaggcgcggcgcacggatgccgtctggatgggaagttacggtttacagcgaagtccacccagcgtttccgagatctcactctgttgcccaggctggagtgcagtggcacaatcacagctgaccgcaaccttgacctcccaaggctcaggtgatcctcctgcctcagcccccaggtagctgggacctacagacagggcctcactctattgcccaggctagagtgccgtggcaggatctcagctcactgcaacctccacctcctggctcaagcgatcctcccacctcagcctcctgagtagctgcgactataggagtgtgccaccatgcctggcttaattttcatattttttgtagagatggggattcaacatgtttcccaggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctgggggtgccaccaactcccactgtccagggcttccagtggactctccgaggtactgatgtagaaacttccccattcggtgcaccaagagcaacctcacacggtgtgggccgaatgaagagctgccagatcccacagaaatgtgattgataacagtaaagccacactcctcaagtgcctgaaatacccctcattgtcttcttcaggtggcaagggctctggaacagccacataaaggtgagggcaatatttttactgtagttctttcattgattggttgattgatttttttctcttagagggttagcatacatttatctgaaattgaaattcaagaggagagacaggcacctgtactagttttctcttgctgcctattatcacattaccacaaaccagtggtttgaaaccacagaagtctggaatgaagtggccgggttctctgatcagagtcatgtgaggcccaggttcactacagataatgaaagagttcctattcttgtttgtgggggactgagggccctttttctgtgctggctgtcagcggggagacagtctactctgactccagaggccacgtgctttcctccttacctgtctgtttcatctttcaaccaataacaactcatggagtccttctcaagctcccaccttctctgacttcatcttctccaaccagccacacaaagctctgtcatgtatggagtgatgtgattagatcgagttcatgcggtaacctcaccatcttaaagtcatataactggcatataacaacatagtcacaggaatggtgtctcatcaccttaagaggctttagagacaagggtgtggcatgtttggggaccatttcagaaattccatctaccacagtaggacactcacattcccccatctgcaaagtgcatttaccctctcccctgaggtttccagatttcatgtcattaaagcattagttcaacatgaaaaatgtcatgtagaccacatcagatcaaaagtttaaaatcccatctaaaacatccacaccaggtgtgaatgaggcttccgagagtgtccattaagtgcagatccttgacataattcccttacctctgtcgacctgtgaaactgaacaaacagcttatctgcccctaatgtgaaatgatgggacagacatagaataaccactacagtgattctagttcaaaatgagggaacatggaggggataaagaagtcaataacccaaaatagtttggaaatggagctgggcaaaatccagcaggagtttcttagttaggatccacagcctgggactgaccctctgtcctgtgggtctttgcctctgggctctctgctctgcatttcttgaaaccattattatttatcatttttctcacactgttttgcgtatggctcctattgcactcaaaatgtttttgagattcatccatgttgttttgtgtgtcaaaagtttgttcctttagccattccatggaatgaatgtatcacagtttattgatccattcttgtattgatagatatttgaatgtttccagtttttcctattatgaataaaactgctatgaacattcttgtataaatcattttctggacatatgttttaatttctcttggataaatgcttaggaattagtgagtcatagaatagatagttgtttagttctgtaagaatatgccagacattttttcccaaagtgtttatactattgtacattccaaccattaatgtatgaaggtgagaaagcttttgctacttccaaagaggcctctctatatacatgtaattttttctaactggagacaggctgatgacttcagggacatgagcatgggatacctgtcatcaccaccaccataaagttgggattcaggaaggaggttaatcatataaagaatcctgtgaccagtatgagcttctctcaggccacacagggcactcaagtgaacagggcatgggggccctggggtcatggtaagaaagtgtctcattggtaaaaccttttcctctggggaggtaaataaatgatttgtttcttcttggtagcccttgaagataaggatggtcaaacaaaataatatcatacctggagaaactcagatcttgctaagatttactggttgggaatccaaagttaatgccaagaagcagccgccagttgggatcaaatgtgagcctatggatcaaggtgcgtactcaaacacagagagctttctgaaagatgctaccagtagtttttccagggcagagatgggtcctttatttttctctctaatctagcccatatgcttagctgagttttctttgtatcactttaaatgatgatgtcccttgttcaacaattttctaaacattctttagataataattttatgggcattctttattgcattaggcttaaattttttaatgcatcttaaggttttattgcaaaatattgccttgtttcctttttaagatgatacagtttataatatgcaaatttgttgtctgtcccctccctttatgtacatagaaaatgagcaaacaggtggccatgaaacagatggtcatagaattggttcagtggttgtgagtgcagcaacccaagagtgtcttatctgaaataccaccaggaatgtctggacacagtagacaaaggtttttcaactggacgccttaggatacatgcttgcaaaaacaaagtagccaaaaagaaaccagagtcacagaatatcagagccagaggaacatttggaggtaattcagtacctcctccttttcaacctacagggga

SEQ ID NO: 462920 - DNA, 3434 bp, Homo sapiens
tgcgccttgggctctcctgacgcgctgagcgggaccctgaggagccagctggcgcaggctatgggctgggcggcggttgagacagcggcggtattgggaggggtaggtgagggtcgcgaggctgcgtgagcatctgagtgaacgcggtgcttttgggaacgcgggacgggcgacctgtggcgccaggagcgggccgaggcgcggcgcacggatgccgtctggatgggaagttacggtttacagcgaagtccacccagcgtttccgaggtgaaggcgccgcgccaggccggggggcggtgagtccgggacccgcgggtacacagctgggtcaacacatgaggcgcgtttgtagccatcactgaatcacctcatgactagcggggcaggcctctaattcaccgcaggatttccaatctcactctgttgcccaggctggagtgcagtggcacaatcacagctgaccgcaaccttgacctcccaaggctcaggtgatcctcctgcctcagcccccaggtagctgggacctacaggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctgggggtgccaccaactcccactgtccagggcttccagtggactctccgaggtactgatgtagaaacttccccattcggtgcaccaagagcaacctcacacggtgtgggccgaatgaagagctgccagatcccacagaaatgtgattgataacagtaaagccacactcctcaagtgcctgaaatacccctcattgtcttcttcaggtggcaagggctctggaacagccacataaaggtgagggcaatatttttactgtagttctttcattgattggttgattgatttttttctcttagagggttagcatacatttatctgaaattgaaattcaagaggagagacaggcacctgtactagttttctcttgctgcctattatcacattaccacaaaccagtggtttgaaaccacagaagtctggaatgaagtggccgggttctctgatcagagtcatgtgaggcccaggttcactacagataatgaaagagttcctattcttgtttgtgggggactgagggccctttttctgtgctggctgtcagcggggagacagtctactctgactccagaggccacgtgctttcctccttacctgtctgtttcatctttcaaccaataacaactcatggagtccttctcaagctcccaccttctctgacttcatcttctccaaccagccacacaaagctctgtcatgtatggagtgatgtgattagatcgagttcatgcggtaacctcaccatcttaaagtcatataactggcatataacaacatagtcacaggaatggtgtctcatcaccttaagaggctttagagacaagggtgtggcatgtttggggaccatttcagaaattccatctaccacagtaggacactcacattcccccatctgcaaagtgcatttaccctctcccctgaggtttccagatttcatgtcattaaagcattagttcaacatgaaaaatgtcatgtagaccacatcagatcaaaagtttaaaatcccatctaaaacatccacaccaggtgtgaatgaggcttccgagagtgtccattaagtgcagatccttgacataattcccttacctctgtcgacctgtgaaactgaacaaacagcttatctgcccctaatgtgaaatgatgggacagacatagaataaccactacagtgattctagttcaaaatgagggaacatggaggggataaagaagtcaataacccaaaatagtttggaaatggagctgggcaaaatccagcaggagtttcttagttaggatccacagcctgggactgaccctctgtcctgtgggtctttgcctctgggctctctgctctgcatttcttgaaaccattattatttatcatttttctcacactgttttgcgtatggctcctattgcactcaaaatgtttttgagattcatccatgttgttttgtgtgtcaaaagtttgttcctttagccattccatggaatgaatgtatcacagtttattgatccattcttgtattgatagatatttgaatgtttccagtttttcctattatgaataaaactgctatgaacattcttgtataaatcattttctggacatatgttttaatttctcttggataaatgcttaggaattagtgagtcatagaatagatagttgtttagttctgtaagaatatgccagacattttttcccaaagtgtttatactattgtacattccaaccattaatgtatgaaggtgagaaagcttttgctacttccaaagaggcctctctatatacatgtaattttttctaactggagacaggctgatgacttcagggacatgagcatgggatacctgtcatcaccaccaccataaagttgggattcaggaaggaggttaatcatataaagaatcctgtgaccagtatgagcttctctcaggccacacagggcactcaagtgaacagggcatgggggccctggggtcatggtaagaaagtgtctcattggtaaaaccttttcctctggggaggtaaataaatgatttgtttcttcttggtagcccttgaagataaggatggtcaaacaaaataatatcatacctggagaaactcagatcttgctaagatttactggttgggaatccaaagttaatgccaagaagcagccgccagttgggatcaaatgtgagcctatggatcaaggtgcgtactcaaacacagagagctttctgaaagatgctaccagtagtttttccagggcagagatgggtcctttatttttctctctaatctagcccatatgcttagctgagttttctttgtatcactttaaatgatgatgtcccttgttcaacaattttctaaacattctttagataataattttatgggcattctttattgcattaggcttaaattttttaatgcatcttaaggttttattgcaaaatattgccttgtttcctttttaagatgatacagtttataatatgcaaatttgttgtctgtcccctccctttatgtacatagaaaatgagcaaacaggtggccatgaaacagatggtcatagaattggttcagtggttgtgagtgcagcaacccaagagtgtcttatctgaaataccaccaggaatgtctggacacagtagacaaaggtttttcaactggacgccttaggatacatgcttgcaaaaacaaagtagccaaaaagaaaccagagtcacagaatatcagagccagaggaacatttggaggtaattcagtacctcctccttttcaacctacagggga

SEQ ID NO: 462921 - DNA, 2893 bp, Homo sapiens
aataaatactaagggaactcagaggccagtgccagcatgggtcctccgtatgctgaacgccggtcccctgggcccatttttctttctctgtactttgtctctgtgtctctttcttttccaagtctctccttccacctaatgagaaacgcccacaggtgtggaggggcaacccatcccttcactgaaccatttttattcttccagaaatgtgattgataacagtaaagccacactcctcaagtgcctgaaatacccctcattgtcttcttcaggtggcaagggctctggaacagccacataaaggtgagggcaatatttttactgtagttctttcattgattggttgattgatttttttctcttagagggttagcatacatttatctgaaattgaaattcaagaggagagacaggcacctgtactagttttctcttgctgcctattatcacattaccacaaaccagtggtttgaaaccacagaagtctggaatgaagtggccgggttctctgatcagagtcatgtgaggctaaaatccgggaatgggctggctgtgtttttttcctagagctcaagctatttttccaggttcactacagataatgaaagagttcctattcttgtttgtgggggactgagggccctttttctgtgctggctgtcagcggggagacagtctactctgactccagaggccacgtgctttcctccttacctgtctgtttcatctttcaaccaataacaactcatggagtccttctcaagctcccaccttctctgacttcatcttctccaaccagccacacaaagctctgtcatgtatggagtgatgtgattagatcgagttcatgcggtaacctcaccatcttaaagtcatataactggcatataacaacatagtcacaggaatggtgtctcatcaccttaagaggctttagagacaagggtgtggcatgtttggggaccatttcagaaattccatctaccacagtaggacactcacattcccccatctgcaaagtgcatttaccctctcccctgaggtttccagatttcatgtcattaaagcattagttcaacatgaaaaatgtcatgtagaccacatcagatcaaaagtttaaaatcccatctaaaacatccacaccaggtgtgaatgaggcttccgagagtgtccattaagtgcagatccttgacataattcccttacctctgtcgacctgtgaaactgaacaaacagcttatctgcccctaatgtgaaatgatgggacagacatagaataaccactacagtgattctagttcaaaatgagggaacatggaggggataaagaagtcaataacccaaaatagtttggaaatggagctgggcaaaatccagcaggagtttcttagttaggatccacagcctgggactgaccctctgtcctgtgggtctttgcctctgggctctctgctctgcatttcttgaaaccattattatttatcatttttctcacactgttttgcgtatggctcctattgcactcaaaatgtttttgagattcatccatgttgttttgtgtgtcaaaagtttgttcctttagccattccatggaatgaatgtatcacagtttattgatccattcttgtattgatagatatttgaatgtttccagtttttcctattatgaataaaactgctatgaacattcttgtataaatcattttctggacatatgttttaatttctcttggataaatgcttaggaattagtgagtcatagaatagatagttgtttagttctgtaagaatatgccagacattttttcccaaagtgtttatactattgtacattccaaccattaatgtatgaaggtgagaaagcttttgctacttccaaagaggcctctctatatacatgtaattttttctaactggagacaggctgatgacttcagggacatgagcatgggatacctgtcatcaccaccaccataaagttgggattcaggaaggaggttaatcatataaagaatcctgtgaccagtatgagcttctctcaggccacacagggcactcaagtgaacagggcatgggggccctggggtcatggtaagaaagtgtctcattggtaaaaccttttcctctggggaggtaaataaatgatttgtttcttcttggtagcccttgaagataaggatggtcaaacaaaataatatcatacctggagaaactcagatcttgctaagatttactggttgggaatccaaagttaatgccaagaagcagccgccagttgggatcaaatgtgagcctatggatcaaggtgcgtactcaaacacagagagctttctgaaagatgctaccagtagtttttccagggcagagatgggtcctttatttttctctctaatctagcccatatgcttagctgagttttctttgtatcactttaaatgatgatgtcccttgttcaacaattttctaaacattctttagataataattttatgggcattctttattgcattaggcttaaattttttaatgcatcttaaggttttattgcaaaatattgccttgtttcctttttaagatgatacagtttataatatgcaaatttgttgtctgtcccctccctttatgtacatagaaaatgagcaaacaggtggccatgaaacagatggtcatagaattggttcagtggttgtgagtgcagcaacccaagagtgtcttatctgaaataccaccaggaatgtctggacacagtagacaaaggtttttcaactggacgccttaggatacatgcttgcaaaaacaaagtagccaaaaagaaaccagagtcacagaatatcagagccagaggaacatttggaggtaattcagtacctcctccttttcaacctacagggga

SEQ ID NO: 462922 - DNA, 3041 bp, Homo sapiens
tgcgccttgggctctcctgacgcgctgagcgggaccctgaggagccagctggcgcaggctatgggctgggcggcggttgagacagcggcggtattgggaggggtaggtgagggtcgcgaggctgcgtgagcatctgagtgaacgcggtgcttttgggaacgcgggacgggcgacctgtggcgccaggagcgggccgaggcgcggcgcacggatgccgtctggatgggaagttacggtttacagcgaagtccacccagcgtttccgaggtgaaggcgccgcgccaggccggggggcggtgagtccgggacccgcgggtacacagctgggtcctgcggctgtcgcaagttttgttgcgagcgacggagggcgaggcggggtggggggttgggagggcatgtgttccggccccgccgaggcttaagttccatgcgttcgattcctcgcttgccgctgccgcccgcagccctcatctcttgggcgctggggaagaaactcgctggcgggtgttctgtggcatcccagggggtggagggacgagcagcttcgggggcacgtcctcgtgtatcctgtggaggaccctgaccccgcaccccaccctcgaggccagaaatcagttgcctctggggacctgagaggcgagaccactcgcgcccctgacttgcaaagttggggtctttattggcctccgggattctgctcctggcggtttctccaggctggtgatgggcaacacatgaggcgcgtttgtagccatcactgaatcacctcatgactagcggggcaggcctctaattcaccgcaggatttccagtaggttggattgtggggttggtgtttgcactccaaagagttggcgtgatttccctgtatctgtctttctggcttgttagatcttctcatttggcgtcctttctccgaagagttaaccaagacgtttggcgtggttttcttgctttcctcctatcttttgctgctagagctgctttcaaaaagaagtcttttcttgcagtgataccttttctttgggttacagtgttgttcatcctttctttgccgaaagaatgaatcccagtgcttcacgaagttaaaggaaagatctgctggtagtgtttagtctttgttctgagctgatatgtgttagtagctttttgtttttaaattttattagtaaaatttcaccagtgaaccagaagctctttttttctgttgtgaaatgctagctttaagatttctgagaactttgtgtcaaagaaatctttgaaaagttactgaagtatacagagaggttcacaattttaaatgtgcaggtggtccgggcgcggtagatcacacctgtaatcccagcactttgggacgccaaggtgggcggatcacttgagcccaggatttccagaccagcctgggcaacgtgccaaaaccctatctctactaaaattacaaaagttagctgtgtgtggtggtgtgtgcctgtagtcccagctacctggtaggctgaggtgggaggatcaccagagcccaggaggttgagattgcagtgagccgtgatcatggcagtgcactcccgcctgggtggcagagtgagaccctgtctccaaaaaaaaaaaaaaaaaaaaaaaagtacagataatgaatttttaccaagtgaaccaccacagatcaagaaatagaacattactagactggggtatatttgtaggagtgacattgttggttttagaggtatatgaatgataaaacttagtattacatattgttgaacgttttcccaaagtggttgtaccatttagcagggatattctggttaccccacaaccttgctgatgcctgtcagttaaaaattattttgccattctagtaggggtgcagtaatgtatcagtgtgatttcattttgcattttcctggtattgagattgagtatcttttattgtcatttgtgtgtcctcttttgtgaagtgcctgttaaatctttttatccagttttcattgatatgcttgtttttctgttgatttgtaatacttttttccggatatgtgtcctttctacgatatatatgtattgcatttccctttttttcaatctgtagcttgccttttcgctcttttaatggtgcttattcatgaatggagattctctaactttttttttttctttttgagacaagatctcactctgttgcccaggctggagtgcagtggcacaatcacagctgaccgcaaccttgacctcccaaggctcaggtgatcctcctgcctcagcccccaggtagctgggacctacagacagggcctcactctattgcccaggctagagtgccgtggcaggatctcagctcactgcaacctccacctcctggctcaagcgatcctcccacctcagcctcctgagtagctgcgactataggagtgtgccaccatgcctggcttaattttcatattttttgtagagatggggattcaacatgtttcccaggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctgggggtgccaccaactcccactgtccagggcttccagtggactctccgaggtactgatgtagaaacttccccattcggtgcaccaagagcaacctcacacggtgtgggccgaatgaagagctgccagatcccacagcccttgaagataaggatggtcaaacaaaataatatcatacctggagaaactcagatcttgctaagatttactggttgggaatccaaagttaatgccaagaagcagccgccagttgggatcaaatgtgagcctatggatcaagaccgttacctggcacgctggccacaatctacctcactcttatcagagtctgagctactggcagtgctttcagctctgagttgaggcacctcgaaccttgtttttgtggtgaaggatcctaaagtgctgtgggagtgatcacatttttcacaacagtaa

SEQ ID NO: 462923 - DNA, 5376 bp, Homo sapiens
tgcgccttgggctctcctgacgcgctgagcgggaccctgaggagccagctggcgcaggctatgggctgggcggcggttgagacagcggcggtattgggaggggtaggtgagggtcgcgaggctgcgtgagcatctgagtgaacgcggtgcttttgggaacgcgggacgggcgacctgtggcgccaggagcgggccgaggcgcggcgcacggatgccgtctggatgggaagttacggtttacagcgaagtccacccagcgtttccgaggtgaaggcgccgcgccaggccggggggcggtgagtccgggacccgcgggtacacagctgggtcctgcggctgtcgcaagttttgttgcgagcgacggagggcgaggcggggtggggggttgggagggcatgtgttccggccccgccgaggcttaagttccatgcgttcgattcctcgcttgccgctgccgcccgcagccctcatctcttgggcgctggggaagaaactcgctggcgggtgttctgtggcatcccagggggtggagggacgagcagcttcgggggcacgtcctcgtgtatcctgtggaggaccctgaccccgcaccccaccctcgaggccagaaatcagttgcctctggggacctgagaggcgagaccactcgcgcccctgacttgcaaagttggggtctttattggcctccgggattctgctcctggcggtttctccaggctggtgatgggcaacacatgaggcgcgtttgtagccatcactgaatcacctcatgactagcggggcaggcctctaattcaccgcaggatttccagtaggttggattgtggggttggtgtttgcactccaaagagttggcgtgatttccctgtatctgtctttctggcttgttagatcttctcatttggcgtcctttctccgaagagttaaccaagacgtttggcgtggttttcttgctttcctcctatcttttgctgctagagctgctttcaaaaagaagtcttttcttgcagtgataccttttctttgggttacagtgttgttcatcctttctttgccgaaagaatgaatcccagtgcttcacgaagttaaaggaaagatctgctggtagtgtttagtctttgttctgagctgatatgtgttagtagctttttgtttttaaattttattagtaaaatttcaccagtgaaccagaagctctttttttctgttgtgaaatgctagctttaagatttctgagaactttgtgtcaaagaaatctttgaaaagttactgaagtatacagagaggttcacaattttaaatgtgcaggtggtccgggcgcggtagatcacacctgtaatcccagcactttgggacgccaaggtgggcggatcacttgagcccaggatttccagaccagcctgggcaacgtgccaaaaccctatctctactaaaattacaaaagttagctgtgtgtggtggtgtgtgcctgtagtcccagctacctggtaggctgaggtgggaggatcaccagagcccaggaggttgagattgcagtgagccgtgatcatggcagtgcactcccgcctgggtggcagagtgagaccctgtctccaaaaaaaaaaaaaaaaaaaaaaaagtacagataatgaatttttaccaagtgaaccaccacagatcaagaaatagaacattactagactggggtatatttgtaggagtgacattgttggttttagaggtatatgaatgataaaacttagtattacatattgttgaacgttttcccaaagtggttgtaccatttagcagggatattctggttaccccacaaccttgctgatgcctgtcagttaaaaattattttgccattctagtaggggtgcagtaatgtatcagtgtgatttcattttgcattttcctggtattgagattgagtatcttttattgtcatttgtgtgtcctcttttgtgaagtgcctgttaaatctttttatccagttttcattgatatgcttgtttttctgttgatttgtaatacttttttccggatatgtgtcctttctacgatatatatgtattgcatttccctttttttcaatctgtagcttgccttttcgctcttttaatggtgcttattcatgaatggagattctctaactttttttttttctttttgagacaagatctcactctgttgcccaggctggagtgcagtggcacaatcacagctgaccgcaaccttgacctcccaaggctcaggtgatcctcctgcctcagcccccaggtagctgggacctacagacagggcctcactctattgcccaggctagagtgccgtggcaggatctcagctcactgcaacctccacctcctggctcaagcgatcctcccacctcagcctcctgagtagctgcgactataggagtgtgccaccatgcctggcttaattttcatattttttgtagagatggggattcaacatgtttcccaggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctgggggtgccaccaactcccactgtccagggcttccagtggactctccgaggtactgatgtagaaacttccccattcggtgcaccaagagcaacctcacacggtgtgggccgaatgaagagctgccagatcccacagaaatgtgattgataacagtaaagccacactcctcaagtgcctgaaatacccctcattgtcttcttcaggtggcaagggctctggaacagccacataaaggtgagggcaatatttttactgtagttctttcattgattggttgattgatttttttctcttagagggttagcatacatttatctgaaattgaaattcaagaggagagacaggcacctgtactagttttctcttgctgcctattatcacattaccacaaaccagtggtttgaaaccacagaagtctggaatgaagtggccgggttctctgatcagagtcatgtgaggcccaggttcactacagataatgaaagagttcctattcttgtttgtgggggactgagggccctttttctgtgctggctgtcagcggggagacagtctactctgactccagaggccacgtgctttcctccttacctgtctgtttcatctttcaaccaataacaactcatggagtccttctcaagctcccaccttctctgacttcatcttctccaaccagccacacaaagctctgtcatgtatggagtgatgtgattagatcgagttcatgcggtaacctcaccatcttaaagtcatataactggcatataacaacatagtcacaggaatggtgtctcatcaccttaagaggctttagagacaagggtgtggcatgtttggggaccatttcagaaattccatctaccacagtaggacactcacattcccccatctgcaaagtgcatttaccctctcccctgaggtttccagatttcatgtcattaaagcattagttcaacatgaaaaatgtcatgtagaccacatcagatcaaaagtttaaaatcccatctaaaacatccacaccaggtgtgaatgaggcttccgagagtgtccattaagtgcagatccttgacataattcccttacctctgtcgacctgtgaaactgaacaaacagcttatctgcccctaatgtgaaatgatgggacagacatagaataaccactacagtgattctagttcaaaatgagggaacatggaggggataaagaagtcaataacccaaaatagtttggaaatggagctgggcaaaatccagcaggagtttcttagttaggatccacagcctgggactgaccctctgtcctgtgggtctttgcctctgggctctctgctctgcatttcttgaaaccattattatttatcatttttctcacactgttttgcgtatggctcctattgcactcaaaatgtttttgagattcatccatgttgttttgtgtgtcaaaagtttgttcctttagccattccatggaatgaatgtatcacagtttattgatccattcttgtattgatagatatttgaatgtttccagtttttcctattatgaataaaactgctatgaacattcttgtataaatcattttctggacatatgttttaatttctcttggataaatgcttaggaattagtgagtcatagaatagatagttgtttagttctgtaagaatatgccagacattttttcccaaagtgtttatactattgtacattccaaccattaatgtatgaaggtgagaaagcttttgctacttccaaagaggcctctctatatacatgtaattttttctaactggagacaggctgatgacttcagggacatgagcatgggatacctgtcatcaccaccaccataaagttgggattcaggaaggaggttaatcatataaagaatcctgtgaccagtatgagcttctctcaggccacacagggcactcaagtgaacagggcatgggggccctggggtcatggtaagaaagtgtctcattggtaaaaccttttcctctggggaggtaaataaatgatttgtttcttcttggtagcccttgaagataaggatggtcaaacaaaataatatcatacctggagaaactcagatcttgctaagatttactggttgggaatccaaagttaatgccaagaagcagccgccagttgggatcaaatgtgagcctatggatcaaggtgcgtactcaaacacagagagctttctgaaagatgctaccagtagtttttccagggcagagatgggtcctttatttttctctctaatctagcccatatgcttagctgagttttctttgtatcactttaaatgatgatgtcccttgttcaacaattttctaaacattctttagataataattttatgggcattctttattgcattaggcttaaattttttaatgcatcttaaggttttattgcaaaatattgccttgtttcctttttaagatgatacagtttataatatgcaaatttgttgtctgtcccctccctttatgtacatagaaaatgagcaaacaggtggccatgaaacagatggtcatagaattggttcagtggttgtgagtgcagcaacccaagagtgtcttatctgaaataccaccaggaatgtctggacacagtagacaaaggtttttcaactggacgccttaggatacatgcttgcaaaaacaaagtagccaaaaagaaaccagagtcacagaatatcagagccagaggaacatttggaggtaattcagtacctcctccttttcaacctacagggga

SEQ ID NO: 462924 - DNA, 2954 bp, Homo sapiens
tgcgccttgggctctcctgacgcgctgagcgggaccctgaggagccagctggcgcaggctatgggctgggcggcggttgagacagcggcggtattgggaggggtaggtgagggtcgcgaggctgcgtgagcatctgagtgaacgcggtgcttttgggaacgcgggacgggcgacctgtggcgccaggagcgggccgaggcgcggcgcacggatgccgtctggatgggaagttacggtttacagcgaagtccacccagcgtttccgaggtgaaggcgccgcgccaggccggggggcggtgagtccgggacccgcgggtacacagctgggtcctgcggctgtcgcaagttttgttgcgagcgacggagggcgaggcggggtggggggttgggagggcatgtgttccggccccgccgaggcttaagttccatgcgttcgattcctcgcttgccgctgccgcccgcagccctcatctcttgggcgctggggaagaaactcgctggcgggtgttctgtggcatcccagggggtggagggacgagcagcttcgggggcacgtcctcgtgtatcctgtggaggaccctgaccccgcaccccaccctcgaggccagaaatcagttgcctctggggacctgagaggcgagaccactcgcgcccctgacttgcaaagttggggtctttattggcctccgggattctgctcctggcggtttctccaggctggtgatgggcaacacatgaggcgcgtttgtagccatcactgaatcacctcatgactagcggggcaggcctctaattcaccgcaggatttccagtaggttggattgtggggttggtgtttgcactccaaagagttggcgtgatttccctgtatctgtctttctggcttgttagatcttctcatttggcgtcctttctccgaagagttaaccaagacgtttggcgtggttttcttgctttcctcctatcttttgctgctagagctgctttcaaaaagaagtcttttcttgcagtgataccttttctttgggttacagtgttgttcatcctttctttgccgaaagaatgaatcccagtgcttcacgaagttaaaggaaagatctgctggtagtgtttagtctttgttctgagctgatatgtgttagtagctttttgtttttaaattttattagtaaaatttcaccagtgaaccagaagctctttttttctgttgtgaaatgctagctttaagatttctgagaactttgtgtcaaagaaatctttgaaaagttactgaagtatacagagaggttcacaattttaaatgtgcaggtggtccgggcgcggtagatcacacctgtaatcccagcactttgggacgccaaggtgggcggatcacttgagcccaggatttccagaccagcctgggcaacgtgccaaaaccctatctctactaaaattacaaaagttagctgtgtgtggtggtgtgtgcctgtagtcccagctacctggtaggctgaggtgggaggatcaccagagcccaggaggttgagattgcagtgagccgtgatcatggcagtgcactcccgcctgggtggcagagtgagaccctgtctccaaaaaaaaaaaaaaaaaaaaaaaagtacagataatgaatttttaccaagtgaaccaccacagatcaagaaatagaacattactagactggggtatatttgtaggagtgacattgttggttttagaggtatatgaatgataaaacttagtattacatattgttgaacgttttcccaaagtggttgtaccatttagcagggatattctggttaccccacaaccttgctgatgcctgtcagttaaaaattattttgccattctagtaggggtgcagtaatgtatcagtgtgatttcattttgcattttcctggtattgagattgagtatcttttattgtcatttgtgtgtcctcttttgtgaagtgcctgttaaatctttttatccagttttcattgatatgcttgtttttctgttgatttgtaatacttttttccggatatgtgtcctttctacgatatatatgtattgcatttccctttttttcaatctgtagcttgccttttcgctcttttaatggtgcttattcatgaatggagattctctaactttttttttttctttttgagacaagatctcactctgttgcccaggctggagtgcagtggcacaatcacagctgaccgcaaccttgacctcccaaggctcaggtgatcctcctgcctcagcccccaggtagctgggacctacaggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctgggggtgccaccaactcccactgtccagggcttccagtggactctccgaggtactgatgtagaaacttccccattcggtgcaccaagagcaacctcacacggtgtgggccgaatgaagagctgccagatcccacagcccttgaagataaggatggtcaaacaaaataatatcatacctggagaaactcagatcttgctaagatttactggttgggaatccaaagttaatgccaagaagcagccgccagttgggatcaaatgtgagcctatggatcaagaaaatgagcaaacaggtggccatgaaacagatggtcatagaattggttcagtggttgtgagtgcagcaacccaagagtgtcttatctgaaataccaccaggaatgtctggacacagtagacaaaggtttttcaactggacgccttaggatacatgcttgcaaaaacaaagtagccaaaaagaaaccagagtcacagaatatcagagccagaggaacatttggaggtaattcagtacctcctccttttcaacctacagggga

SEQ ID NO: 462925 - DNA, 2610 bp, Homo sapiens
tgcgccttgggctctcctgacgcgctgagcgggaccctgaggagccagctggcgcaggctatgggctgggcggcggttgagacagcggcggtattgggaggggtaggtgagggtcgcgaggctgcgtgagcatctgagtgaacgcggtgcttttgggaacgcgggacgggcgacctgtggcgccaggagcgggccgaggcgcggcgcacggatgccgtctggatgggaagttacggtttacagcgaagtccacccagcgtttccgaggtgaaggcgccgcgccaggccggggggcggtgagtccgggacccgcgggtacacagctgggtcctgcggctgtcgcaagttttgttgcgagcgacggagggcgaggcggggtggggggttgggagggcatgtgttccggccccgccgaggcttaagttccatgcgttcgattcctcgcttgccgctgccgcccgcagccctcatctcttgggcgctggggaagaaactcgctggcgggtgttctgtggcatcccagggggtggagggacgagcagcttcgggggcacgtcctcgtgtatcctgtggaggaccctgaccccgcaccccaccctcgaggccagaaatcagttgcctctggggacctgagaggcgagaccactcgcgcccctgacttgcaaagttggggtctttattggcctccgggattctgctcctggcggtttctccaggctggtgatgggcaacacatgaggcgcgtttgtagccatcactgaatcacctcatgactagcggggcaggcctctaattcaccgcaggatttccagtaggttggattgtggggttggtgtttgcactccaaagagttggcgtgatttccctgtatctgtctttctggcttgttagatcttctcatttggcgtcctttctccgaagagttaaccaagacgtttggcgtggttttcttgctttcctcctatcttttgctgctagagctgctttcaaaaagaagtcttttcttgcagtgataccttttctttgggttacagtgttgttcatcctttctttgccgaaagaatgaatcccagtgcttcacgaagttaaaggaaagatctgctggtagtgtttagtctttgttctgagctgatatgtgttagtagctttttgtttttaaattttattagtaaaatttcaccagtgaaccagaagctctttttttctgttgtgaaatgctagctttaagatttctgagaactttgtgtcaaagaaatctttgaaaagttactgaagtatacagagaggttcacaattttaaatgtgcaggtggtccgggcgcggtagatcacacctgtaatcccagcactttgggacgccaaggtgggcggatcacttgagcccaggatttccagaccagcctgggcaacgtgccaaaaccctatctctactaaaattacaaaagttagctgtgtgtggtggtgtgtgcctgtagtcccagctacctggtaggctgaggtgggaggatcaccagagcccaggaggttgagattgcagtgagccgtgatcatggcagtgcactcccgcctgggtggcagagtgagaccctgtctccaaaaaaaaaaaaaaaaaaaaaaaagtacagataatgaatttttaccaagtgaaccaccacagatcaagaaatagaacattactagactggggtatatttgtaggagtgacattgttggttttagaggtatatgaatgataaaacttagtattacatattgttgaacgttttcccaaagtggttgtaccatttagcagggatattctggttaccccacaaccttgctgatgcctgtcagttaaaaattattttgccattctagtaggggtgcagtaatgtatcagtgtgatttcattttgcattttcctggtattgagattgagtatcttttattgtcatttgtgtgtcctcttttgtgaagtgcctgttaaatctttttatccagttttcattgatatgcttgtttttctgttgatttgtaatacttttttccggatatgtgtcctttctacgatatatatgtattgcatttccctttttttcaatctgtagcttgccttttcgctcttttaatggtgcttattcatgaatggagattctctaactttttttttttctttttgagacaagatctcactctgttgcccaggctggagtgcagtggcacaatcacagctgaccgcaaccttgacctcccaaggctcaggtgatcctcctgcctcagcccccaggtagctgggacctacaggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctgggggtgccaccaactcccactgtccagggcttccagtggactctccgaggtactgatgtagaaacttccccattcggtgcaccaagagcaacctcacacggtgtgggccgaatgaagagctgccagatcccacaggtaaaaaccctgaggcattgccagctcgatggagtcagagagtcctttttctattatga

SEQ ID NO: 462926 - DNA, 1929 bp, Homo sapiens
ggatgtgccttccagctacttttaatgacttccttctcagcaggagagatatttatcctcactgccatgtcctatgaccgctatgtagccatctgctgtcccctgaactacgaggtattggagttggtgcatgtttaagcatttcttgtttcatctgtattgtgatctcttacattatatcttctccactgtactgaagatccctaccactaaaggctgctttctgtgatctacactgtgatgcctccagtatttaaccctgtaacctacagcctgcggaacaatgacatgaaatgtgctctgataaggttgctgcagaaaacatatggtcaggaggcttacttcatttaacactttcaagttctgtcagtgatacagtgccttacagatcacaagaaactttccttatttgtaactttggaaagacctgagaaaagaaagcaatatactcaaattattttttccctgaagaaataaatactcaagagcctaactgactatttctaagtcacttaattgcattacatcaggataatacatagtgttatagtaatcatttggtattcttctatgacaaagcatttctgcctttgtattataactttctgaaagaattggttctgtttaacatgatgctttcatctttggtctcttaataacccattttctctattttattcactgagaacaaattaaaaatgctgaggtgattcaatgagtgcagtataatgcatttgcattatactacccagataaaattcacatgactcccctgagaatctagctagagctgagcaagaacaatactaggcaaaaataacacacgacagtggatacatgcagtagctttgggtttatgcgggaaacaacattcggcgttggtgaacgcgagggactgtgtgattgggttaaagggctcagtgcggggactctgttttctggtttcagtaccacaatggacacaggcaacaaaactctgccccaggactttctcttactgggctttcctggttctcaaactcttcagctctctctctttatgctttttctggtgatgtacatcctcacagttagtggtaatgtggctatcttgatgttggtgagcacctcccatcagttgcatacccccatgtacttctttctgagcaacctctccttcctggagatttggtataccacagcagcagtgcccaaagcactggccatcctactggggagaagtcagaccatatcatttacaagctgtcttttgcagatgtactttgttttctcattaggctgcacagagtacttcctcctggcagccatggcttatgaccgctgtcttgccatctgctatcctttacactacggagccatcatgagtagcctgctctcagcgcagctggccctgggctcctgggtgtgtggtttcgtggccattgcagtgcccacagccctcatcagtggcctgtccttctgtggcccccgtgccatcaaccacttcttctgtgacattgcaccctggattgccctggcctgcaccaacacacaggcagtagagcttgtggcctttgtgattgctgttgtggttatcctgagttcatgcctcatcacctttgtctcctatgtgtacatcatcagcaccatcctcaggatcccctctgccagtggccggagcaaagccttctccacgtgctcctcgcatctcaccgtggtgctcatttggtatgggtccacagttttccttcacgtccgcacctctatcaaagatgccttggatctgatcaaagctgtccacgtcctgaacactgtggtgactccagttttaaaccccttcatctatacgcttcgtaataaggaagtaagagagactctgctgaagaaatggaagggaaaataaatctcctctaccacaacagatgtcctgtaaatggtctctgcatctat

SEQ ID NO: 462927 - DNA, 484 bp, Homo sapiens
ggatgtgccttccagctacttttaatgacttccttctcagcaggagagatatttatcctcactgccatgtcctatgaccgctatgtagccatctgctgtcccctgaactacgaggtgattcatgtgcccattagagcttgagaagcactgcttggaagccccttctgccatcaatgagcaccatcctcaggatcccctctgccagtggccggagcaaagccttctccacgtgctcctcgcatctcaccgtggtgctcatttggtatgggtccacagttttccttcacgtccgcacctctatcaaagatgccttggatctgatcaaagctgtccacgtcctgaacactgtggtgactccagttttaaaccccttcatctatacgcttcgtaataaggaagtaagagagactctgctgaagaaatggaagggaaaataaatctcctctaccacaacagatgtcctgtaaatggtctctgcatctat

SEQ ID NO: 462928 - DNA, 1174 bp, Homo sapiens
ttccccaaaatggagaattcagaagaagcagcttcacatttcctgaaagacttctgtgccacatggttgctaagcactgagagcacaaagataattaagctgattccctgtcctcagcacacccataagcctcagctgcgctcagaaaatgagggaatgagaagaaagtggaattggacagaaagccttgcttttgaatcctggctcctgcatgtattagcaaatgactcaacacatctgagcctcagtttcttcagcaatgcagtggggacaataacatctacccctcagagctgttatgaggactcaaaagatactctgtcctgtggtttggtacccaagctggtctctttggggctcagtctggtgctggttgatgggtgtggccaccccatacctactcctgcagccttttcaaagagaaggaagcttcagtgtgagcactttgaagcatctgcttactgatctgaagcctcctcaaaagttacaccaaggcccgttttgctgtcctgctcactggatccctctgctgaagaaaaaggggtcaaggataacccagacacattcatggggtgggctgctaggggtgccaggtagatgcagctgccccaaggtcggggactcaggaacttgggctctacggcatcccaccccttcctcacatctggtgtgctctggcagagtcctggctctctccaagctggtcaccaagactttcctcatacatttaaccaatctttacacaggacctccgctgacctgagcacttcctgcatgaaaggggctcaataccaaggaagaaaacagatacatgcaccctttctaagtagcaaaactgggttcaaatcctcggctacatcacttatgtgagatgaagtcccactatattgccaaggctggacttgaatccctaagctcaagtagtgttcccacctcaccctcccaagtaactgagactacaggtgcacaccactgtaccagcataattgcatatcttatcaatcaatccacagccactaaatacctactgaggtatctgtgtcccctgggctttttccaagagctttcaatatggttagatttgtttattaaatttgcataaatatgtgatatgagtagttatatattcatgtgatcatttgttcatttgtaaatattaattaaatgccttttt

SEQ ID NO: 462929 - DNA, 459 bp, Homo sapiens
cctaagaagatgtagataaagtgactgcaaggacctccgctgacctgagcacttcctgcatgaaaggggctcaataccaaggaagaaaacagatacatgcaccctttctaagtagcaaaactgggttcaaatcctcggctacatcacttatgtgagatgaagtcccactatattgccaaggctggacttgaatccctaagctcaagtagtgttcccacctcaccctcccaagtaactgagactacaggtgcacaccactgtaccagcataattgcatatcttatcaatcaatccacagccactaaatacctactgaggtatctgtgtcccctgggctttttccaagagctttcaatatggttagatttgtttattaaatttgcataaatatgtgatatgagtagttatatattcatgtgatcatttgttcatttgtaaatattaattaaatgccttttt

SEQ ID NO: 462930 - DNA, 472 bp, Homo sapiens
tttcttctctctagtggcaaggggggaaatgaggagaccttccaatgtcttctctaccaagtgaatctctgactctacaagtttccttcccaagacactgtggtccagggctacctcccttacagcctacatgacaacatgtgcaaattatttgtcagcatctaattgcaagaacggtgagtcctccgtgcctcattggaggccataaatgggtaattggagccatggttagtgggctgaggtcacacttttctgctggttaagatgcagacaccacaggcataagccgtcccctttaagacttttactggctaaaaagggcaagaacactctgttccaagaagcagaaagcaaaagaaacacagacttccttgctcctggtgtttagatctatgagcctactcttatcatatctcaagttttaatcccaaagacaagatcaagatcatgtccatacttcttaggcttaagg

SEQ ID NO: 462931 - DNA, 1155 bp, Homo sapiens
tttcttctctctagtggcaaggggggaaatgaggagaccttccaatgtcttctctaccaagtgaatctctgactctacaagtttccttcccaagacactgtggtccagggctacctcccttacagcctacatgacaacatgtgcaaattatttgtcagcatctaattgcaagaacgatgaggaaaccaaggcacagaggttaaacaacgtgtccaagccacgtagcaagtaaacaattgagccaggctccaaatccaaacgttctggcgtcagagtcctataaagatttttttggcctaatgtgaggaagtactttctaagaataagagtttaccaattaaaagggggttgctgttttatgaagatatttaaaccaaggctgaggggccattttcaagggatgctgactcggtaaaagttctttggcagcaagcatcagaaaccaaatgtaacaactttaagctaaaaaataaaaagaaggaagaggaagaagagaagatggggttgagggaggaggacaggaaaaaaaaggagaagaaaggtgaagaggaaacaacgggatggccatcgtctaagataacctgttttcactgtggagcacaggctctgaaggggacacagccaaaccacaccagctcattagcatcttcagctctgccatggcatagggcatgtctgctcatactccacttgacaagcctttcctctgcccagctccaagcatgccgtctgcagacaaaggccttgaagaggctgcatgtgtccttgaccctcactgacagcacttgcttctggactcagagggagccccagggaatgccccggccaccttccgcctgtttcaaggctttaccatccaagatcactggcaatgaacttgcaggaccaagggagcctgcaggaggaatgatctccaggaaccaccaccccttccaggagccaccgtttaagggcttgagaatggccctctcttcccctgccaactgttctttgatcctctagaacagtgttttttaaacacagcaaatcacagctcattagtgagacatgaaatcaatttagtgagctgaaatcaccatattttatcttaaaagagaaaagaaaatagtttgcgttgcacaaagtaaagaatttacccatcaaagaaaagcacct

SEQ ID NO: 462932 - DNA, 1056 bp, Homo sapiens
tgccgcaacatgaaaagtgacaaccatagcttcttaggggactcccctaaagccttcatccttctgggtgtgtctgacaggccgtggctggaactccctctctttgtggtcctcctgctgtcctatgtgctggccatgttggggaacgtcgccatcatcctggcatcccgggtggatcctcaactccacagccccatgtacatcttcctcagtcacctgtccttcctggacctctgctacaccaccacgacagtccctcagatgctggtcaacatgggcagttcccagaagaccatcagctatggaggctgcactgagcaatatgcaaccttccactggctgggatgcaccggagggcatcgtcctggccgccatggccctggaccgctacgtggccatctgcaagcccctgcactatgccgttctcatgcaccgtgctctctgtcagcagctcgtggctctggcctggctcagtggcttcggcaactccttcgtgcaggtggtcctgacggtgcaattgccattctgcgggcggcaggtgctgaacaactttttctgtgaggtgccggccgtgatcaagctgtcgtgtgctgacaccgctgtgaatgacaccatactggctgtgctggtggccttcttcgtgttggtgcccctggctctcatccttctctcctatggctttattgcccgggcagtgctcaggatccagtcctccaagggacgacacaaggcctttgggacgtgttcctcccacctgatgatcgtctccctcttctacctacctgcgatttacatgtatctgcagcccccttccagctactcccaagagcagggcaaatttatttctctcttctattccataatcacccccactctcaatcccttcacctacaccctgagaaataaagatatgaagggggctctgaggagacttctggccaggatctggaggctcttatacacaagatgaagctgaaatacaatcttattttacttacaatgaataagtgtttttctccatatacttaaatctccacaaattttacacgacttttt

SEQ ID NO: 462933 - DNA, 1543 bp, Homo sapiens
ggtggcagacatgggagagacaggcaagctgcaaagggaagtcgacgaaataaaattaaagccctacaatcgtgttcgtgtcaatgtagatggggtgcccccctcggtttgctcacagaggtgggtgtgagatcctacaggacggtctggaagacatcccatggaaggcactttattttgcccagaagctggaggaaaagcagaagggcgctgaacactgactaagaggagagagcgcacattacatggagaccatggtccccataccagaaacatgagagtagagagaagcaaagccagcatcgtggagccagtccctttatccaggatcttggagggatacagtcttctgtagaaattaaataaagactgaattcttcaatgggtattttgagaagagagccactgtaagcttatacactgtgaattgcaaaatgttactgcctctgggtggacaggttttaaaaagacttttttttttcctcctggcatggctgacagagggaaggctgggtttcaatcccatctttcccttcccttgcccagtgcttctttatgtgcacaacctgcacaactatatgtggtttgcaaacacgcataagcaaagactaacagcttctgaaacaaactctgaataaaagagggagcatattaaggcagatggcagaggaggtgagcagcatgggcagatagaagcatcacagagactacaagaagaatgtgccagaccggctcatagtggccacactgattaagaattaccatcagctctttaggatttggaaacttggaaacacattgtgtgttcttcctggtttgttatagagtatgtgtatgtacttctttctcttaaaaatatttatttttaaagaattgacttataaaattatatgtatttgtcatgtataacacaatattttgaagtacagtcctgtgtcataaggatatgttctgagaaatccatcaattttgtcattgtataaacatgatagagtgtatttacacaaacctaggtggtataaactactacacacctaggctacataatgtagcctattgctcctaggctataaacctgtataacatgctactgtactaaatactatagacaatagtcacatactggtgagtatttgcgtatcaaaacatatctaaatatagaaaagatgcagtaaaaatatggtattacaatcttatgagaccactatagtatatgaggtccatcattgattaaaacatagttatatggtgcatgactgtatatatgcattgtggaatggttaaatctagctaactaacaaatgtgttatatcacatagttattatttttgaggtgagaatacaatattcactctcttagcattttttaagaatacagtatattaactatagtcaccatgctgaatggtagatctctggaactaatttctcctatctaagtgtgattatgtaccctttgaccaacatctttctaaccccaccccacaaacaccccataataaagcctcttgtaaccaccattttactcctttttctatgagaa

SEQ ID NO: 462934 - DNA, 1869 bp, Homo sapiens
  misc_feature (281)..(281): n is a, c, g, or t
  misc_feature (283)..(283): n is a, c, g, or t
  misc_feature (285)..(285): n is a, c, g, or t
ggtgccaagccagcatctagacatgaacattctaggcacggaggccaattttacctccaaagtatctctggactccgtctcaacatccctgtccccgctgctcagcagaagtaccatctctgagaagcatatttttcaacttattgtaaatgaagcctatagggctgcatggggcagggaaattatacataatttatccaaatatttgttctttctgagagaggagtatgagagtagggatgcagctgtggggctcatagagacacttaatggagacacgncnancaattcccacaacacccctggaacatgtcttcttcaacctttaagtcaacctaatgaaatgattcaccttggagtcactaaaatgtttcatgtacttcagagttgctgccatatggttcccataaaggttctgccaaaattcccatacattagtttgccaagtatgctgctggatgttcattcagcactagtgtttaacaaaagcccggttttaaaatcagaggatatgagttgggggggccttgagggcgctgaacactgactaagaggagagagcgcacattacatggagaccatggtccccataccagaaacatgagagtagagagaagcaaagccagcatcgtggagccagtccctttatccaggatcttggagggatacagtcttctgtagaaattaaataaagactgaattcttcaatgggtattttgagaagagagccactgtaagcttatacactgtgaattgcaaaatgttactgcctctgggtggacaggttttaaaaagacttttttttttcctcctggcatggctgacagagggaaggctgggtttcaatcccatctttcccttcccttgcccagtgcttctttatgtgcacaacctgcacaactatatgtggtttgcaaacacgcataagcaaagactaacagcttctgaaacaaactctgaataaaagagggagcatattaaggcagatggcagaggaggtgagcagcatgggcagatagaagcatcacagagactacaagaagaatgtgccagaccggctcatagtggccacactgattaagaattaccatcagctctttaggatttggaaacttggaaacacattgtgtgttcttcctggtttgttatagagtatgtgtatgtacttctttctcttaaaaatatttatttttaaagaattgacttataaaattatatgtatttgtcatgtataacacaatattttgaagtacagtcctgtgtcataaggatatgttctgagaaatccatcaattttgtcattgtataaacatgatagagtgtatttacacaaacctaggtggtataaactactacacacctaggctacataatgtagcctattgctcctaggctataaacctgtataacatgctactgtactaaatactatagacaatagtcacatactggtgagtatttgcgtatcaaaacatatctaaatatagaaaagatgcagtaaaaatatggtattacaatcttatgagaccactatagtatatgaggtccatcattgattaaaacatagttatatggtgcatgactgtatatatgcattgtggaatggttaaatctagctaactaacaaatgtgttatatcacatagttattatttttgaggtgagaatacaatattcactctcttagcattttttaagaatacagtatattaactatagtcaccatgctgaatggtagatctctggaactaatttctcctatctaagtgtgattatgtaccctttgaccaacatctttctaaccccaccccacaaacaccccataataaagcctcttgtaaccaccattttactcctttttctatgagaa

SEQ ID NO: 462935 - DNA, 1468 bp, Homo sapiens
  misc_feature (24)..(24): n is a, c, g, or t
agcggagaagctggaggaaaagcngaagatacattagtttgccaagtatgctgctggatgttcattcagcactagtgtttaacaaaagcccggttttaaaatcagaggatatgagttgggggggccttgagggcgctgaacactgactaagaggagagagcgcacattacatggagaccatggtccccataccagaaacatgagagtagagagaagcaaagccagcatcgtggagccagtccctttatccaggatcttggagggatacagtcttctgtagaaattaaataaagactgaattcttcaatgggtattttgagaagagagccactgtaagcttatacactgtgaattgcaaaatgttactgcctctgggtggacaggttttaaaaagacttttttttttcctcctggcatggctgacagagggaaggctgggtttcaatcccatctttcccttcccttgcccagtgcttctttatgtgcacaacctgcacaactatatgtggtttgcaaacacgcataagcaaagactaacagcttctgaaacaaactctgaataaaagagggagcatattaaggcagatggcagaggaggtgagcagcatgggcagatagaagcatcacagagactacaagaagaatgtgccagaccggctcatagtggccacactgattaagaattaccatcagctctttaggatttggaaacttggaaacacattgtgtgttcttcctggtttgttatagagtatgtgtatgtacttctttctcttaaaaatatttatttttaaagaattgacttataaaattatatgtatttgtcatgtataacacaatattttgaagtacagtcctgtgtcataaggatatgttctgagaaatccatcaattttgtcattgtataaacatgatagagtgtatttacacaaacctaggtggtataaactactacacacctaggctacataatgtagcctattgctcctaggctataaacctgtataacatgctactgtactaaatactatagacaatagtcacatactggtgagtatttgcgtatcaaaacatatctaaatatagaaaagatgcagtaaaaatatggtattacaatcttatgagaccactatagtatatgaggtccatcattgattaaaacatagttatatggtgcatgactgtatatatgcattgtggaatggttaaatctagctaactaacaaatgtgttatatcacatagttattatttttgaggtgagaatacaatattcactctcttagcattttttaagaatacagtatattaactatagtcaccatgctgaatggtagatctctggaactaatttctcctatctaagtgtgattatgtaccctttgaccaacatctttctaaccccaccccacaaacaccccataataaagcctcttgtaaccaccattttactcctttttctatgagaa

SEQ ID NO: 462936 - DNA, 725 bp, Homo sapiens
ggtggcagacatgggagagacaggcaagctgcaaagggaagtcgacgaaataaaattaaagccctacaatcgtgttcgtgtcaatgtagatggggtgcccccctcggtttgctcacagaggtgggtgtgagatcctacaggacggtctggaagacatcccatggaaggcactttattttgcccagaagctggaggaaaagcagaagagtgctgattggtgcatttacaatcctttagctagacagaaaagttcttcaagtccccacttgacccagaaagtccagctggcttcacctcttaaaactactccacctgaggtttttagataaaaaagaattgtactcaaggaattgaagctatggagcctctgccacatctggacctgattttgatgacaagatcctgtacctcaagcccgagactaatttcataatttgatgaatctttctggagagtcatgggaggaatgtaaacaatttgtggccaaaggagaattatggtagtttgaagatgtggatacaaattatttgacattcttctcatagaaaggtaactccatagctgggagccaagtctcgaagccccatgaggggaagtggatacatctcagaattggggtttcctgatacacacgactgcatccttcatctgccaggccctgacattgtttactggagaagatgtcataggaaattgggctatgtcattgagccactggagtcaca

SEQ ID NO: 462937 - DNA, 1002 bp, Homo sapiens
ctctcctcaaccaccatcttatcaaaggtgacaagagtcacctttgctccagttcccagcaagtgtggtgtcagcacagcggcaggtcaccgttcaggaaggacccttgtaccgcatggagggctcccacatcactatctggtgcaatgtgagtggctcccagggacctcctgagcagaatttccagtggtccatttacctgccttcgtcgccagagcgagaggtgcagatcgtcagcaccatggacccttccttcccctatgccatctacacccagcgcgtccgcggagggaagatcttcatagaaagagtccaggggaacccaaccctattgcacatcacagatcttcaggcccgggatgccggagaatatgaatgccacacacccagcaccgataagcaatactttgggagttacagtgcaaagatgaacctagtgggtaaggagaagctgtcttcacgtcgccagcactccctgcagaccactgccatgccccagactctgcacagagtggagcaggacccactggagctcacttgtgaggtggcctcggagaccgttcagcacagccacctgtctgtggcctggctctggcagaaagttggcgagaagcccgtggaggtcatctccctgagccgagatttcatgcttcactctggcagcgaatatgcccagaggcagagcctgggggaggtgcggctggacaagctggggaggaccaccttctgcctcaccatcttccacctgcagccttctgaccagggcgagttctactgcgaggccgctgagtggatccaggatccggatgggtcgtggtatgctatgacccgaaagcgttccgagggagcagtggtcaacgtccagccaactggtcagtccctctgagcctcttgtcctgtcctttacttggtggtgaaagctgtcagatactgggagaatgtggagactccttctttgggcacctctaccagggcagcaggttttcatgtgaagttaaagcc

SEQ ID NO: 462938 - DNA, 326 bp, Homo sapiens
cgtcgaccgggccgcgtcgactgctacaacatggacgttatgctaagtgaaataaaccagttccgaaaggacaaatacacccatttccacttatatggggtatctaacgtcaaactcagaagaacaaagtactgcggtatttgccacaagctggtggaggagaaaatgagttgttcaatgggtattgagtgtcagccacgcaagatggaaaagcttttattacaatttttattgtgataaaaacacataaaatttaccctttcacatactttgtgtgtaccgaagagtattgttaactataggcactctttttatacaacaaatct

SEQ ID NO: 462939 - DNA, 2086 bp, Homo sapiens
tggtctgcattggggtcttgctctgttgcctagggtgtggagtgcggtggcatgatcatgcctcactatagccttgacctcctgggctcaagcgatcctcccacctgagtctcctgagtacctgggaccacaggcacatgctaacgcacccagttaatttttttattcgtagagccgaggtctcactatgttgcccagactggtctcaagctcttgggctcaagcagtcctcctgcctcagcctcccaaagtgccaggattacaggtgtgagccaccacacccagtccaaaaagtgattttctaattccatagtttcttctacatttcttaactggaattttgtaaggaagagttatccttattcatttatttacccatttacttgtaggagcatgtatcataaattcttaatctatggggtgtagttagctactgtaaatttgatgcacatatttttccagattcaataagtaggatccccatcaagctatcttctgaatctttaaaaatgtattctccttatttcatgggtatataattattttctgggcaacagtttgttcatggtacatttgtctccagccctagactcagaaaaatgtaatttattttaatggagaatactatttagaagctgcagtctctgtgtagggaggtgttcctaggtaatagtgccctggcttttaggtcttctctatggaggatatggcaaagacatacaaaattatatatacgtatccacacattaataactctatttctatattaaaaacatgaccacaagccaacacttttaattccactgcagcactgctgggttatttcttgctttccaaattcccttgtctgtagctatctttcatcacttgcaaaaatagcacgtgctcaatcctagattaaaatataagctactctcagaattgataactcataccactctttttaaaaatcaactaaccagaattcagtttttattcacagttcttatctttagctcagggcgtaatataaaagcactaggtttaaaacttacttggtcagcagcaatccacttctaggtacatgtccaaaggaactgaagaaagcatctcaatgtgtgaatgcctacctgtgttcattgcagcattattcagaagagccaagaggtggaagcaaagtaaatgtccattgacagatgaattggtaaacaaaatgcattatatacatacaatgcaatatcatttagccttaaaaacaaaattctgccatatgctacaacatggacgttatgctaagtgaaataaaccagttccgaaaggacaaatacacccatttccacttatatggggtatctaacgtcaaactcagaagaacaaagtactgcggtatttgccacaagctggtggaggagaaaatgagttgttcaatgggtattgagtgtcagccacgcaagatggaaaagctttttgagatttgttgtataaaaatatgcctatagttaacaatactcttcggtacacacaaagtatgtgaaagggtaaattttatgtgtttttatcacaataaaaattgtaataaaagaagttacttgggtcaattttgtgctttttacccccctcttcattgttgaatttttatccatttgatacaaagttcatttcagtaattcctgttaattttccattttgtgtcacaccttgctccaggccatctgcatatatacgtgcaggtcacacgggttatgatggcttagcttgggcttggaggcctgacattccagtcttcttatattaatcagaaaaacaaaatagtggtgaagtgttggggggcaatgaaaattttggggggagctatggagagataatgggcaatgtttctcaaggctgcttcaagtgggatgaggggcaacatgggaacctagagtgggagagattaaactgaagaaagattttgagaaaaggggtgatattgtggggttgttaaaaggagtatttgttgtatagaatgattggtgatggcctggatgtggttttgtatgaattgagaaactaaacggaagacacaaggtctgaataagagaaggagaaaaacaagtattagaggact

SEQ ID NO: 462940 - DNA, 2048 bp, Homo sapiens
ggctgggtgcggtggctcacgcctgtaatcccagcactttgggaggctgagaagcgatcctcccacctgagtctcctgagtacctgggaccacaggcacatgctaacgcacccagttaatttttttattcgtagagccgaggtctcactatgttgcccagactggtctcaagctcttgggctcaagcagtcctcctgcctcagcctcccaaagtgccaggattacaggtgtgagccaccacacccagtccaaaaagtgattttctaattccatagtttcttctacatttcttaactggaattttgtaaggaagagttatccttattcatttatttacccatttacttgtaggagcatgtatcataaattcttaatctatggggtgtagttagctactgtaaatttgatgcacatatttttccagattcaataagtaggatccccatcaagctatcttctgaatctttaaaaatgtattctccttatttcatgggtatataattattttctgggcaacagtttgttcatggtacatttgtctccagccctagactcagaaaaatgtaatttattttaatggagaatactatttagaagctgcagtctctgtgtagggaggtgttcctaggtaatagtgccctggcttttaggtcttctctatggaggatatggcaaagacatacaaaattatatatacgtatccacacattaataactctatttctatattaaaaacatgaccacaagccaacacttttaattccactgcagcactgctgggttatttcttgctttccaaattcccttgtctgtagctatctttcatcacttgcaaaaatagcacgtgctcaatcctagattaaaatataagctactctcagaattgataactcataccactctttttaaaaatcaactaaccagaattcagtttttattcacagttcttatctttagctcagggcgtaatataaaagcactaggtttaaaacttacttggtcagcagcaatccacttctaggtacatgtccaaaggaactgaagaaagcatctcaatgtgtgaatgcctacctgtgttcattgcagcattattcagaagagccaagaggtggaagcaaagtaaatgtccattgacagatgaattggtaaacaaaatgcattatatacatacaatgcaatatcatttagccttaaaaacaaaattctgccatatgctacaacatggacgttatgctaagtgaaataaaccagttccgaaaggacaaatacacccatttccacttatatggggtatctaacgtcaaactcagaagaacaaagtactgcggtatttgccacaagctggtggaggagaaaatgagttgttcaatgggtattgagtgtcagccacgcaagatggaaaagctttttgagatttgttgtataaaaatatgcctatagttaacaatactcttcggtacacacaaagtatgtgaaagggtaaattttatgtgtttttatcacaataaaaattgtaataaaagaagttacttgggtcaattttgtgctttttacccccctcttcattgttgaatttttatccatttgatacaaagttcatttcagtaattcctgttaattttccattttgtgtcacaccttgctccaggccatctgcatatatacgtgcaggtcacacgggttatgatggcttagcttgggcttggaggcctgacattccagtcttcttatattaatcagaaaaacaaaatagtggtgaagtgttggggggcaatgaaaattttggggggagctatggagagataatgggcaatgtttctcaaggctgcttcaagtgggatgaggggcaacatgggaacctagagtgggagagattaaactgaagaaagattttgagaaaaggggtgatattgtggggttgttaaaaggagtatttgttgtatagaatgattggtgatggcctggatgtggttttgtatgaattgagaaactaaacggaagacacaaggtctgaataagagaaggagaaaaacaagtattagaggact

SEQ ID NO: 462941 - DNA, 1982 bp, Homo sapiens
ggtgggatttatagtaataaattagtttaagattgcaggccaggcccagtggctcacacatataatcccagcactttgggaggttaaggtggacagatcactcgagctcttgggctcaagcagtcctcctgcctcagcctcccaaagtgccaggattacaggtgtgagccaccacacccagtccaaaaagtgattttctaattccatagtttcttctacatttcttaactggaattttgtaaggaagagttatccttattcatttatttacccatttacttgtaggagcatgtatcataaattcttaatctatggggtgtagttagctactgtaaatttgatgcacatatttttccagattcaataagtaggatccccatcaagctatcttctgaatctttaaaaatgtattctccttatttcatgggtatataattattttctgggcaacagtttgttcatggtacatttgtctccagccctagactcagaaaaatgtaatttattttaatggagaatactatttagaagctgcagtctctgtgtagggaggtgttcctaggtaatagtgccctggcttttaggtcttctctatggaggatatggcaaagacatacaaaattatatatacgtatccacacattaataactctatttctatattaaaaacatgaccacaagccaacacttttaattccactgcagcactgctgggttatttcttgctttccaaattcccttgtctgtagctatctttcatcacttgcaaaaatagcacgtgctcaatcctagattaaaatataagctactctcagaattgataactcataccactctttttaaaaatcaactaaccagaattcagtttttattcacagttcttatctttagctcagggcgtaatataaaagcactaggtttaaaacttacttggtcagcagcaatccacttctaggtacatgtccaaaggaactgaagaaagcatctcaatgtgtgaatgcctacctgtgttcattgcagcattattcagaagagccaagaggtggaagcaaagtaaatgtccattgacagatgaattggtaaacaaaatgcattatatacatacaatgcaatatcatttagccttaaaaacaaaattctgccatatgctacaacatggacgttatgctaagtgaaataaaccagttccgaaaggacaaatacacccatttccacttatatggggtatctaacgtcaaactcagaagaacaaagtactgcggtatttgccacaagctggtggaggagaaaatgagttgttcaatgggtattgagtgtcagccacgcaagatggaaaagctttttgagatttgttgtataaaaatatgcctatagttaacaatactcttcggtacacacaaagtatgtgaaagggtaaattttatgtgtttttatcacaataaaaattgtaataaaagaagttacttgggtcaattttgtgctttttacccccctcttcattgttgaatttttatccatttgatacaaagttcatttcagtaattcctgttaattttccattttgtgtcacaccttgctccaggccatctgcatatatacgtgcaggtcacacgggttatgatggcttagcttgggcttggaggcctgacattccagtcttcttatattaatcagaaaaacaaaatagtggtgaagtgttggggggcaatgaaaattttggggggagctatggagagataatgggcaatgtttctcaaggctgcttcaagtgggatgaggggcaacatgggaacctagagtgggagagattaaactgaagaaagattttgagaaaaggggtgatattgtggggttgttaaaaggagtatttgttgtatagaatgattggtgatggcctggatgtggttttgtatgaattgagaaactaaacggaagacacaaggtctgaataagagaaggagaaaaacaagtattagaggact

SEQ ID NO: 462942 - DNA, 1901 bp, Homo sapiens
ttttttttgagacatggtctcccttttgcccaggctggagtgtagtacagttatagcccattgcagcctcaaacttacgggtgtgagccaccacacccagtccaaaaagtgattttctaattccatagtttcttctacatttcttaactggaattttgtaaggaagagttatccttattcatttatttacccatttacttgtaggagcatgtatcataaattcttaatctatggggtgtagttagctactgtaaatttgatgcacatatttttccagattcaataagtaggatccccatcaagctatcttctgaatctttaaaaatgtattctccttatttcatgggtatataattattttctgggcaacagtttgttcatggtacatttgtctccagccctagactcagaaaaatgtaatttattttaatggagaatactatttagaagctgcagtctctgtgtagggaggtgttcctaggtaatagtgccctggcttttaggtcttctctatggaggatatggcaaagacatacaaaattatatatacgtatccacacattaataactctatttctatattaaaaacatgaccacaagccaacacttttaattccactgcagcactgctgggttatttcttgctttccaaattcccttgtctgtagctatctttcatcacttgcaaaaatagcacgtgctcaatcctagattaaaatataagctactctcagaattgataactcataccactctttttaaaaatcaactaaccagaattcagtttttattcacagttcttatctttagctcagggcgtaatataaaagcactaggtttaaaacttacttggtcagcagcaatccacttctaggtacatgtccaaaggaactgaagaaagcatctcaatgtgtgaatgcctacctgtgttcattgcagcattattcagaagagccaagaggtggaagcaaagtaaatgtccattgacagatgaattggtaaacaaaatgcattatatacatacaatgcaatatcatttagccttaaaaacaaaattctgccatatgctacaacatggacgttatgctaagtgaaataaaccagttccgaaaggacaaatacacccatttccacttatatggggtatctaacgtcaaactcagaagaacaaagtactgcggtatttgccacaagctggtggaggagaaaatgagttgttcaatgggtattgagtgtcagccacgcaagatggaaaagctttttgagatttgttgtataaaaatatgcctatagttaacaatactcttcggtacacacaaagtatgtgaaagggtaaattttatgtgtttttatcacaataaaaattgtaataaaagaagttacttgggtcaattttgtgctttttacccccctcttcattgttgaatttttatccatttgatacaaagttcatttcagtaattcctgttaattttccattttgtgtcacaccttgctccaggccatctgcatatatacgtgcaggtcacacgggttatgatggcttagcttgggcttggaggcctgacattccagtcttcttatattaatcagaaaaacaaaatagtggtgaagtgttggggggcaatgaaaattttggggggagctatggagagataatgggcaatgtttctcaaggctgcttcaagtgggatgaggggcaacatgggaacctagagtgggagagattaaactgaagaaagattttgagaaaaggggtgatattgtggggttgttaaaaggagtatttgttgtatagaatgattggtgatggcctggatgtggttttgtatgaattgagaaactaaacggaagacacaaggtctgaataagagaaggagaaaaacaagtattagaggact

SEQ ID NO: 462943 - DNA, 1557 bp, Homo sapiens
tggtctgcattggggtcttgctctgttgcctagggtgtggagtgcggtggcatgatcatgcctcactatagccttgacctcctgggctcaagcgatcctcccacctgagtctcctgagtacctgggaccacaggcacatgctaacgcacccagttaatttttttattcgtagagccgaggtctcactatgttgcccagactggtctcaagctcttgggctcaagcagtcctcctgcctcagcctcccaaagtgccaggattacaggtgtgagccaccacacccagtccaaaaagtgattttctaattccatagtttcttctacatttcttaactggaattttgtaaggaagagttatccttattcatttatttacccatttacttgtaggagcatgtatcataaattcttaatctatggggtgtagttagctactgtaaatttgatgcacatatttttccagattcaataagtaggatccccatcaagctatcttctgaatctttaaaaatgtattctccttatttcatgggtatataattattttctgggcaacagtttgttcatggtacatttgtctccagccctagactcagaaaaatgtaatttattttaatggagaatactatttagaagctgcagtctctgtgtagggaggtgttcctaggtaatagtgccctggcttttaggtcttctctatggaggatatggcaaagacatacaaaattatatatacgtatccacacattaataactctatttctatattaaaaacatgaccacaagccaacacttttaattccactgcagcactgctgggttatttcttgctttccaaattcccttgtctgtagctatctttcatcacttgcaaaaatagcacgtgctcaatcctagattaaaatataagctactctcagaattgataactcataccactctttttaaaaatcaactaaccagaattcagtttttattcacagttcttatctttagctcagggcgtaatataaaagcactaggtttaaaacttacttggtcagcagcaatccacttctaggtacatgtccaaaggaactgaagaaagcatctcaatgtgtgaatgcctacctgtgttcattgcagcattattcagaagagccaagaggtggaagcaaagtaaatgtccattgacagatgaattggtaaacaaaatgcattatatacatacaatgcaatatcatttagccttaaaaacaaaattctgccatatgctacaacatggacgttatgctaagtgaaataaaccagttccgaaaggacaaatacacccatttccacttatatggggtatctaacgtcaaactcagaagaacaaagtactgcggtatttgccacaagctggtggaggagaaaatgagttgttcaatgggtattgagtgtcagccacgcaagatggaaaagctttttgagatttgttgtataaaaatatgcctatagttaacaatactcttcggtacacacaaagtatgtgaaagggtaaattttatgtgtttttatcacaataaaaattgtaata

SEQ ID NO: 462944 - DNA, 2047 bp, Homo sapiens
tggtctgcattggggtcttgctctgttgcctagggtgtggagtgcggtggcatgatcatgcctcactatagccttgacctcctgggctcaagcgatcctcccacctgagtctcctgagtacctgggaccacaggcacatgctaacgcacccagttaatttttttattcgtagagccgaggtctcactatgttgcccagactggtctcaagctcttgggctcaagcagtcctcctgcctcagcctcccaaagtgccaggattacaggtgtgagccaccacacccagtccaaaaagtgattttctaattccatagtttcttctacatttcttaactggaattttgtaaggaagagttatccttattcatttatttacccatttacttgtaggagcatgtatcataaattcttaatctatggggtgtagttagctactgtaaatttgatgcacatatttttccagattcaataagtaggatccccatcaagctatcttctgaatctttaaaaatgtattctccttatttcatgggtatataattattttctgggcaacagtttgttcatggtacatttgtctccagccctagactcagaaaaatgtaatttattttaatggagaatactatttagaagctgcagtctctgtgtagggaggtgttcctaggtaatagtgccctggcttttaggtcttctctatggaggatatggcaaagacatacaaaattatatatacgtatccacacattaataactctatttctatattaaaaacatgaccacaagccaacacttttaattccactgcagcactgctgggttatttcttgctttccaaattcccttgtctgtagctatctttcatcacttgcaaaaatagcacgtgctcaatcctagattaaaatataagctactctcagaattgataactcataccactctttttaaaaatcaactaaccagaattcagtttttattcacagttcttatctttagctcagggcgtaatataaaagcactaggtttaaaacttacttggtcagcagcaatccacttctaggtacatgtccaaaggaactgaagaaagcatctcaatgtgtgaatgcctacctgtgttcattgcagcattattcagaagagccaagaggtggaagcaaagtaaatgtccattgacagatgaattggtaaacaaaatgcattatatacatacaatgcaatatcatttagccttaaaaacaaaattctgccatattccgaaaggacaaatacacccatttccacttatatggggtatctaacgtcaaactcagaagaacaaagtactgcggtatttgccacaagctggtggaggagaaaatgagttgttcaatgggtattgagtgtcagccacgcaagatggaaaagctttttgagatttgttgtataaaaatatgcctatagttaacaatactcttcggtacacacaaagtatgtgaaagggtaaattttatgtgtttttatcacaataaaaattgtaataaaagaagttacttgggtcaattttgtgctttttacccccctcttcattgttgaatttttatccatttgatacaaagttcatttcagtaattcctgttaattttccattttgtgtcacaccttgctccaggccatctgcatatatacgtgcaggtcacacgggttatgatggcttagcttgggcttggaggcctgacattccagtcttcttatattaatcagaaaaacaaaatagtggtgaagtgttggggggcaatgaaaattttggggggagctatggagagataatgggcaatgtttctcaaggctgcttcaagtgggatgaggggcaacatgggaacctagagtgggagagattaaactgaagaaagattttgagaaaaggggtgatattgtggggttgttaaaaggagtatttgttgtatagaatgattggtgatggcctggatgtggttttgtatgaattgagaaactaaacggaagacacaaggtctgaataagagaaggagaaaaacaagtattagaggact

SEQ ID NO: 462945 - DNA, 3786 bp, Homo sapiens
cgccatcttttccggcgctggctccgcatggtcagtgccatttcgcctttatcgtggtggagtccaccctggctgtggggctgtcggtcctccttgcgcggccagtggctagaggccgcaggctcagtgggtcccagtcaggagccaggtcgggaagtgtgtttgtcccgactccgcgcgttttctggagtggtttcatccgctgtgctcccttcttcaaaagcttggaaagcaacctttgacctattcaaactcagtctgtctcttgactggaggaggagaaggaaaagttgagcacattgccaaccggagttccccaagaatggcaagttaaaaccaaagtgtcagcacctcaacaacatttttttttggcttaacaaaacatcaaacggcatacaaatgatgggactgtctagttgcaggaaaacaagctcaggcctcctgctgatcctattttatggcagaaatccacaatggaggggaactctgtgactttatggaaaatggagaaatcttcagtgaacactcatgccttaatgcacacatgggaactgaaaatacaggggacacttatgactgtgatgagtatggagaaaactttcccatgttacacaacagtgcccctgctggagagacactttctgtgttgaatcagtgcagaaaagccttcagcctgccaccaaatgttcaccagagaacgtggataggagacaaatcctttgaatacagtgactgtgaggaagcctttgttgatcagtcacatcttcaggcaaataggataactcacaatggagaaacactctatgaacagaagcaatgtgggagagcttttacttactccacaagccatgctgtgtctgttaaaatgcatactgtagaaaaaccctacgaatgtaaggaatgtggaaaattctttagatattcttcatatcttaatagtcacatgcgaacccatactggggagaaaccctatgaatgtaaggaatgtgggaaatgcttcactgtttcttcacacctagttgaacatgtaagaattcatactggagagaaaccttatcaatgtaaggaatgtggaagagccttcgctgggcgctcaggccttactaaacatgtacgaatacacactggagagaagccctatgaatgtaacgaatgtgggaaagcctacaataggttttatctactaactgaacattttaaaactcacacagaggagaagccctttgaatgtaaggtatgtggaaaatccttcagaagctcttcatgccttaagaatcactttagaattcacactggaataaaaccctataaatgtaaggagtgtgggaaagcattcaagcttacataatcatgtaaaaatccatactggagagaagccctatgaatgtaaggactgtgggaaagcctttgctacatcttcacaactcattgaacatataagaactcacactggagagaaaccgtatatatgtaaggaatgtgggaaaaccttccgtgcttcttcacatctacagaaacatgttagaattcacactggagagaaaccctatatatgtaacgaataagaagcattattagtggcagctatagccttatgaaatgtatttcttaaataataagacttgaaagtcagaattattccagaatccatgggctgcggttagcagacatgaaaacgccaatcttgtttatacctccataagagctcttggttagtaggttcattatcagtggtaatattttgaaaggaatctctgaacagtatgttttacagtgggcttaaaatattcagtaaaccatgctgtaaatagatgtaaatagataccacaggaagagtagatgtagcataattcttaactggctcttggatttttggaatggactttactgtttacccggctgatcttgaacttaaaacctcaagtgatgctcccctatctgcctcccaacactctgggattacaggtgtgagccaccacacccagtccaaaaagtgattttctaattccatagtttcttctacatttcttaactggaattttgtaaggaagagttatccttattcatttatttacccatttacttgtaggagcatgtatcataaattcttaatctatggggtgtagttagctactgtaaatttgatgcacatatttttccagattcaataagtaggatccccatcaagctatcttctgaatctttaaaaatgtattctccttatttcatgggtatataattattttctgggcaacagtttgttcatggtacatttgtctccagccctagactcagaaaaatgtaatttattttaatggagaatactatttagaagctgcagtctctgtgtagggaggtgttcctaggtaatagtgccctggcttttaggtcttctctatggaggatatggcaaagacatacaaaattatatatacgtatccacacattaataactctatttctatattaaaaacatgaccacaagccaacacttttaattccactgcagcactgctgggttatttcttgctttccaaattcccttgtctgtagctatctttcatcacttgcaaaaatagcacgtgctcaatcctagattaaaatataagctactctcagaattgataactcataccactctttttaaaaatcaactaaccagaattcagtttttattcacagttcttatctttagctcagggcgtaatataaaagcactaggtttaaaacttacttggtcagcagcaatccacttctaggtacatgtccaaaggaactgaagaaagcatctcaatgtgtgaatgcctacctgtgttcattgcagcattattcagaagagccaagaggtggaagcaaagtaaatgtccattgacagatgaattggtaaacaaaatgcattatatacatacaatgcaatatcatttagccttaaaaacaaaattctgccatatgctacaacatggacgttatgctaagtgaaataaaccagttccgaaaggacaaatacacccatttccacttatatggggtatctaacgtcaaactcagaagaacaaagtactgcggtatttgccacaagctggtggaggagaaaatgagttgttcaatgggtattgagtgtcagccacgcaagatggaaaagctttttgagatttgttgtataaaaatatgcctatagttaacaatactcttcggtacacacaaagtatgtgaaagggtaaattttatgtgtttttatcacaataaaaattgtaataaaagaagttacttgggtcaattttgtgctttttacccccctcttcattgttgaatttttatccatttgatacaaagttcatttcagtaattcctgttaattttccattttgtgtcacaccttgctccaggccatctgcatatatacgtgcaggtcacacgggttatgatggcttagcttgggcttggaggcctgacattccagtcttcttatattaatcagaaaaacaaaatagtggtgaagtgttggggggcaatgaaaattttggggggagctatggagagataatgggcaatgtttctcaaggctgcttcaagtgggatgaggggcaacatgggaacctagagtgggagagattaaactgaagaaagattttgagaaaaggggtgatattgtggggttgttaaaaggagtatttgttgtatagaatgattggtgatggcctggatgtggttttgtatgaattgagaaactaaacggaagacacaaggtctgaataagagaaggagaaaaacaagtattagaggact

SEQ ID NO: 462946 - DNA, 2579 bp, Homo sapiens
cgccatcttttccggcgctggctccgcatggtcagtgccatttcgcctttatcgtggtggagtccaccctggctgtggggctgtcggtcctccttgcgcggccagtggctagaggccgcaggctcagtgggtcccagtcaggagccaggtcgggaagtgtgtttgtcccgactccgcgcgttttctggagtggtttcatccgctgtgctcccttcttcaaaagcttggaaagcaacctttgacctattcaaactcagtctgtctcttgactggaggaggagaaggaaaagttgagcacattgccaaccggagttccccaagaatggcaagttaaaaccaaagtgtcagcacctcaacaacatttttttttggcttaacaaaacatcaaacggcatacaaatgatgggactgtctagttgcaggaaaacaagctcaggcctcctgctgatcctattttatggcagaaatccacaatggaggggaactctgtgactttatggaaaatggagaaatcttcagtgaacactcatgccttaatgcacacatgggaactgaaaatacaggggacacttatgactgtgatgagtatggagaaaactttcccatgttacacaacagtgcccctgctggagagacactttctgtgttgaatcagtgcagaaaagccttcagcctgccaccaaatgttcaccagagaacgtggataggagacaaatcctttgaatacagtgactgtgaggaagcctttgttgatcagtcacatcttcaggcaaataggataactcacaatggagaaacactctatgaacagaagcaatgtgggagagcttttacttactccacaagccatgctgtgtctgttaaaatgcatactgtagaaaaaccctacgaatgtaaggaatgtggaaaattctttagatattcttcatatcttaatagtcacatgcgaacccatactggggagaaaccctatgaatgtaaggaatgtgggaaatgcttcactgtttcttcacacctagttgaacatgtaagaattcatactggagagaaaccttatcaatgtaaggaatgtggaagagccttcgctgggcgctcaggccttactaaacatgtacgaatacacactggagagaagccctatgaatgtaacgaatgtgggaaagcctacaataggttttatctactaactgaacattttaaaactcacacagaggagaagccctttgaatgtaaggtatgtggaaaatccttcagaagctcttcatgccttaagaatcactttagaattcacactggaataaaaccctataaatgtaaggagtgtgggaaagcattcaagcttacataatcatgtaaaaatccatactggagagaagccctatgaatgtaaggactgtgggaaagcctttgctacatcttcacaactcattgaacatataagaactcacactggagagaaaccgtatatatgtaaggaatgtgggaaaaccttccgtgcttcttcacatctacagaaacatgttagaattcacactggagagaaaccctatatatgtaacgaataagaagcattattagtggcagctatagccttatgaaatgtatttcttaaataataagacttgaaagtcagaattattccagaatccatgggctgcggttagcagacatgaaaacgccaatcttgtttatacctccataagagctcttggttagtaggttcattatcagtggtaatattttgaaaggaatctctgaacagtatgttttacagtgggcttaaaatattcagtaaaccatgctgtaaatagatgtaaatagataccacaggaagagtagatgtagcataattcttaactggctcttggatttttggaatggactttactgtttacccggctgatcttgaacttaaaacctcaagtgatgctcccctatctgcctcccaacactctgggattacaggtgtgagccactgcacctggctcttatcttggcttttgacatgactttctcactgaggttaatcatttccagcttttgatctaaagtgagaaatttgcaactccttctttcacttgaacagttagaggccattgtggggtaatgaattggcctaatttcaatattgtccctcagggaattaggaggcctgggaagaggaggagagaggggagagtggccagttggtggagcagtgagaacatagcatttgttaagtttgctgtcttcgaaggttgtggtttgtggtaccccaaaacaattaaaataggaacatcaaagatcacagagcagccgggcacggtggctcacacctgtaatcccagcaccttgagaggctgaggtgagtgaatcatgaggtcaggagttcgagaccagcctggccaccatggtgaaaccccgtctctactaaaaatacaaaaaattagccgggcatggtggcaggcacctatagtcccagctattcaggaggctgaggcaggagaatcacttgaatccaggaggtggaggttagagtgagctgagatcacaccactgcactccagcccaggtgacagagtgagattccttctcaaaaa

SEQ ID NO: 462947 - DNA, 3589 bp, Homo sapiens
caccacggcttccggtgtcatggctgcttgaagtcccgggagtcggtgaggcggctgcaggtccctccctgcggagccgctggtccggctggcggagatgtgaccgcgggcccggccggcctgcctcaggcgtcgcgtcagctcccgtgtccgtgcccttaacccacaccgatggcgggatccggctgcgcctggggcgcggagccgccgcgttttctggaggccttcgggcggctgtggcaggtacagagccgtctgggtagcggctcctccgcctcggtgtatcgggttcgctgctgcggcaaccctggctcgccccccggcgccctcaagcagttcttgccgccaggaaccaccggggctgcggcctctgccgccgagtatggtttccgcaaagagagggcggcgctggaacagttgcagggtcacagaaacatcgtgactttgtatggagtgtttacaatccacttttctccaaatgtgccatcacgctgtctgttgcttgaactcctggatgtcagtgtttcggaattgctcttatattccagtcaccagggttgttccatgtggatgatacagcattgtgcccgagatgttttggaggcccttgcttttcttcatcatgagggctatgtccatgcggacctcaaaccacgtaacatattgtggagtgcagagaatgaatgttttaaactcattgactttggacttagcttcaaagaaggcaatcaggatgtaaagtatattcagacagacgggtatcgggctccagaagcagaattgcaaaattgcttggcccaggctggcctgcagagtgatacagaatgtacctcagctgttgatctgtggagcctaggaatcattttactggaaatgttctcaggaatgaaactgaaacatacagtcagatctcaggaatggaaggcaaacagttctgctattattgatcacatatttgccagtaaagcagtggtgaatgccgcaattccagcctatcacctaagagaccttatcaaaagcatgcttcatgatgatccaagcagaagaattcctgctgaaatggcattgtgcagcccattctttagcattccttttgcccctcatattgaagatctggtcatgcttcccactccagtgctaagactgctgaatgtgctggatgatgattatcttgagaatgaagaggaatatgaagatgttgtagaagatgtaaaagaggagtgtcaaaaatatggaccagtggtatctctacttgttccaaaggaaaatcctggcagaggacaagtctttgttgagtatgcaaatgctggtgattccaaagctgcgcagaaattactgactggaaggatgtttgatgggaagtttgttgtggctacattctacccgctgagtgcctacaagaggggatatctgtatcaaaccttgctttaatcagtaacctaaggactgtttcctttttctcctcttccatttcttgggttattccacatatgaatgcaggactacccccttaccattttaagaaggtactttatacatttatttaatcctactaatgtgcagccattgcccaagcagtgactgcgttgcatacatttggcactgagtaggacaagacctctcagctatacattgaggggttttagagcatccatgtgggcaacccttttttgtgcgggagagcaggtgttgctcttcagtatgtagcctaaaaaaatcttaattatttcatggatcatgaagcaaggatgaataatatcatgtcttggtaaatactaacaaatttgttaggtttggtgacatcatttacagattatttctttatgttgtccagtggttcttccttattgttgatatccataagctggcactggatgctctcagtaatgttaagtaattgtcaagcagcagttacctactgtgttcttaacactgagttgtgaattttttcttaaagcagtactgtagtactgaatattcctttaaaggaactgcagtgagcctatctaagtttttttaaattaaggcttttaaaatagaaagctgatgcttgatcttgcacaatttttatgtctagtatgtatgcttgagtgaatgtgcgagtatgaatgattagagaaaatttgagtcagtgtactttatagtgtgaatcctgtgagctaatacagtctatacttatttcttccctacctgtttcacatccgtaagatttaagatatacattttttgagaggtagtctgtctgatacaatgtaaatgacaaaacataattcctgagaggcccagaacaaactggagtctagcctggagttaaattgagacttctaaaatgattggaacaaagactaagttgtgccagatgtaaatcaacccctcttttagtttactttagactttgtattagctcatcttttttgtagtaaatctatagttttaaggtttctcaagatgtggctctacctactatgatgaaaattgaagtgggtcaaaagaattagatgtacagtgaagggaaaagaaaaaaaatgggcgaagagagggtggaaaataaaaggattcttttttcttcctttctgtttctcgtatccctgctccctttttcctccccttccctcattctttgcctctatccttagctgaagacaaactagaggagcagcatcccaggtagtttggcttttgactgcaaggtagttaagaaaggtgtagatataatgaggtagaagtagaaaggaagaaaaactcaaagaattcttaaaaggattcatagcaacataatgtgtccctgagtagaggatgctgctatgcgtgagttcatggacacaagttgattacatggtttttagaattataattatggattcttcttatttcatggtaggttgtctttaaagatataaaaattaggatgcctttatgaagcactgattataccaaaaaaaaaagacaagttatatacaggttattaatttttttatttatttattttttcctaaggaaaaagtcttctatctttccctgctggaagcctcctcatatttccttatgtttgccatgcaggttgctgagagtccagttagaatttgcattttacagaatgaaatactttaccccattcaaacaattattgtttgacattttagttatttataattgtcaaattcaggactctcctttaatgtttattatgaaaccaaatttggcataaggaggctgatttatgaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcagctcttaaaagaccatgtatataaaaagtatttc

SEQ ID NO: 462948 - DNA, 3253 bp, Homo sapiens
agcgggtcgtgcagatgaagcctccaggtaccaggcttccaagaaaatagattgtaaatgtttcttaccagaccgaaggtctgtgttgaccttaaccggagagtgactttgtatggagtgtttacaatccacttttctccaaatgtgccatcacgctgtctgttgcttgaactcctggatgtcagtgtttcggaattgctcttatattccagtcaccagggttgttccatgtggatgatacagcattgtgcccgagatgttttggaggcccttgcttttcttcatcatgagggctatgtccatgcggacctcaaaccacgtaacatattgtggagtgcagagaatgaatgttttaaactcattgactttggacttagcttcaaagaaggcaatcaggatgtaaagtatattcagacagacgggtatcgggctccagaagcagaattgcaaaattgcttggcccaggctggcctgcagagtgatacagaatgtacctcagctgttgatctgtggagcctaggaatcattttactggaaatgttctcaggaatgaaactgaaacatacagtcagatctcaggaatggaaggcaaacagttctgctattattgatcacatatttgccagtaaagcagtggtgaatgccgcaattccagcctatcacctaagagaccttatcaaaagcatgcttcatgatgatccaagcagaagaattcctgctgaaatggcattgtgcagcccattctttagcattccttttgcccctcatattgaagatctggtcatgcttcccactccagtgctaagactgctgaatgtgctggatgatgattatcttgagaatgaagaggaatatgaagatgttgtagaagatgtaaaagaggagtgtcaaaaatatggaccagtggtatctctacttgttccaaaggaaaatcctggcagaggacaagtctttgttgagtatgcaaatgctggtgattccaaagctgcgcagaaattactgactggaaggatgtttgatgggaagtttgttgtggctacattctacccgctgagtgcctacaagaggggatatctgtatcaaaccttgctttaatcagtaacctaaggactgtttcctttttctcctcttccatttcttgggttattccacatatgaatgcaggactacccccttaccattttaagaaggtactttatacatttatttaatcctactaatgtgcagccattgcccaagcagtgactgcgttgcatacatttggcactgagtaggacaagacctctcagctatacattgaggggttttagagcatccatgtgggcaacccttttttgtgcgggagagcaggtgttgctcttcagtatgtagcctaaaaaaatcttaattatttcatggatcatgaagcaaggatgaataatatcatgtcttggtaaatactaacaaatttgttaggtttggtgacatcatttacagattatttctttatgttgtccagtggttcttccttattgttgatatccataagctggcactggatgctctcagtaatgttaagtaattgtcaagcagcagttacctactgtgttcttaacactgagttgtgaattttttcttaaagcagtactgtagtactgaatattcctttaaaggaactgcagtgagcctatctaagtttttttaaattaaggcttttaaaatagaaagctgatgcttgatcttgcacaatttttatgtctagtatgtatgcttgagtgaatgtgcgagtatgaatgattagagaaaatttgagtcagtgtactttatagtgtgaatcctgtgagctaatacagtctatacttatttcttccctacctgtttcacatccgtaagatttaagatatacattttttgagaggtagtctgtctgatacaatgtaaatgacaaaacataattcctgagaggcccagaacaaactggagtctagcctggagttaaattgagacttctaaaatgattggaacaaagactaagttgtgccagatgtaaatcaacccctcttttagtttactttagactttgtattagctcatcttttttgtagtaaatctatagttttaaggtttctcaagatgtggctctacctactatgatgaaaattgaagtgggtcaaaagaattagatgtacagtgaagggaaaagaaaaaaaatgggcgaagagagggtggaaaataaaaggattcttttttcttcctttctgtttctcgtatccctgctccctttttcctccccttccctcattctttgcctctatccttagctgaagacaaactagaggagcagcatcccaggtagtttggcttttgactgcaaggtagttaagaaaggtgtagatataatgaggtagaagtagaaaggaagaaaaactcaaagaattcttaaaaggattcatagcaacataatgtgtccctgagtagaggatgctgctatgcgtgagttcatggacacaagttgattacatggtttttagaattataattatggattcttcttatttcatggtaggttgtctttaaagatataaaaattaggatgcctttatgaagcactgattataccaaaaaaaaaagacaagttatatacaggttattaatttttttatttatttattttttcctaaggaaaaagtcttctatctttccctgctggaagcctcctcatatttccttatgtttgccatgcaggttgctgagagtccagttagaatttgcattttacagaatgaaatactttaccccattcaaacaattattgtttgacattttagttatttataattgtcaaattcaggactctcctttaatgtttattatgaaaccaaatttggcataaggaggctgatttatgaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcagctcttaaaagaccatgtatataaaaagtatttc

SEQ ID NO: 462949 - DNA, 689 bp, Homo sapiens
cctctgtgggcctgcacgcactctccaaccagtgctgatgagatgaaccaggttccctggtgctgcatcatctctgacctctcctttattcccagtggctcccatgcatccaaggtatgccagttgggcgtcaagttagagagagagagagagcttcagaaaaaacttacattgaagagaggattccttgttttgactacgtgtgtttctgctgtcttaggcagccaacatattggtttacatggatctggaggattatgcacactagtgttgagtttcattgcagggacaaaatggtcccaagaaaagatgaaagtccgaaagattattacaaatgtatgggatatttttcaaccacttctttttggtttagttggagcagaagtatctgtttcactgcttgaatcaaatattgttggtaagaataattagagcacaaaaaatatgaaattcaaaaatatttaagaaaattataaatacatttatttttatttacaatatatctttgaatggctacaaggaccttcttcagaaacacatgttgatacactgtcatattttcctattgctcttcctttacactgtgtgctctttttttttaaaccaaggacagccctgaatatcttccctgagttttctaaggaaataaatataagatttctttcctgagggaacatatttgatatgat

SEQ ID NO: 462950 - DNA, 590 bp, Homo sapiens
  misc_feature (11)..(13): n is a, c, g, or t
  misc_feature (17)..(17): n is a, c, g, or t
  misc_feature (21)..(21): n is a, c, g, or t
  misc_feature (53)..(54): n is a, c, g, or t
aaaaagaaaannngccnaacncccccacaggaaaaaggaattaaaaaaaacannaaccctaaaaaacttacattgaagagaggattccttgttttgactacgtgtgtttctgctgtcttaggcagccaacatattggtttacatggatctggaggattatgcacactagtgttgagtttcattgcagggacaaaatggtcccaagaaaagatgaaagtccgaaagattattacaaatgtatgggatatttttcaaccacttctttttggtttagttggagcagaagtatctgtttcactgcttgaatcaaatattgttggtaagaataattagagcacaaaaaatatgaaattcaaaaatatttaagaaaattataaatacatttatttttatttacaatatatctttgaatggctacaaggaccttcttcagaaacacatgttgatacactgtcatattttcctattgctcttcctttacactgtgtgctctttttttttaaaccaaggacagccctgaatatcttccctgagttttctaaggaaataaatataagatttctttcctgagggaacatatttgatatgat

SEQ ID NO: 462951 - DNA, 5864 bp, Homo sapiens
atttgctcttttggtgaacaaggttcacatttattgccaaaagatgtctactctcctggaaaacatctttgccataattaatcttttcaagcaatattcaaaaaaagataaaaacactgacacattgagtaaaaaagagctgaaggaacttctggaaaaggaatttcggcaaatcctgaagaatccagatgacccagatatggttgatgtcttcatggatcacttggatatagaccacaacaagaaaattgacttcactgagtttcttctgatggtattcaagttggctcaagcatattatgagtctaccagaaaagagaatttaccgatatcaggacacaagcacagaaagcacagtcatcatgataaacatgaagataataaacaggaagaaaacaaagaaaacagaaaaagaccctcaagtctggaaagaagaaacaatagaaaagggaataagggaagatccaagagcccaagagaaacaggggggaaaaggcatgaatctagttctgaaaaaaaagaaagaaaaggatattcacctactcatagagaagaagaatatggaaaaaaccatcataactcaagtaaaaaagagaaaaacaagactgaaaatactagattaggagacaataggaagaggctaagtgaaagacttgaagagaaagaagacaatgaagaaggagtatatgattatgaaaatacaggaagaatgactcaaaaatggatacaatcaggccatattgccacatattacacaatccaggatgaagcctatgacaccactgatagtctattagaagaaaacaaaatatatgaaagatcaaggtcatctgatggcaaatcatcatctcaagtgaacaggtcaagacatgaaaatacaagccaggtaccattgcaggagtccaggacaagaaagcgtaggggatccagagttagccaggacagggacagtgagggacactcagaagactctgagaggcactctgggtcggcttccagaaaccatcatggatctgcgtgggagcagtcaagagatggctccagacaccccaggtcccatgatgaagacagagccagtcatgggcactctgcagacagctccagacaatcaggcactcgtcacgcagagacttcctctcgtggacagactgcatcatcccatgaacaggcaagatcaagtccaggagaaagacatggatccggccaccagcagtcagcagacagctccagacactcagccactgggcgcgggcaagcttcatctgcagtcagcgatcgtggacaccgggggtctagcggtagtcaggccagtgacagtgagggacattcagaaaactcagacacacaatcagtgtcaggccacggaaaggctgggctgagacagcagagccaccaagagtccacacgtggccggtcaggggaacggtctggacgttcagggtcttccctctaccaggtgagcactcatgaacagcctgactctgcccatggacggaccgggaccagcactggaggaagacaaggatcgcaccacgagcaggcacgagacagctccaggcattcagcgtcccaagagggtcaggacaccattcgtggacacccggggtcaagcagaggaggaaggcagggatcccaccacgagcaatcggtaaataggtctggacactcaggttcccatcacagccacaccacatcccagggaaggtctgatgcctcccatgggcagtcaggatccagaagtgcaagcagacaaacacgaaatgaggaacaatcaggagacggcaccaggcactcagggtcacgtcatcatgaagcttcctctcaggctgacagctctagacactcacaggtgggccagggacaatcatcggggcccaggacaagtaggaaccagggatccagtgttagccaggacagtgacagtcagggacactcagaagactctgagaggtggtctgggtctgcttccagaaaccatcatggatctgctcaggagcagtcaagagatggctccagacaccccaggtcccatcacgaagacagagctggtcatgggcactctgcagacagctccagaaaatcaggcactcgtcacacacagaattcctctagtggacaggctgcgtcatcccatgaacaggcaagatcaagtgcaggagaaagacatggatcccgccaccagctccagtcagcagacagctccagacactcaggcactgggcacggacaagcttcatctgcagtcagagacagtggacaccgagggtccagtggtagtcaggccactgacagtgagggacattcagaagactcagacacacagtcagtgtcaggccatggacaggctggtcaccatcagcagagccaccaagagtccgcacgtgaccggtcaggggaaaggtctcgacgttcagggtctttcctctaccaggacaccattcgtggacacccggggtcaagcagaagaggaaggcaggggtcccaccacgagcaatcggtagataggtctggacactcagggtcccatcacagccacaccacatcccagggaaggtctgatgcctcccgtgggcagtcaggatccagaagtgcaagcagaacaacacgtaatgaggaacaatcaagagacggctccaggcactcagggtcacgtcaccatgaagcttcctctcatgccgacatctctagacactcacaggcaggccagggacaatcagaggggtccaggacaagcaggcgccagggatccagtgttagccaggacagtgacagtgagggacattcagaagactctgagaggtggtctgggtctgcttccagaaaccatcgtggatctgctcaggagcagtcaagacatggctccagacaccccaggtcccatcacgaagacagagccggtcacgggcactctgcagacagctccagacaatcaggaactcctcacgcagagacttcctctggtggacaggctgcgtcatcccatgaacaggcaagatcaagtccaggagaaagacacggatcccgccaccagcagtcagcagacagctccagacactcaggcattccgcgcagacaagcttcatctgcagtcagagacagtggacactgggggtccagtggtagtcaggccagtgatagtgagggacattcagaggagtcagacacacagtcagtgtcaggccatggacaggatgggccccatcagcagagccaccaagagtccgcacgtgactggtcagggggaaggtctggacgttcagggtctttcatctaccaggtgagcactcatgaacagtctgagtctgcccatgggcggaccaggaccagcactggacgaagacaaggatcccaccacgagcaggcacgagacagctccaggcactcagcgtcccaagagggtcaggacaccattcgtgcacacccggggtcaaggagaggaggaaggcagggatcccaccatgagcaatcggtagatagatctggacactcagggtcccatcacagccacaccacatcccagggaaggtctgatgcctcccatgggcagtcaggatccagaagtgcaagcagacaaactcgtaaggacaaacaatcaggagacggctccaggcactcagggtcacgtcaccatgaagctgcctcttgggctgacagctctagacactcacaggtgggacaggaacaatcatcggggtccaggacaagcaggcaccagggatccagtgttagccaggacagtgacagtgagagacactcagacgactccgagaggttgtctgggtctgcttccagaaaccatcatggatcttctcgggagcagtcaagagatggctccagacaccctgggttccatcaagaagacagagccagtcacgggcactctgcagacagctccagacaatcaggcactcatcacacagagtcttcctctcatggacaggctgtgtcatcccatgaacaggcaagatcaagtccaggagaaagacatggatcccgccaccagcagtcagcagacagctccagacactcaggcattgggcacagacaagcttcatctgcagtcagagacagtggacaccgagggtccagtggtagtcaggtcactaacagtgagggacattcagaagactcagacacacagtcagtgtcagcccacggacaagctgggccccatcagcagagccacaaagagtccgcacgtggccagtcaggggaaagctctggacgttcaaggtctttcctctaccaggtgagctctcatgaacagtctgagtccacacacggacagactgcacccagcactggaggaagacaaggatcccgccatgagcaggcacgaaacagctctaggcactcagcatcccaagacggtcaggacaccattcgtggacacccggggtcaagcagaggaggaaggcagggatcctaccacgagcaatcagtagataggtctggacactcagggtaccatcacagccacaccacaccccagggaaggtctgatgcctcccatgggcagtcaggacccagaagtgcaagcaggcaaacaagaaatgaggaacaatcaggagacggctccaggcactcagggtcacgtcaccatgaaccttccactcgggccggcagctctagacactcacaggtgggccagggagaatcagcggggtccaagacaagcaggcgccagggatccagtgttagtcaggacagggacagtgagggacactcagaagactctgagaggcggtctgagtcggcttccagaaaccattatggatctgctcgggagcagtcaagacatggctccaggaaccccaggtcccatcaagaagatagagccagtcatgggcactctgcagagagctccagacaatcaggcactcgtcatgcagagacttcctctggtggacaggctgcatcatcccaggaacaggcaaggtcaagtccaggagaaagacatggatcccgccaccagcagtcagcagacagctccacagactcaggcactgggcgcagacaagattcatctgtagtcggagacagtggaaaccgagggtccagtggtagccaggccagtgacagcgagggacactcagaagagtcagacacacagtcagtgtcagcccacggacaggctgggccccatcagcagagccaccaagagtccacacgtggccagtcaggggaaaggtctggacgttcagggtctttcctctaccaggtgagcactcatgaacagtctgagtccgcccatggacgcacagggcccagcactggaggaagacaaagatcccgccacgagcaggcacgagacagctccaggcactcagcgtcccaagagggtcaggacaccattcgtggacacccagggtcaagcagaggaggaaggcagggatcccactatgagcaatcggtagatagttctggacactcagggtctcatcacagccacaccacgtcccaggaaaggtctgatgtctcccgtgggcagtcaggatccagaagtgtcagcagacaaacacgtaatgagaaacaatcaggagacggctccaggcactcagggtcgcgtcaccatgaagcttcctctcgggccgacagctctagacactcgcaggtgggccagggacaatcatcagggcccaggacaagcaggaaccagggatccagtgttagccaggacagtgacagtcagggacactcagaagactctgagaggtggtctgggtctgcttccagaaaccatcttggatctgcttgggagcagtcaagagatggctccagacaccctgggtcccatcacgaagacagagccggctgcgtcatcccatgaacaggcaagatcaagtgcaggagaaagacatgga

SEQ ID NO: 462952 - DNA, 5595 bp, Homo sapiens
gcggccgcctactactactaaattcgcggccgcgtcgacccagaaaagagaatttaccgatatcaggacacaagcacagaaagcacagtcatcatgataaacatgaagataataaacaggaagaaaacaaagaaaacagaaaaagaccctcaagtctggaaagaagaaacaatagaaaagggaataagggaagatccaagagcccaagagaaacaggggggaaaaggcatgaatctagttctgaaaaaaaagaaagaaaaggatattcacctactcatagagaagaagaatatggaaaaaaccatcataactcaagtaaaaaagagaaaaacaagactgaaaatactagattaggagacaataggaagaggctaagtgaaagacttgaagagaaagaagacaatgaagaaggagtatatgattatgaaaatacaggaagaatgactcaaaaatggatacaatcaggccatattgccacatattacacaatccaggatgaagcctatgacaccactgatagtctattagaagaaaacaaaatatatgaaagatcaaggtcatctgatggcaaatcatcatctcaagtgaacaggtcaagacatgaaaatacaagccaggtaccattgcaggagtccaggacaagaaagcgtaggggatccagagttagccaggacagggacagtgagggacactcagaagactctgagaggcactctgggtcggcttccagaaaccatcatggatctgcgtgggagcagtcaagagatggctccagacaccccaggtcccatgatgaagacagagccagtcatgggcactctgcagacagctccagacaatcaggcactcgtcacgcagagacttcctctcgtggacagactgcatcatcccatgaacaggcaagatcaagtccaggagaaagacatggatccggccaccagcagtcagcagacagctccagacactcagccactgggcgcgggcaagcttcatctgcagtcagcgatcgtggacaccgggggtctagcggtagtcaggccagtgacagtgagggacattcagaaaactcagacacacaatcagtgtcaggccacggaaaggctgggctgagacagcagagccaccaagagtccacacgtggccggtcaggggaacggtctggacgttcagggtcttccctctaccaggtgagcactcatgaacagcctgactctgcccatggacggaccgggaccagcactggaggaagacaaggatcgcaccacgagcaggcacgagacagctccaggcattcagcgtcccaagagggtcaggacaccattcgtggacacccggggtcaagcagaggaggaaggcagggatcccaccacgagcaatcggtaaataggtctggacactcaggttcccatcacagccacaccacatcccagggaaggtctgatgcctcccatgggcagtcaggatccagaagtgcaagcagacaaacacgaaatgaggaacaatcaggagacggcaccaggcactcagggtcacgtcatcatgaagcttcctctcaggctgacagctctagacactcacaggtgggccagggacaatcatcggggcccaggacaagtaggaaccagggatccagtgttagccaggacagtgacagtcagggacactcagaagactctgagaggtggtctgggtctgcttccagaaaccatcatggatctgctcaggagcagtcaagagatggctccagacaccccaggtcccatcacgaagacagagctggtcatgggcactctgcagacagctccagaaaatcaggcactcgtcacacacagaattcctctagtggacaggctgcgtcatcccatgaacaggcaagatcaagtgcaggagaaagacatggatcccgccaccagctccagtcagcagacagctccagacactcaggcactgggcacggacaagcttcatctgcagtcagagacagtggacaccgagggtccagtggtagtcaggccactgacagtgagggacattcagaagactcagacacacagtcagtgtcaggccatggacaggctggtcaccatcagcagagccaccaagagtccgcacgtgaccggtcaggggaaaggtctcgacgttcagggtctttcctctaccaggacaccattcgtggacacccggggtcaagcagaagaggaaggcaggggtcccaccacgagcaatcggtagataggtctggacactcagggtcccatcacagccacaccacatcccagggaaggtctgatgcctcccgtgggcagtcaggatccagaagtgcaagcagaacaacacgtaatgaggaacaatcaagagacggctccaggcactcagggtcacgtcaccatgaagcttcctctcatgccgacatctctagacactcacaggcaggccagggacaatcagaggggtccaggacaagcaggcgccagggatccagtgttagccaggacagtgacagtgagggacattcagaagactctgagaggtggtctgggtctgcttccagaaaccatcgtggatctgctcaggagcagtcaagacatggctccagacaccccaggtcccatcacgaagacagagccggtcacgggcactctgcagacagctccagacaatcaggaactcctcacgcagagacttcctctggtggacaggctgcgtcatcccatgaacaggcaagatcaagtccaggagaaagacacggatcccgccaccagcagtcagcagacagctccagacactcaggcattccgcgcagacaagcttcatctgcagtcagagacagtggacactgggggtccagtggtagtcaggccagtgatagtgagggacattcagaggagtcagacacacagtcagtgtcaggccatggacaggatgggccccatcagcagagccaccaagagtccgcacgtgactggtcagggggaaggtctggacgttcagggtctttcatctaccaggtgagcactcatgaacagtctgagtctgcccatgggcggaccaggaccagcactggacgaagacaaggatcccaccacgagcaggcacgagacagctccaggcactcagcgtcccaagagggtcaggacaccattcgtgcacacccggggtcaaggagaggaggaaggcagggatcccaccatgagcaatcggtagatagatctggacactcagggtcccatcacagccacaccacatcccagggaaggtctgatgcctcccatgggcagtcaggatccagaagtgcaagcagacaaactcgtaaggacaaacaatcaggagacggctccaggcactcagggtcacgtcaccatgaagctgcctcttgggctgacagctctagacactcacaggtgggacaggaacaatcatcggggtccaggacaagcaggcaccagggatccagtgttagccaggacagtgacagtgagagacactcagacgactccgagaggttgtctgggtctgcttccagaaaccatcatggatcttctcgggagcagtcaagagatggctccagacaccctgggttccatcaagaagacagagccagtcacgggcactctgcagacagctccagacaatcaggcactcatcacacagagtcttcctctcatggacaggctgtgtcatcccatgaacaggcaagatcaagtccaggagaaagacatggatcccgccaccagcagtcagcagacagctccagacactcaggcattgggcacagacaagcttcatctgcagtcagagacagtggacaccgagggtccagtggtagtcaggtcactaacagtgagggacattcagaagactcagacacacagtcagtgtcagcccacggacaagctgggccccatcagcagagccacaaagagtccgcacgtggccagtcaggggaaagctctggacgttcaaggtctttcctctaccaggtgagctctcatgaacagtctgagtccacacacggacagactgcacccagcactggaggaagacaaggatcccgccatgagcaggcacgaaacagctctaggcactcagcatcccaagacggtcaggacaccattcgtggacacccggggtcaagcagaggaggaaggcagggatcctaccacgagcaatcagtagataggtctggacactcagggtaccatcacagccacaccacaccccagggaaggtctgatgcctcccatgggcagtcaggacccagaagtgcaagcaggcaaacaagaaatgaggaacaatcaggagacggctccaggcactcagggtcacgtcaccatgaaccttccactcgggccggcagctctagacactcacaggtgggccagggagaatcagcggggtccaagacaagcaggcgccagggatccagtgttagtcaggacagggacagtgagggacactcagaagactctgagaggcggtctgagtcggcttccagaaaccattatggatctgctcgggagcagtcaagacatggctccaggaaccccaggtcccatcaagaagatagagccagtcatgggcactctgcagagagctccagacaatcaggcactcgtcatgcagagacttcctctggtggacaggctgcatcatcccaggaacaggcaaggtcaagtccaggagaaagacatggatcccgccaccagcagtcagcagacagctccacagactcaggcactgggcgcagacaagattcatctgtagtcggagacagtggaaaccgagggtccagtggtagccaggccagtgacagcgagggacactcagaagagtcagacacacagtcagtgtcagcccacggacaggctgggccccatcagcagagccaccaagagtccacacgtggccagtcaggggaaaggtctggacgttcagggtctttcctctaccaggtgagcactcatgaacagtctgagtccgcccatggacgcacagggcccagcactggaggaagacaaagatcccgccacgagcaggcacgagacagctccaggcactcagcgtcccaagagggtcaggacaccattcgtggacacccagggtcaagcagaggaggaaggcagggatcccactatgagcaatcggtagatagttctggacactcagggtctcatcacagccacaccacgtcccaggaaaggtctgatgtctcccgtgggcagtcaggatccagaagtgtcagcagacaaacacgtaatgagaaacaatcaggagacggctccaggcactcagggtcgcgtcaccatgaagcttcctctcgggccgacagctctagacactcgcaggtgggccagggacaatcatcagggcccaggacaagcaggaaccagggatccagtgttagccaggacagtgacagtcagggacactcagaagactctgagaggtggtctgggtctgcttccagaaaccatcttggatctgcttgggagcagtcaagagatggctccagacaccctgggtcccatcacgaagacagagccggctgcgtcatcccatgaacaggcaagatcaagtgcaggagaaagacatgga

SEQ ID NO: 462953 - DNA, 1376 bp, Homo sapiens
gtggtttagaagaagattgtttttctggattcagctccaacaaagtttgtcctgcaggtcttggtgctgtgccatggtccttctcgccaataatattcagcctggataccccgctggtcataatggctacactaggagccagcccagggctctcctggagcacaggacacctgttcagtgcagaggactcagtggagtctcgctctgtcacccaggctggagtgcagtggtgccatcttggctcactgcaacctctgcctcccacacgccaccatgcctgggtaatttttgtatttttagtagagacagagtttcaccatgttggcgaggatggtctcaatctcctgacttcatgatctacctgcctcggcctcccaaaagtgctgcgattataggcatgagccactctgcacagcctagacttcaagcttttagaatagcgtctctctctctctctctctctctctctctctctctccctctttctctgtctccctcccattgtataaccaatgtctttgtataaaaccaacttagttctgtgagaagagttgtacgtttttaatatttttgttctttttgtagactgcaggaacaaaaatagccttcctatagtaaggtggcaattcacattaagaatgtagataagcaaatttaaacttttaaatgtaatttgtctaaaaaaattgaaaaacagtgtatagtaaaaatctctcttccaaccaacggaaagtacttttatgtaagatcctttaagttactgacttgaatctttacgtaaggtaacatgtctttttatacacctgctattaataatgtttccttgattttgaacaatttgattatgttatcccttagtgtaattttcttcatgtttcttgtgcttggggtttgctgagtttcttggatcctttctaatctgccttagttcatccaatgtaattttcatctcaaatgtttttgtctttgaaagtttgattttggcttttcttgtttatctcccatgtctctatttaatgttttgattatatgagatacatgtataaaaacagttttaatgtcctcctctgctaattttaacatctatttaagttctgggtcagttttgattgattattttcagtttgcatcatgattgtctgctgctttttatgcctggtaatccttatttagttgtaaaatttaccgacaaaagcaaagtgacaaaaggagataggaaatatcatgaaaacaatttctctaaaaaaaaaaaaacttatgatgcctaatcccctgaataaagacatttaagcctttcttgcttcatatttagacaaaaatcttcctgcttatgttcctatttcatctctgaaaacagtgtaagcaaccagttgtcc

SEQ ID NO: 462954 - DNA, 853 bp, Homo sapiens
gtggtttagaagaagattgtttttctggattcagctccaacaaagtttgtcctgcaggtcttggtgctgtgccatggtccttctcgccaataatattcagcctggataccccgctggtcataatggctacactaggagccagcccagggctctcctggagcacaggacacctgttcagtgcagaggactcagtggagtctcgctctgtcacccaggctggagtgcagtggtgccatcttggctcactgcaacctctgcctcccacacgccaccatgcctgggtaatttttgtatttttagtagagacagagtttcaccatgttggcgaggatggtctcaatctcctgacttcatgatctacctgcctcggcctcccaaaagtgctgcgattataggcatgagccactctgcacagcctagacttcaagcttttagaatagcgtctctctctctctctctctctctctctctctctttctctgtatgggcctcattccttctactacaaataaggaaaatgaccacctggaaacccaaggcccaccacatcccagcggagccacccccgctgaaagaaacccagcttctccctcaagcatctacacatccatcccggcccgaactccatctgacccttgtgagacatgcttccacacctcggtggaccactgaggctcgggaattcagcataatgatgggcacttctggggtcatgggccttccctgtagctaaggtgacaaaaggacagactggtctggaatgtccatgccagcctggcattacactgcccagcccttgatcatggctgttttctggagctagcttgtgttctatgacctgaaatatcagggg

SEQ ID NO: 462955 - DNA, 1711 bp, Homo sapiens
accagttacctggccccacccatcaccgctctcttcctgctggccatcttctgcaagagggtcacagagcccggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcctcacacgcctcacatggtggactcggaactgccccctctctgagctggagaaggaggcccacgagagcacaccggagatatccgagaggccagccggggagtgccctgcaggaggtggagcggcagagaactcgagcctgggccaggagcagcctgaagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtagacagattaaacaaagcccaagcctgtcagccacagaaacaggctctcctcttactttgctgtctaaactggagatcacagaagtcaagactgcaagctcccctgaagagaatccaactcaacctgcacacttgacaagtggagaaacagaagcccagagagagcactgggtttgttcaggaccacccagaaggtgtcacacggggtttccccactctttctgatatattgccttacagacctacctcaaacacactgtttccaccctcttcttgaatgtattcagtagcctttactgaatgtgtgtcttgagagtagaaaaatggaggatacaagaaaaggagcaggaagaaatttgcaaaaatccaagagcacctttgctcccccttatcctccttcctcttcccctttctagttcccctacctctctatctttctattctcaccaataatctctttgttgcatgaatttacccaggagagtcctatatttccattggtggctccacagtggtggctgtcagacccgaaggggtggggagccaagggtggactttaagcatggtgacagatggtattttgggcagaaagctcttagacaatggactatccaaagcactatttaaattctgcctcttcctactctctaacccaaatatgcacaaactctctatggccttgagaagcagttggagagacatgacttgttaaaacctcaaggaatcaagacatgttactctgtatttaagggtaagccccacagcgggcagcacaaacagcctgggagccactgtgcctgtgcttctctgtccttctccctttgcttgccatgaatccgcataccttggaatacactgtgaccccagttaagtgtcccttcgccaggaagctgccgcaacgtccagacctgggtcaagttcccactcctgctcccatagccttgacctgcttctgtcacagcactgatcacactgagatggaagactccagggggcaaggaccaagggccatatcccaagtgactttgtacccagaaaataacagctgttcaataaatgtgtattgagttaattagttc

SEQ ID NO: 462956 - DNA, 1166 bp, Homo sapiens
accagttacctggccccacccatcaccgctctcttcctgctggccatcttctgcaagagggtcacagagcccggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcctcacacgcctcacatggtggactcggaactgccccctctctgagctggagaaggaggcccacgagagcacaccggagatatccgagaggccagccggggagtgccctgcaggaggtggagcggcagagaactcgagcctgggccaggagcagcctgaagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtagacagattaaacaaagcccaagcctgtcagccacagaaacaggctctcctcttactttgctgtctaaactggagatcacagaagtcaagactgcaagctcccctgaagagaatccaactcaacctgcacacttgacaagtggagaaacagaagcccagagagagcactgggtttgttcaggaccacccagaaggtgtcacacggggtttccccactctttctgatatattgccttacagacctacctcaaacacactgtttccaccctcttcttgaatgtattcagtagcctttactgaatgtgtgtcttgagagtagaaaaatggaggatacaagaaaaggagcaggaagaaatttgcaaaaatccaagagcacctttgctcccccttatcctccttcctcttcccctttctagttcccctacctctctatctttctattctcaccaataatctctttgttgcatgaatttacccaggagagtcctatatttccattggtgggaatagaaagatttttaggggggaaacggg

SEQ ID NO: 462957 - DNA, 1658 bp, Homo sapiens
accagttacctggccccacccatcaccgctctcttcctgctggccatcttctgcaagagggtcacagagcccggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcctcacacgcctcacatggtggactcggaactgccccctctctgagctggagaaggaggcccacgagagcacaccggagatatccgagaggccagccggggagtgccctgcaggaggtggagcggcagagaactcgagcctgggccaggagcagcctgaagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtagacagattaaacaaagcccaagcctgtcagccacagaaacaggctctcctcttactttgctgtctaaactggagatcacagaagtcaagactgcaagctcccctgaagagaatccaactcaacctgcacacttgacaagtggagaaacagaagcccagagagagcactgggtttgttcaggaccacccagaaggtgtcacacggggtttccccactctttctgatatattgccttacagacctacctcaaacacactgtttccaccctcttcttgaatgtattcagtagcctttactgaatgtgtgtcttgagagtagaaaaatggaggatacaagaaaaggagcaggaagaaatttgcaaattcccctacctctctatctttctattctcaccaataatctctttgttgcatgaatttacccaggagagtcctatatttccattggtggctccacagtggtggctgtcagacccgaaggggtggggagccaagggtggactttaagcatggtgacagatggtattttgggcagaaagctcttagacaatggactatccaaagcactatttaaattctgcctcttcctactctctaacccaaatatgcacaaactctctatggccttgagaagcagttggagagacatgacttgttaaaacctcaaggaatcaagacatgttactctgtatttaagggtaagccccacagcgggcagcacaaacagcctgggagccactgtgcctgtgcttctctgtccttctccctttgcttgccatgaatccgcataccttggaatacactgtgaccccagttaagtgtcccttcgccaggaagctgccgcaacgtccagacctgggtcaagttcccactcctgctcccatagccttgacctgcttctgtcacagcactgatcacactgagatggaagactccagggggcaaggaccaagggccatatcccaagtgactttgtacccagaaaataacagctgttcaataaatgtgtattgagttaattagttc

SEQ ID NO: 462958 - DNA, 1395 bp, Homo sapiens
ttaggagatatacctaatgttaaatgatgagttaatgggtgaagcacaccaatgtggacatgtatacatatgtaactaagctgcacgttgtgcacgtctcagagaagtttgttattaccgactttctgaagcctacttctgtcagctcgtcaaagtcattctctatcctgctttgttccattgctggcgaggagctgcgatcctttggaggagaagggatgaatctgcaggagtctgaagaggaggaagtcccccaggagtcctgggatgaaggttattcgactctctcaattcctcctgaaaggttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactggatgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagcgtgctgatggaagtggaagtgcctgaagtcttacaggactcactggatagatattattcgactccatcaatgtactttgaactacctgactcattccagcactacagaagtgtgttttactcatttgaggaacagcacatcagctttgcccttgacatggacaataggttttttactttgacggtgagaagtctccacctggtcttccagatgggagtcat

SEQ ID NO: 462959 - DNA, 2766 bp, Homo sapiens
cggcggtctaagggctgcctccccgccactccttgtccggaccccgcgcccggggcctcccgccgccgcggcgcctcctcagagagcccgggtcagctgcccctgtggccgcggctggtcccaaactcactgaatcgggaactctggtctgggtacagaaatcggggtgattctgatgcaggcgagagttggagaaccaatgtcgtagttcatcagcctccgaaagcatcctttgctctctttccagaaaggaagagcatctctgccattcgtgtctcaaggacaagcgcttcagcctcgttctctgtgagctgatctgtggatcgcggcgtgtcgggcgacatggaggaagaaagaaaaactgctgagttacagaaaaatagaatacaggactcagtagtctttgaggatgtggctgtggactttacccaggaggaatgggctttgctggatcttgctcagagaaacctctacagagatgtgatgctggaaaacttccagaacctggcctcactagggtatccgctacacacaccccatctgatctcccagtgggaacaagaggaggacctgcagacagtgaagagagaacttatccagggcatctttatgggagagcaccgggaaggcaagaacccttgggagaaactgttttggttgggggaaaaaataaacttaaaaaatcatatggtagagaacatctatgaatgttatgaagaaaatcaagatggacagactttcagccaagttccaaatcttgattcactcaagagaaatactgaagtaaaatcctgtgaatgccatgagtgtggaaaggccttcgtggatcattcatcccttaagagtcacatcaggtctcatactggaagcaaaccctatcagtgcaaggaatgtgggaaggccttccattttcttgcttgtttcaagaagcatatgaaaacccccactgaagagaagccctatgaatgtaaggaatgtaccaaagccttcagctgttcctcattctttagggcacatatgaagattcacatcggaaagacaaactatgaatgtaaagaatgtgggaaaggttttagttgttcctcatcgctcacagaacacaaaagaattcacagtggagataagccttatgaatgtaaggaatgtgggaaggccttcagttgttcctcctcactctccaaacacaaaagaattcacagtggagataagccatatgaatgtaaggaatgtgggaaggcctttagctcttcctctcaccttataatacatataagaattcacactggagagaagccttatgaatgtaaagagtgtgggaaggccttcagcgagtcctcaaaactcactgtacatgggaggacacatactggagagaaaccctataaatgtaaggaatgtgggaaagcctacaattgtccctcctccttaagtatccatatgagaaaacacactggagaaaaaccgtatgaatgtctggaatgtggaaaggccttctaccttcccacttcccttaatacacatgtgaaaaatcaaagtcgagagaaaccctatgaatgtaaggaatgtgggaaggcctttagttgtccctcgtcctttagagcacatgtgagagatcacactggaaagatacagtatgaatgtaaggagtgtgggaagacctttagtcgttcctcatccctcaccgaacacctaagaactcacagcggagagaagccgtatgaatgtaaagaatgtgggaaagcctttattagttcctcccaccttacagtacatatcagaactcacactggagagaaaccctatgaatgtaagaaatgtgggaaagcctttatttatccctcagcccttaggatccacatgagaacgcacactggggaaaaaccctatgaatgtaaggaatgtgggaaagcatttcgtcattcttcataccttactgtacatgcaagaatgcacactggagagaaaccctttgaatgtctggaatgtggaaaagctttcagttgtccctcatcctttcgaaggcatgtgagaagccacactggagagaaaccctatgaatgtaaggaatgtgggaaagcctttgtttgtcctgcctactttcgaaggcatgtgaaaactcacactagagaaaacatataaatgtaaggaatatgggaatgtctgcaaagcttcagatcctaggcaacatgtgagatctcatactgtggagacaccctatgaatgtaagaaagtaggaaattgttgctcatcgttttgaagatttgaggacactttagagaaaccctgtgtatgtaagtcatgtgctaaagcctttatgaacattgcttattatgtataagaaaatctctactagaaatgaagatcagtgcctcatccttaaagtagaatgctggctcgttgattaccagtgttttctgataggaacattgaaggtgataaatttaccttttcagctctagccacatactttttagtatgaggtgctttaattttggttctgatgtaaatatgatttccattacaaaatcttttggatcatggaggacacgaaatattttttctgtataggcagcagtggtcttttttaaaaaagtggtttctaattaatgttcattgttctttaaatgggtagtcgttataatattgacaaaccaatataatattgacaaaccaaaaaccaaatattgatttttgttgatgttttgtttttagtctacatggcagataatggaacttgcccactcaatatttttcttcctattcttt

SEQ ID NO: 462960 - DNA, 3558 bp, Homo sapiens
gaagaagttggatgccatgaccctcattaaagaagtgacatgggcttctgtcattgcagacatgtccatcttcgggcactgccctgcccatgatgacttctacttggttgtgtgtaaccactgcagccaagtggtgaagcctcaagctttccagaagcactgcgcccctgccagctctcagaaatgccatgtagtgaatgggcagggcccagcttgtagggccccaggttccacgaaaacctcctccagggagaagggccaggggtcccggagccgtggccaccagcctcctgagaagacccagaaggacaacctctgccagccagggggcctcaccaaggactcccctggaaaacctcccatggctcccccttctaaagaacctcctggcagagagaacatcgagatcatccccagtgaggggtccagtcactgggctgaaggcagccctcctgaaaaggagcccagtgggaccaggctgccccctaaaacccaccggaagatggctcggaaggagtgcgacctcaacaggcagtgtggggtaataaatccagagaccaaaaagatctgtacccgcctgttgacctgcaagatccactcagtacaccagcgccgggaagtccagggccgggccaaggactttgacgtgctggtggcagagctgaaggccaactcccgcaaaggggagtctcccaaggagaagagcccagggcgcaaggagcaagttctcgagcgcccctcccaggagctcccctcctcagtccaggttgtagcagcggtggctgctcccagcagcaccttctctgttcgtgccaagcagacctacccatactgtgcactgcccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttgtcaactccccgttatctgctcccctgagcccatcctctacaggcacctgcccccgccttccaggtccaaccctgagacctgcctgctcagcctccatgccccccaccaaggacaaccttgtccccagctaccctgcaggctcccccagcgtggcggctgcctgtagccaggcagagtgcatgggcgggagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaaggtactggagctacctctgttccctgaaggaaagggagtttgagtccctgggtcacagcctaacatgccgagcagcaagtcaaaagcccattaacgagaaagtgcctgcccactgcaacggagccgccagcacctcctcccctccagatccgggccccaggctgctgccgctttttataactttatattattttttttaagaaaaaaagctctttaaaatacctcaagactgtctccctgttctgttgctgctatgaaaatataaaaacagaaacatagaaaaggaaggaaaaaaaataacaaaatgagtgtccttactgtccccagccctaccctgggaggctgagatgataggcagccagactccagctcccatagcttgcctgcaaaagtctcttatgctcattattattattattgtcatcttgtcattttcaatagtgtgaaaaatgtttgtgtcactggggtagtctttccagacaggatgatgaggcgtgtggctctgaatgagtaaggcttcctgagtcttgacaccagagacgactatggtcccattgggaagagaaactcgagagggggagctgcacttctggctctttctaggatccttgccccgagggtctgggaattggcttgtgacccttttctggtccttcagcaaccctaggcatccatccctccctgaattattgcctgcttttcttcagctgttcctgcagcctcattttctcagccacttagggagcttgagctgggttggtcattgctgttgggatattcctgttttctattggacagccttccttccctgcctgtgggtttgcctttaaggaaggggtagaacctttcccagggaggcctccttgggttgaaccaccccttttttggaggcaggaagggaaaaggcatcatcacttgcagaactggtggtgtgggaggccacaggagtgtgggaggccttggtccttcaggatcacctggctcctcagggctgagcagctgctgaggaggcggcagggctgggagtgccctagtttttccatttatctcgctggggaccactcccgtgcagatgcgagaggagacttgcatttccctcctttggtccaccaggttcaaggcactatattttggcgatgtcctttcctattctccttgctcttaggcatggaggaagcttgttccctgaacaagacaaaatgaggtgacaggagacagtgcacagccagggaaatccagtactactagaaatcggctccaaacacttgtttcacagtcttggttcagcgtaccaagtgtgtgatttggggtttcactgaaatcgtttgccacgaaagtaatttccacaggctgcttgggatttaggcccttgtagacagacacacagatacaaatgaaggtgggctgggaactgttcggtccccttctgcctccgggctctcgcgggagcgggcctctccggggcactcgcgtttcccccccagcccccagagggcgctgtgggccactccgccgcactgccggcggcgtccccggggaggagcctctcctgcagccgccaccgcctccgcgatcgcaaacccggaagacgtgttc

SEQ ID NO: 462961 - DNA, 3480 bp, Homo sapiens
gaagaagttggatgccatgaccctcattaaagaagtgacatgggcttctgtcattgcagacatgtccatcttcgggcactgccctgcccatgatgacttctacttggttgtgtgtaaccactgcagccaagtggtgaagcctcaagctttccagaagcactgcgcccctgccagctctcagaaatgccatgtagtgaatgggcagggcccagcttgtagggccccaggttccacgaaaacctcctccagggagaagggccaggggtcccggagccgtggccaccagcctcctgagaagacccagaaggacaacctctgccagccagggggcctcaccaaggactcccctggaaaacctcccatggctcccccttctaaagaacctcctggcagagagaacatcgagatcatccccagtgaggggtccagtcactgggctgaaggcagccctcctgaaaaggagcccagtgggaccaggctgccccctaaaacccaccggaagatggctcggaaggagtgcgacctcaacaggcagtgtggggtaataaatccagagaccaaaaagatctgtacccgcctgttgacctgcaagatccactcagtacaccagcgccgggaagtccagggccgggccaaggactttgacgtgctggtggcagagctgaaggccaactcccgcaaaggggagtctcccaaggagaagagcccagggcgcaaggagcaagttctcgagcgcccctcccaggagctcccctcctcagtccaggttgtagcagcggtggctgctcccagcagcaccttctctgttcgtgccaagcagacctacccatactgtgcactgcccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttgtcaactccccgttatctgctcccctgagcccatcctctacaggcacctgcccccgccttccaggtccaaccctgagacctgcctgctcagcctccatgccccccaccaaggacaaccttgtccccagctaccctgcaggctcccccagcgtggcggctgcctgtagccaggcagagtgcatgggcgggagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaagtcaaaagcccattaacgagaaagtgcctgcccactgcaacggagccgccagcacctcctcccctccagatccgggccccaggctgctgccgctttttataactttatattattttttttaagaaaaaaagctctttaaaatacctcaagactgtctccctgttctgttgctgctatgaaaatataaaaacagaaacatagaaaaggaaggaaaaaaaataacaaaatgagtgtccttactgtccccagccctaccctgggaggctgagatgataggcagccagactccagctcccatagcttgcctgcaaaagtctcttatgctcattattattattattgtcatcttgtcattttcaatagtgtgaaaaatgtttgtgtcactggggtagtctttccagacaggatgatgaggcgtgtggctctgaatgagtaaggcttcctgagtcttgacaccagagacgactatggtcccattgggaagagaaactcgagagggggagctgcacttctggctctttctaggatccttgccccgagggtctgggaattggcttgtgacccttttctggtccttcagcaaccctaggcatccatccctccctgaattattgcctgcttttcttcagctgttcctgcagcctcattttctcagccacttagggagcttgagctgggttggtcattgctgttgggatattcctgttttctattggacagccttccttccctgcctgtgggtttgcctttaaggaaggggtagaacctttcccagggaggcctccttgggttgaaccaccccttttttggaggcaggaagggaaaaggcatcatcacttgcagaactggtggtgtgggaggccacaggagtgtgggaggccttggtccttcaggatcacctggctcctcagggctgagcagctgctgaggaggcggcagggctgggagtgccctagtttttccatttatctcgctggggaccactcccgtgcagatgcgagaggagacttgcatttccctcctttggtccaccaggttcaaggcactatattttggcgatgtcctttcctattctccttgctcttaggcatggaggaagcttgttccctgaacaagacaaaatgaggtgacaggagacagtgcacagccagggaaatccagtactactagaaatcggctccaaacacttgtttcacagtcttggttcagcgtaccaagtgtgtgatttggggtttcactgaaatcgtttgccacgaaagtaatttccacaggctgcttgggatttaggcccttgtagacagacacacagatacaaatgaaggtgggctgggaactgttcggtccccttctgcctccgggctctcgcgggagcgggcctctccggggcactcgcgtttcccccccagcccccagagggcgctgtgggccactccgccgcactgccggcggcgtccccggggaggagcctctcctgcagccgccaccgcctccgcgatcgcaaacccggaagacgtgttc

SEQ ID NO: 462962 - DNA, 576 bp, Homo sapiens
ggcgcaggcgcccagaggcgcacaggagacctcaggcccagactccactccccagctgtgaaaggactgctggccagacccccaagctagcccgccaggcctccatagagctgcccagcatggctgcatccagtaccaagagttggtgggagacgggtgaggtacaggctcagtctgcggccaagactccgtcctgcaagatggactctgtgactacatgactaataaaatatggcagaaatgacaccatgcagtttccaagcccaggccttaggagacaggcagcttccagttcagtcttttggagggtcagctctggggccctcagccatcacgcatggagtccaaccaccctgagacgtcatgctggagacccacctgtggatgccccagtcaagagtcactgctgagcccagcctcccagccacccccacccagggcaccagaccacggagcttctggccaaggcttcaccaacttcacttgatgctgtgaggaacagaactgcccatccaagccctgccagaatttctaacccacaaagccacgagtcacaataaatgctatgggacaaaa

SEQ ID NO: 462963 - DNA, 1212 bp, Homo sapiens
ctccatctcatgccccaggcccaaggacacacaccccagctgagaccttgctcacatagaggggctgggacatgggaacatggggagcaacatggccaggcttctcctccatggaaaccctccacctcctcaatactctgccccagctctgcgccgccctccatttggaggggctgggtcgtgagtgggggcgtgagtgagcatgagggcccctgcaccccaggctctgcctccccacgtggaacgaggcccagcagcccccagccaggtggctactactgcattcaatcagtgcccctccatctaacaaatactccctcatataatcagtactcctccatccaatcaatattccttcatcaacacctttctatacaaccaatagtcctccatctaatcaatgctcctccatccaaccaatactctgcaatttaaccactgtccctccatccattcaatgtccctccatccatcccatggtcccccagccctaccccatgagcagcatggaggcagacccacatctgtcttgtgcgccatcatctccctgatgctcttcaggaaagggaggtgtctcacaattgcattgaatggaggaaggcacatctttccagtgatccccactctagggctgcattgggaaatcgctcccagggaaaacacaaacacaaagcagagggttgcccagtgtgaccctctgatgtgaccacggtggctgtccactaaggtaatcctgatgcttttcctcctctgcagactgctggccagacccccaagctagcccgccaggcctccatagagctgcccagcatggctgcatccagtaccaagagttggtgggagacgggtgaggtacaggctcagtctgcggccaagactccgtcctgcaaggatattgtggctggagacatgagcaagaaaagcctctgggagcagaagggaggctccaagacctcatcaacaattaaggtagagcctaaatgtggttggtgcaggcaggaaatattaacttatttcattgtcacacgaaaccagaagacataaaacagttaaaataggccaggcacagtggctcacacctgtaatcccagcactttgggaggccgaggcgggtggatcacgaggtcaggaggagaccatcctggccaacgtggtgaaacttggtctatactaaaaatacaaaaaaaaaaaaaaaaaaaaattagccgagcg

SEQ ID NO: 462964 - DNA, 954 bp, Homo sapiens
caaggctcccaaggcctgagtgggcaggtagcacccaggtatagaccttccacgtgcagcacccaggacacagccagcatgaactgggcatttctgcagggcctgctgagtggcgtgaacaagtactccacagtgctgagccgcatctggctgtctgtggtgttcatctttcgtgtgctggtgtacgtggtggcagcggaggaggtgtgggacgatgagcagaaggactttgtctgcaacaccaagcagcccggctgccccaacgtctgctatgacgagttcttccccgtgtcccacgtgcgcctctgggccctacagctcatcctggtcacgtgcccctcactgctcgtggtcatgcacgtggcctaccgcgaggaacgcgagcgcaagcaccacctgaaacacgggcccaatgccccgtccctgtacgacaacctgagcaagaagcggggcggactgtggtggacgtacttgctgagcctcatcttcaaggccgccgtggatgctggcttcctctatatcttccaccgcctctacaaggattatgacatgccccgcgtggtggcctgctccgtggagccttgcccccacactgtggactgttacatctcccggcccacggagaagaaggtcttcacctacttcatggtgaccacagctgccatctgcatcctgctcaacctcagtgaagtcttctacctggtgggcaagaggtgcatggagatcttcggccccaggcaccggcggcctcggtgccgggaatgcctacccgatacgtgcccaccatatgtcctctcccagggagggcaccctgaggatgggaactctgtcctaatgaaggctgggtcggccccagtggatgcagcacaggtcccggataggtgagtcccctctgacggtgggagggtcacggctgagagcaagccagggatgggaatctgtcaaggtgcccaa

SEQ ID NO: 462965 - DNA, 2847 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgataagctgctcctcaaaccacacctttggggattttgaagggagtggggatacacagcctccccagacacctcccattctgaggggaagccgctgcactccctgggggaccccagtctgatgccctccaggaggataagtctgaagccgggctgggaagggagcggagaggcccgaaacagagcagcaggcagcgccctctgctggcaccctggagacagcctcggctgcggggcccctgccttctagtcctccccagctttcaggacaccttgacaacctggggtccctgcagaagtggcccggctgtcccccaagtctcctgaagctatctgggtagggtgggaggcagtgctgtgagccacaaatgcaaagcagaggggacagatgttgggactcaaagacatgaggtagagctggccccatgggtaggtgccaccaccagagcccatgaggcttcgtgttctagaaggtggtgggttagtgccgcactgagggcgtgtccgggagggagcatgtgtcaccagggctcaggaaacagcatgagtcatgacgcgggggtgtttaaggcattcgtgccacagcggggacctcggagctatgccttgataaggcaagtgaggttacatgtacgatgatgcggtttgtgctgcagactggaaaaaagcaggggctttgtcctctcctgaccccctcacactctgccttcacggtaggctcctgagaggggggtctccaaggagggtgtcagtactgcagcttcagctggcgtggatggggtgcttacaggagcagcagggctgagggagatgacagcagtacgaaccgtggctctcctgaggcctgggtttcctcatatgtaaaatgggggttgcattagaccatacccttggcctgtgtttaggcaaatagggatgaaagtggggccaagggctgaagagctgggtccgctgccgtcgttgcccttctttcttgccaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccccaataaagcacccgccccctcaaaaaacaaaaaaggggtgggtaaaaacac

SEQ ID NO: 462966 - DNA, 2972 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtgtactttcccaagcaccaccaggccaaaggtctctcagttcagagcagaaagccgtatacccagaggagcaggcagataacagaaacttccagaaacctctgtggagacagtggaagaggcaaaagggagttcctgacagctggattctagaagtagaactatgagctcacctttggcctcccttagcaagacccgaaaagtgcccctgccctcggagcctatgaatcctgggaggcgaggaatccgcatctatggagatgaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgataagctgctcctcaaaccacacctttggggattttgaagggagtggggatacacagcctccccagacacctcccattctgaggggaagccgctgcactccctgggggaccccagtctgatgccctccaggaggataagtctgaagccgggctgggaagggagcggagaggcccgaaacagagcagcaggcagcgccctctgctggcaccctggagacagcctcggctgcggggcccctgccttctagtcctccccagctttcaggacaccttgacaacctggggtccctgcagaagtggcccggctgtcccccaagtctcctgaagctatctgggtagggtgggaggcagtgctgtgagccacaaatgcaaagcagaggggacagatgttgggactcaaagacatgaggtagagctggccccatgggtaggtgccaccaccagagcccatgaggcttcgtgttctagaaggtggtgggttagtgccgcactgagggcgtgtccgggagggagcatgtgtcaccagggctcaggaaacagcatgagtcatgacgcgggggtgtttaaggcattcgtgccacagcggggacctcggagctatgccttgataaggcaagtgaggttacatgtacgatgatgcggtttgtgctgcagactggaaaaaagcaggggctttgtcctctcctgaccccctcacactctgccttcacggtaggctcctgagaggggggtctccaaggagggtgtcagtactgcagcttcagctggcgtggatggggtgcttacaggagcagcagggctgagggagatgacagcagtacgaaccgtggctctcctgaggcctgggtttcctcatatgtaaaatgggggttgcattagaccatacccttggcctgtgtttaggcaaatagggatgaaagtggggccaagggctgaagagctgggtccgctgccgtcgttgcccttctttcttgccaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccccaataaagcacccgccccctcaaaaaacaaaaaaggggtgggtaaaaacac

SEQ ID NO: 462967 - DNA, 2876 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgagcggtgacctaggcatccctgtctgcagaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgataagctgctcctcaaaccacacctttggggattttgaagggagtggggatacacagcctccccagacacctcccattctgaggggaagccgctgcactccctgggggaccccagtctgatgccctccaggaggataagtctgaagccgggctgggaagggagcggagaggcccgaaacagagcagcaggcagcgccctctgctggcaccctggagacagcctcggctgcggggcccctgccttctagtcctccccagctttcaggacaccttgacaacctggggtccctgcagaagtggcccggctgtcccccaagtctcctgaagctatctgggtagggtgggaggcagtgctgtgagccacaaatgcaaagcagaggggacagatgttgggactcaaagacatgaggtagagctggccccatgggtaggtgccaccaccagagcccatgaggcttcgtgttctagaaggtggtgggttagtgccgcactgagggcgtgtccgggagggagcatgtgtcaccagggctcaggaaacagcatgagtcatgacgcgggggtgtttaaggcattcgtgccacagcggggacctcggagctatgccttgataaggcaagtgaggttacatgtacgatgatgcggtttgtgctgcagactggaaaaaagcaggggctttgtcctctcctgaccccctcacactctgccttcacggtaggctcctgagaggggggtctccaaggagggtgtcagtactgcagcttcagctggcgtggatggggtgcttacaggagcagcagggctgagggagatgacagcagtacgaaccgtggctctcctgaggcctgggtttcctcatatgtaaaatgggggttgcattagaccatacccttggcctgtgtttaggcaaatagggatgaaagtggggccaagggctgaagagctgggtccgctgccgtcgttgcccttctttcttgccaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccccaataaagcacccgccccctcaaaaaacaaaaaaggggtgggtaaaaacac

SEQ ID NO: 462968 - DNA, 2642 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgataagctgctcctcaaaccacacctttggggattttgaagggagtggggatacacagcctccccagacacctcccattctgaggggaagccgctgcactccctgggggaccccagtctgatgccctccaggaggataagtctgaagccgggctgggaagggagcggagaggcccgaaacagagcagcaggcagcgccctctgctggcaccctggagacagcctcggctgcggggcccctgccttctagtcctccccagctttcaggacaccttgacaacctggggtccctgcagaagtggcccggctgtcccccaagtctcctgaagctatctgggtagggtgggaggcagtgctgtgagccacaaatgcaaagcagaggggacagatgttgggactcaaagacatgaggtagagctggccccatgggtaggtgccaccaccagagcccatgaggcttcgtgttctagaaggtggtgggttagtgccgcactgagggcgtgtccgggagggagcatgtgtcaccagggctcaggaaacagcatgagtcatgacgcgggggtgtttaaggcattcgtgccacagcggggacctcggagctatgccttgataaggcaagtgaggttacatgtacgatgatgcggtttgtgctgcagactggaaaaaagcaggggctttgtcctctcctgaccccctcacactctgccttcacggtaggctcctgagaggggggtctccaaggagggtgtcagtactgcagcttcagctggcgtggatggggtgcttacaggagcagcagggctgagggagatgacagcagtacgaaccgtggctctcctgaggcctgggtttcctcatatgtaaaatgggggttgcattagaccatacccttggcctgtgtttaggcaaatagggatgaaagtggggccaagggctgaagagctgggtccgctgccgtcgttgcccttctttcttgccaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccccaataaagcacccgccccctcaaaaaacaaaaaaggggtgggtaaaaacac

SEQ ID NO: 462969 - DNA, 2613 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgataagctgctcctcaaaccacacctttggggattttgaagggagtggggatacacagcctccccagacacctcccattctgaggggaagccgctgcactccctgggggaccccagtctgatgccctccaggaggataagtctgaagccgggctgggaagggagcggagaggcccgaaacagagcagcaggcagcgccctctgctggcaccctggagacagcctcggctgcggggcccctgccttctagtcctccccagctttcaggacaccttgacaacctggggtccctgcagaagtggcccggctgtcccccaagtctcctgaagctatctgggtagggtgggaggcagtgctgtgagccacaaatgcaaagcagaggggacagatgttgggactcaaagacatgaggtagagctggccccatgggtaggtgccaccaccagagcccatgaggcttcgtgttctagaaggtggtgggttagtgccgcactgagggcgtgtccgggagggagcatgtgtcaccagggctcaggaaacagcatgagtcatgacgcgggggtgtttaaggcattcgtgccacagcggggacctcggagctatgccttgataaggcaagtgaggttacatgtacgatgatgcggtttgtgctgcagactggaaaaaagcaggggctttgtcctctcctgaccccctcacactctgccttcacggtaggctcctgagaggggggtctccaaggagggtgtcagtactgcagcttcagctggcgtggatggggtgcttacaggagcagcagggctgagggagatgacagcagtacgaaccgtggctctcctgaggcctgggtttcctcatatgtaaaatgggggttgcattagaccatacccttggcctgtgtttaggcaaatagggatgaaagtggggccaagggctgaagagctgggtccgctgccgtcgttgcccttctttcttgccaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccccaataaagcacccgccccctcaaaaaacaaaaaaggggtgggtaaaaacac

SEQ ID NO: 462970 - DNA, 1632 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccccaataaagcacccgccccctcaaaaaacaaaaaaggggtgggtaaaaacac

SEQ ID NO: 462971 - DNA, 2973 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgataagctgctcctcaaaccacacctttggggattttgaagggagtggggatacacagcctccccagacacctcccattctgaggggaagccgctgcactccctgggggaccccagtctgatgccctccaggaggataagtctgaagccgggctgggaagggagcggagaggcccgaaacagagcagcaggcagcgccctctgctggcaccctggagacagcctcggctgcggggcccctgccttctagtcctccccagctttcaggacaccttgacaacctggggtccctgcagaagtggcccggctgtcccccaagtctcctgaagctatctgggtagggtgggaggcagtgctgtgagccacaaatgcaaagcagaggggacagatgttgggactcaaagacatgaggtagagctggccccatgggtaggtgccaccaccagagcccatgaggcttcgtgttctagaaggtggtgggttagtgccgcactgagggcgtgtccgggagggagcatgtgtcaccagggctcaggaaacagcatgagtcatgacgcgggggtgtttaaggcattcgtgccacagcggggacctcggagctatgccttgataaggcaagtgaggttacatgtacgatgatgcggtttgtgctgcagactggaaaaaagcaggggctttgtcctctcctgaccccctcacactctgccttcacggtaggctcctgagaggggggtctccaaggagggtgtcagtactgcagcttcagctggcgtggatggggtgcttacaggagcagcagggctgagggagatgacagcagtacgaaccgtggctctcctgaggcctgggtttcctcatatgtaaaatgggggttgcattagaccatacccttggcctgtgtttaggcaaatagggatgaaagtggggccaagggctgaagagctgggtccgctgccgtcgttgcccttctttcttgccaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagccccgtcccggtcccggtcccggcccctccctgtcctggacccagtcccagcccccaataaagcacccgccccctcaacccgctgctccgccaggctcttgggtgggccatctcgccaggcacgtaggaaaggcctgggaccagctgggccagggagggggcggtgccgacccgccccttg

SEQ ID NO: 462972 - DNA, 1992 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagccccgtcccggtcccggtcccggcccctccctgtcctggacccagtcccagcccccaataaagcacccgccccctcaacccgctgctccgccaggctcttgggtgggccatctcgccaggcacgtaggaaaggcctgggaccagctgggccagggagggggcggtgccgacccgccccttg

SEQ ID NO: 462973 - DNA, 1363 bp, Homo sapiens
gatgatgtcatgagtccgtcccccggtgttatttagtcacgaggactcgaactacatgatgtatatagctggccccatgggtaggtgccaccaccagagcccatgaggcttcgtgttctagaaggtggtgggttagtgccgcactgagggcgtgtccgggagggagcatgtgtcaccagggctcaggaaacagcatgagtcatgacgcgggggtgtttaaggcattcgtgccacagcggggacctcggagctatgccttgataaggcaagtgaggttacatgtacgatgatgcggtttgtgctgcagactggaaaaaagcaggggctttgtcctctcctgaccccctcacactctgccttcacggtaggctcctgagaggggggtctccaaggagggtgtcagtactgcagcttcagctggcgtggatggggtgcttacaggagcagcagggctgagggagatgacagcagtacgaaccgtggctctcctgaggcctgggtttcctcatatgtaaaatgggggttgcattagaccatacccttggcctgtgtttaggcaaatagggatgaaagtggggccaagggctgaagagctgggtccgctgccgtcgttgcccttctttcttgccaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccccaataaagcacccgccccctcaaaaaacaaaaaaggggtgggtaaaaacac

SEQ ID NO: 462974 - DNA, 1399 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtgcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccccaataaagcacccgccccctcaaaaaacaaaaaaggggtgggtaaaaacac

SEQ ID NO: 462975 - DNA, 1065 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgcaggccttgtgcccaaagcagcactgctgctgcgggcacgccgagccccgaagtccagcctgaaattcagtcctggtccctgtcccggtcccggctccagtccctgtcccggacccagtcccagcccctccctgtcctggacccagtcccagcccccaataaagcacccgccccctcaacccgctgctccgccaggctcttgggtgggccatctcgccaggcacgtaggaaaggcctgggaccagctgggccagggagggggcggtgccgacccgccccttg

SEQ ID NO: 462976 - DNA, 3104 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtgtactttcccaagcaccaccaggccaaaggtctctcagttcagagcagaaagccgtatacccagaggagcaggcagataacagaaacttccagaaacctctgtggagacagtggaagaggcaaaagggagttcctgacagctggattctagaagtagaactatgagctcacctttggcctcccttagcaagacccgaaaagtgcccctgccctcggagcctatgaatcctgggaggcgaggaatccgcatctatggagatgagcggtgacctaggcatccctgtctgcagaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgataagctgctcctcaaaccacacctttggggattttgaagggagtggggatacacagcctccccagacacctcccattctgaggggaagccgctgcactccctgggggaccccagtctgatgccctccaggaggataagtctgaagccgggctgggaagggagcggagaggcccgaaacagagcagcaggcagcgccctctgctggcaccctggagacagcctcggctgcggggcccctgccttctagtcctccccagctttcaggacaccttgacaacctggggtccctgcagaagtggcccggctgtcccccaagtctcctgaagctatctgggtagggtgggaggcagtgctgtgagccacaaatgcaaagcagaggggacagatgttgggactcaaagacatgaggtagagctggccccatgggtaggtgccaccaccagagcccatgaggcttcgtgttctagaaggtggtgggttagtgccgcactgagggcgtgtccgggagggagcatgtgtcaccagggctcaggaaacagcatgagtcatgacgcgggggtgtttaaggcattcgtgccacagcggggacctcggagctatgccttgataaggcaagtgaggttacatgtacgatgatgcggtttgtgctgcagactggaaaaaagcaggggctttgtcctctcctgaccccctcacactctgccttcacggtaggctcctgagaggggggtctccaaggagggtgtcagtactgcagcttcagctggcgtggatggggtgcttacaggagcagcagggctgagggagatgacagcagtacgaaccgtggctctcctgaggcctgggtttcctcatatgtaaaatgggggttgcattagaccatacccttggcctgtgtttaggcaaatagggatgaaagtggggccaagggctgaagagctgggtccgctgccgtcgttgcccttctttcttgccaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccctccctgtcctggacccagtcccagcccccaataaagcacccgccccctcaacccgctgctccgccaggctcttgggtgggccatctcgccaggcacgtaggaaaggcctgggaccagctgggccagggagggggcggtgccgacccgccccttg

SEQ ID NO: 462977 - DNA, 2748 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgataagctgctcctcaaaccacacctttggggattttgaagggagtggggatacacagcctccccagacacctcccattctgaggggaagccgctgcactccctgggggaccccagtctgatgccctccaggaggataagtctgaagccgggctgggaagggagcggagaggcccgaaacagagcagcaggcagcgccctctgctggcaccctggagacagcctcggctgcggggcccctgccttctagtcctccccagctttcaggacaccttgacaacctggggtccctgcagaagtggcccggctgtcccccaagtctcctgaagctatctgggtagggtgggaggcagtgctgtgagccacaaatgcaaagcagaggggacagatgttgggactcaaagacatgaggtagagctggccccatgggtaggtgccaccaccagagcccatgaggcttcgtgttctagaaggtggtgggttagtgccgcactgagggcgtgtccgggagggagcatgtgtcaccagggctcaggaaacagcatgagtcatgacgcgggggtgtttaaggcattcgtgccacagcggggacctcggagctatgccttgataaggcaagtgaggttacatgtacgatgatgcggtttgtgctgcagactggaaaaaagcaggggctttgtcctctcctgaccccctcacactctgccttcacggtaggctcctgagaggggggtctccaaggagggtgtcagtactgcagcttcagctggcgtggatggggtgcttacaggagcagcagggctgagggagatgacagcagtacgaaccgtggctctcctgaggcctgggtttcctcatatgtaaaatgggggttgcattagaccatacccttggcctgtgtttaggcaaatagggatgaaagtggggccaagggctgaagagctgggtccgctgccgtcgttgcccttctttcttgccaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccccaataaagcacccgccccctcaaaaaacaaaaaaggggtgggtaaaaacac

SEQ ID NO: 462978 - DNA, 1866 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccccaataaagcacccgccccctcaaaaaacaaaaaaggggtgggtaaaaacac

SEQ ID NO: 462979 - DNA, 2873 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtgtactttcccaagcaccaccaggccaaaggtctctcagttcagagcagaaagccgtatacccagaggagcaggcagataacagaaacttccagaaacctctgtggagacagtggaagaggcaaaagggagttcctgacagctggattctagaagtagaactatgagctcacctttggcctcccttagcaagacccgaaaagtgcccctgccctcggagcctatgaatcctgggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgataagctgctcctcaaaccacacctttggggattttgaagggagtggggatacacagcctccccagacacctcccattctgaggggaagccgctgcactccctgggggaccccagtctgatgccctccaggaggataagtctgaagccgggctgggaagggagcggagaggcccgaaacagagcagcaggcagcgccctctgctggcaccctggagacagcctcggctgcggggcccctgccttctagtcctccccagctttcaggacaccttgacaacctggggtccctgcagaagtggcccggctgtcccccaagtctcctgaagctatctgggtagggtgggaggcagtgctgtgagccacaaatgcaaagcagaggggacagatgttgggactcaaagacatgaggtagagctggccccatgggtaggtgccaccaccagagcccatgaggcttcgtgttctagaaggtggtgggttagtgccgcactgagggcgtgtccgggagggagcatgtgtcaccagggctcaggaaacagcatgagtcatgacgcgggggtgtttaaggcattcgtgccacagcggggacctcggagctatgccttgataaggcaagtgaggttacatgtacgatgatgcggtttgtgctgcagactggaaaaaagcaggggctttgtcctctcctgaccccctcacactctgccttcacggtaggctcctgagaggggggtctccaaggagggtgtcagtactgcagcttcagctggcgtggatggggtgcttacaggagcagcagggctgagggagatgacagcagtacgaaccgtggctctcctgaggcctgggtttcctcatatgtaaaatgggggttgcattagaccatacccttggcctgtgtttaggcaaatagggatgaaagtggggccaagggctgaagagctgggtccgctgccgtcgttgcccttctttcttgccaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccccaataaagcacccgccccctcaaaaaacaaaaaaggggtgggtaaaaacac

SEQ ID NO: 462980 - DNA, 1845 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccccaataaagcacccgccccctcaaaaaacaaaaaaggggtgggtaaaaacac

SEQ ID NO: 462981 - DNA, 2486 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgataagctgctcctcaaaccacacctttggggattttgaagggagtggggatacacagcctccccagacacctcccattctgaggggaagccgctgcactccctgggggaccccagtctgatgccctccaggaggataagtctgaagccgggctgggaagggagcggagaggcccgaaacagagcagcaggcagcgccctctgctggcaccctggagacagcctcggctgcggggcccctgccttctagtcctccccagctttcaggacaccttgacaacctggggtccctgcagaagtggcccggctgtcccccaagtctcctgaagctatctgggtagggtgggaggcagtgctgtgagccacaaatgcaaagcagaggggacagatgttgggactcaaagacatgaggtagagctggccccatgggtaggtgccaccaccagagcccatgaggcttcgtgttctagaaggtggtgggttagtgccgcactgagggcgtgtccgggagggagcatgtgtcaccagggctcaggaaacagcatgagtcatgacgcgggggtgtttaaggcattcgtgccacagcggggacctcggagctatgccttgataaggcaagtgaggttacatgtacgatgatgcggtttgtgctgcagactggaaaaaagcaggggctttgtcctctcctgaccccctcacactctgccttcacggtaggctcctgagaggggggtctccaaggagggtgtcagtactgcagcttcagctggcgtggatggggtgcttacaggagcagcagggctgagggagatgacagcagtacgaaccgtggctctcctgaggcctgggtttcctcatatgtaaaatgggggttgcattagaccatacccttggcctgtgtttaggcaaatagggatgaaagtggggccaagggctgaagagctgggtccgctgccgtcgttgcccttctttcttgccaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccccaataaagcacccgccccctcaaaaaacaaaaaaggggtgggtaaaaacac

SEQ ID NO: 462982 - DNA, 1637 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccctccctgtcctggacccagtcccagcccccaataaagcacccgccccctcaacccgctgctccgccaggctcttgggtgggccatctcgccaggcacgtaggaaaggcctgggaccagctgggccagggagggggcggtgccgacccgccccttg

SEQ ID NO: 462983 - DNA, 1272 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccccaataaagcacccgccccctcaaaaaacaaaaaaggggtgggtaaaaacac

SEQ ID NO: 462984 - DNA, 437 bp, Homo sapiens
ccctgctcatctagaacttcatttccattcctgggaccctatcctcctccctcccccccacaactcagcctcggctctaggtctgggctctaaatgactttgtgtgcttggaagtccctgcatcccatgactcggagctgatggccttcatgacgaggaagttgtgggacctggagcagcaggtgaaggcccagactgatgagatactgtccaaggtggggctccaggtgggagagggccaggggctggtctgagaggtggagggactgggctggggaggccaggagttggactagggtgggtgattctaggaaccgtctaccagactgacctgcccagtttgaggaccaggtgtggcctgggcctgatctaggtcctgtgacctgagccgagaggctggggggtcttcccctcagctgagcaggagggtaccgagc

SEQ ID NO: 462985 - DNA, 2325 bp, Homo sapiens
tattttaagaagattgagaacatgtttcgttgggtcgcattattctgcgtgacgaggctcacagaggagaaccccacccttactccaaaggcctttgaaagcagctctggaaagggcagggtttgcttctccctctgcccaacgtctccccaggctgcctgtgccaccttccggtctcacctcctcggagttggggtcaaacgcggagctccagtttctcagcccctcctggagctcaatgatgtccaccacgccgtccccattgcaatccagcacgaagccctgcatccagagcagcatggctgggtccagaggctgcggggaccactcggccacccagccagcaccgcagcactcgccgccgcctcctcgacgcctggctgcgcaaggcagggggtcccggccgtccgccagcttctgcaactgtctagcggagccgccgcagttcggagcccacgcgggccaagccacccgcgcctgcgggctcttgggcgccacggaaaggctgcgccaccttgtgggacctctggccgaggcgccacgcgacagttgagacgccagatgtgagttgaggtgccagacgtgagttgaggtgccagacgtggcggcgttgggtacccaggaccctcggacgggtctgctgcggcttgctgggggtccactccagaccctgttcgcctgggtatcaccagtggagtttgcagaacagcaaagattgctgcttgctccttcctccagaagcttcttcccacagtggcatcaacctgattgatgtcagccggaactctcctgcatgaggtgtctggcgacccctgatgggaagtctcacccagtcaagaagcacgggactggaagggggacctccttacggaggcagactgactgtcccttagcagagctggtgcactgtattggaggaataaccctccttgggatcagctggtctcttcagagccagcaggcaggaaagattaagtctgctgaacctcggaccatggccgccgctcccccgaggtgctctgtcccagggagattagagttcttgtctgtaagcccctgactgtagctactggaattcctgcagggatgccctccaggtgaggagggatggcttcgggtcccacctaggaagcagtctggccacgatctgcaacagccactttgctgcgttgtggggaattccacccagtccaaacctcctagtctccttagcactgtcaggggaaaacctccaactaaagcctcagtaatgacggtcgcccctccccctgggaactgagttgtcccaggcggactccagactgctgtgccggcagcggggatttcaagccagtggttcttagcttgcggggtttccgtgggagtgggaccctctgagcgagaccacttggctccctggctacagccccctttccacagaagtggacatttctcctgcctcactggagttccaggtgctgccggagtatgtaaaaattcctgcagctcagtgcctgcccaaacagccgccgacgggagcagctgtcattggtctgcccagttttgtatttgagacccagggcactggtggttgtaggctcccgaggggatctgctgatctgtggattgcaaaaatctgtgggaaaagcttagtacccttggtgggtagcactgtccctcaccacttcccttggctggggagggaggtccccctgccctgtgcagttcctgggtgaagcaataccctgcttcttctcgctctctgtgggtcatgccgaccatctagtcagtcccagtgagatgaactgggtatctcagttggaaatgcagaaatcacccacattcctcgttcctctcgctggcagctgcagaccagagctgcttctagtcggcagtcttggcccctccccgccgaggtaagtttaataagtcttctaaatttgtccttgccataatgatcagtgatgatctgtcttttaataagttaaatgctttccagacttcaagactctcacccacatcaaaaataaaattatatatcggccatattaccaggattttagaatgttgtattttatcctctaattataggtcaaataactaaggtagaaaggagtaaagcaacttccatgtatgtagtgaggatgttggggggtctgggactaaaattctgccttgggattcccaagaggttggtgattatgatttttgtactcttagacacaaaataaaataacattctgttttgttcctctgcttaccctattcagttctctaaactacaaaatctctgcttatcaaaataagttggattgtcaatttgttgagctcagcaaatgcatttcc

SEQ ID NO: 462986 - DNA, 1460 bp, Homo sapiens
ccacctgttcagctccgccctgctggacccagtgacgttggtctgtccttacgcagacctggccggaggctggggctccttccggggctgccatgttctctcttccatccctcccctcctggctccccggcctcccctccctcgagtggggctctagcctccttgactccctcctgcaaggcctgatcggggcccttggagtcttggtcctgaacagcctcctgaaagtttacttcttcgtgggctgtgccaatgacccgcagcggcgacccgaaaaggagcggcttcgggcccagtgggcctccctggaaacggtgcacctggcagggctggccctgtttctgacggtcgtggggtcccgggtggctgccctcgtggtgctcgagttctccctccgggccgtgtccacgctgctgtccctgggcaagggctcccagggtgccgccgagaggctgcagctctacctgctgtgccagtactcgctgggctgcgggctgacctgtggcctgagcttcctgcaggagggcgcccctcaccgcacgctgaacctgctgctgagcctcgggctggccacgctgctgggcctgggtgcccggcgcctccaccgccacgtctgccgcctctacgagctgcacagcagccagcgctactgtggggtgtgcctgggcctgctggcccatgcacatggcctcccccagctgctgggccgtgccctggccatagcctttgccgtgggtgacctggcagctgtggccctcatcaaccaggacttcctgaccacctcggaggccatgcggttctggacaccgctcaccatctgctacacgctgctggtcatctacatgcaggaggagcagcggcagcaccccggcctgcagagccaggtgcagacggtgctggtgcgcatgggcggcctcttcgtgctgctgctgactgtgggtcgctggctggacctgctgggcatccttgtctccctactgggcgagctctggtgtctcgtgggcgtccgcaccctgcttgacctctgccagatacaggattttccatcccagaggcctccagtgtcaacaccaagccagcccctgccctcggcaccccagtcccagagttcggccccctcttgacctgcctcagggaggatctggagtctgtctcaagcccactagcctgatctccgaggccttgaccccagggcgatgcctggaggcagagtggcagagctggcctcctgcccagagctcagcacaggccctgggagccccgagaagggaaggcaggatttggggatgggagcctctggagaggggacacctggggacccctggttgaaccctctttttcttggggtgggcaatgatgcagcctctcagacctgccttcctgggcaggggtgggggtgcatcctcaggagggctccccctttactggtctcccttcccttctccatgaacaataaagac

SEQ ID NO: 462987 - DNA, 1732 bp, Homo sapiens
acaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatataataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtgacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtacctacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcagtaagtacactactctgaaatcctagcatgttcatgtctttctaagtaacatagatgacattctaagactcatctatattaattgtggcaaaatgtttatgtcaccttgttttaccaatggacctatttagtttttggtttttcaactgtgtataaatgaatatacaaatttcttgataagtacatagtaaaataaattctcctattaatgggcattagtcaagaatacagtaaaagaatttgaacacaatacttgttggttaaatgaagtcgtattgaagcggcatcattgtctgggtaaatatctgaggttcgttatctcacaccaagaagattaaggac

SEQ ID NO: 462988 - DNA, 958 bp, Homo sapiens
tgccaagtgttgaactacagcaaagagagcaacgtaactggtgtgactagaattctccctgcctgatagtcattgggatagccttcttttcaatgtgtgcaattgttggactcattatcggtttgcatcgcagaaacagagaaacaccaccttggtaaccagtgctgctgtgaggtgagaaaagaacaggacagaactgaagtaacaaccagctctcacagtgagtgattcacatcagcgtaaagtcaagccaagcccctgccaaacaccattctaccctctgcctctgagacagcaagatagagcttaagtagcaaccagctcactcacagtgggtgagtcacatcagcagcatcaagacaagacaaggatgtgtggagtccccctgccatctgagtgaccactcttgcaggaccaggcatcaccatggcctggaaaaaccagcctcagtgccctcagtattttttggttgctccttccctggagtccttcacagcaccagaaactgactcttcctggctccagttctcttctagatcaaagccccacaacctcccagcaacctgtgcatcaataaaggctgccttgctccctgtctacagtgagcagtatgtgcctcccagcctgaagccctcttctgcttcaagaaagtacctatgcagttctctcctgcttctgaacccactgttacaagcctatggacagggagtgagtggcctgtgctcacaacaggtgcacggtccaccactctgcctctggcatccagagacactcaccccagtggtctccatgagttgtgggtctattgaaatagagaggacattcattgcgtccttccacccccggaacctcagtcagttcatgcaaaaataacaaaacctacctgtgttcactgaattactatttagtaccaggccctgtgctagggacatagcatacctcacttctaatccttatt

SEQ ID NO: 462989 - DNA, 685 bp, Homo sapiens
ctcaatagatgttagctattactgtaatcaccgcgagaccagttaatgagagagttcttccttatccttactctatattgaatacaatttgttgcacttcgaaatatctggataaggctatagttgttgtcgtcaccgagaatgcaggagtggcaaagagaaaaatcatgcaaaggcttgctgatagcgttcacagtgacagcccgaaagtgtctactgcagatatttcatcaaataaggatgatgaagaaaactctgtgctcgatatggttgtgttgttttctagcagtgacaagttcactttgaatcaggtgtgtttggtgcagacactgtggagcaacatctgcaggtctaagatgtgaatggcagaacaattacacacagtgcgctccttgtgcaagtttatcttcctgtccagtctgctattgaaactatagagaagaagatcttattctgcaatgaagacaatgtgataggtattgtgctattttttcatctttttaaagcttttctctttgaaatgtagcaaaaaaaaaaaaaggaaaatagcttttccttaatcacaagttttagtattttatagtgtttagtatataaagctttcacttccttcattaaatttgtttctcggtgttttattctttttgatgttattttaagtggaaatgttttcttgatttttttt

SEQ ID NO: 462990 - DNA, 2499 bp, Homo sapiens
tttgcctttcttctccccagtccctggccccacctcttctgccacaaacgtcagcatggtggtatcagccggccctttgtccagcgagaaggcagagatgaacattctagaaatcaatgagaaattgcacccccagctggcagagaagaaacagcagttcagaaacctcaaagagaaatgttttctaactcaactggccggcttcctggccaaccagcagaacaaatacaaatatgaagagtgcaaagatctcataaaatctatgctgaggaatgagcgacagttcaaggaggagaagcttgcagagcagctcaagcaagctgaggagctcaggcaatataaagtcctggttcacactcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcagctctcattggctcatcctctcatgttgaatgggaggatgctgtacacattattccagaaaatgaaagtgatgatgaggaagaggaagaaaaagggccagtgtctcccagctcagagaagtttgttattaccgactttctgaagcctacttctgtcagctcatcaaagtcattctccatcctgctttgttccattgctggcgaggagctgcgatcctttggaggagaagggatgaatctgcaggagtctgaagaggaggaagtcccccaggagtcctgggatgaaggttattcgactctctcaattcctcctgaaatgttggcctcgtacaagtcttacagcagcacatttcactcattagaggaacagcaagtctgcatggctgttgacataggcagtgagtactccattgtgaaggtgataaagctccagttcatggcccagtctcatgccatgcccgtgccaacctggactgactgtcacgatattgaactcaaggcaggacatcggtgggatcaagtgaaaaaggaggaccaagaggcaacaggtcacaggctcagcagggagctgctggatgagaaagggcctgaagtcttgcaggactcactggatagatgttattcaactccttcaggttgccttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggttcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccgtatggaagttccttttatgcattggaggaaaaacatgttggcttttctcttgacgtgggagaaattgaaaagaaggggaaggggaagataagaaggggaagaagatcaaagaagaaaagaagaaggggaagaaaagaaggggaagaagatcaaaacccaccatgccccaggctcaacggcgtgctgatggaagtggaagagcctgaagtcttacaggactcactggatagatgttattcgactccatcaatgtactgtgaactacgtgactcattccagcactacagaagtgtgttttactcatttgaggaacagcacatcagctttgcccttgacatggacaataggttctttactttgacggtgacaagtctctatctggtcttccagatgggagtcatattcccacaataagcagcccttactaagccgagaggtgtcattcctgcaggcaggacctataggcgcctgaagatttgaatgaaactatagttccatttggaagcccagacataggatgggtcagtgggcatggctctattcctattctcagagcatgccagtggcaacctgtgctcagtctgaagacaatggacccacgttaggtgtgacac

SEQ ID NO: 462991 - DNA, 1499 bp, Homo sapiens
caccagcccagccagaagcaagtcccagcccccagccctcccctggcctaccttttggggcccttctctgaaccaggctcccctgtcctgcaactctgtcattcacagggatgatccaggctctggctggattctttacctactttgtaatcctggctgagaatggttttaggcctgttgatctgctgggcatccgcctccactgggaagataaatacttgaatgacctggaggacagctacggacagcagtggacctatgagcaacgaaaagttgtggagttcacatgccaaacggccttttttgtcaccatcgtggttgtgcagtgggcggatctcatcatctccaagactcgccgcaactcacttttccagcagggcatgagaaacaaagtcttaatatttgggatcctggaggagacactcttggctgcatttctgtcctacactccaggcatggacgtggccctgcgaatgtacccactcaagataacctggtggctctgtgccattccctacagtattctcatcttcgtctatgatgaaatcagaaaactcctcatccgtcagcacccggatggctgggtggaaagggagacgtactactaaactcagcagatgaagagcttcatgtgacacaggggtgttgtgagagctgggatggggccagagattataagtttgacacaacatctgagacactaggatgaattatcttggatgagaaagatgggcaatcctgggctggcttgagggaatcatgggcagaggatgaggtgggctgaagggaagcccagcctgcatctagctggagccccgcagggaggggcatggtcctgctgaatcccgtagccagtctagacagtaaatgtctggaaaagccctcaccagctggatgtgtcaaatctgatcttgggggagtggggattactgtgaagctccctccacaggtcttcatgatgaccaggctggggaagtgttttaaggaccagagtcaaggctgggataggatcagtatcaagcatccttgccctttaaagtcactctccgagccactggacagcaaggacagggcaaatgactgcctcaaaattccagctgagatcagagaaatggaaggtgggggagagaggagcagctaagtcacacgtgggaagagggtccacagcatccgcacagggggtaggtggggtggagtcatctgaccccaccttgcagttcctgagaccagcttgcagaccacagcgctgtggtgctagaagagatcagattgcatcagtgaaaagcctgaagtccagagaggttaaatgacttgggaatggccatgtgctgagtgttgtccctcatctgagaaagggacaggtaggaaggacagtctccaggcatactggtggtccctgccctctaccctcggtcatcagggctcctcaaccccattctggccctcggcctgttttctctggtgtagccttgagatagaggctgtaacaagactttctg

SEQ ID NO: 462992 - DNA, 2160 bp, Homo sapiens
acagaaatcaactgacaaatggcagattcataggagaaaagacatacacatttatttgatcatagttttacataacagaggagccttcagatgagaatccaaagatacaagagaaacttcccatttttatgcttaggttcaaagccatatggacagccatgtagaaatatgattgaacatgaagggcatgatctaatactgatggactgagtgaagaagcccagcaagacccatcgtgagattctttttggcctctctgagcagtgttccttttttcttggtatgcaataagacctctctggaatggaggtcttatgatctacaatccagtaaggtggccttttgccccacccccagcatacaatgatggaaatagccaatgtgagttctccagaagtctttgtcctcctgggcttctccacacgaccctcactagaaactgtcctcttcatagttgtcttgagtttttacatggtatcgatcttgggcaatggcatcatcattctggtctcccatacagatgtgcacctccacacacctatgtacttctttcttgccaacctccccttcctggacatgagcttcaccacgagcattgtcccacagctcctggctaacctctggggaccacagaaaaccataagctatggagggtgtgtggtccagttctatatctcccattggctgggggcaaccgagtgtgtcctgctggccaccatgtcctatgaccgctacgctgccatctgcaggccactccattacactgtcattatgcatccacagctttgccttgggctagctttggcctcctggctggggggtctgaccaccagcatggtgggctccacgctcaccatgctcctaccgctgtgtgggaacaattgcatcgaccacttcttttgcgagatgcccctcattatgcaactggcttgtgtggataccagcctcaatgagatggagatgtacctggccagctttgtctttgttgtcctgcctctggggctcatcctggtctcttacggccacattgcccgggccgtgttgaagatcaggtcagcagaagggcggagaaaggcattcaacacctgttcttcccacgtggctgtggtgtctctgttttacgggagcatcatcttcatgtatctccagccagccaagagcacctcccatgagcagggcaagttcatagctctgttctacaccgtagtcactcctgcgctgaacccacttatttacaccctgaggaacacggaggtgaagagcgccctccggcacatggacgctccgtggataataaactttgacgacgctgagagcgcgcggggagaccggagccggcctgttccccagagcccccggagccctcccagccctcaggcctgcgcctggggtgagctgagcccgggactccgccttgcaggctccggaaccctcgctgtggctcccccgctcggcccaggccttgaagccgcggcgaacctcttcctaccctacctcggggacctggtggcagcggcggcctcccccagcctggaccccgccggccgcgggtctcccggcccaaccccaccgacccagaccaagaccgcgccgagccgccgggactcagcgccttcgggtggcggcggtaagcggggaggaaacatggcgccgcccaaatgcgcccggaggccgttaggctgtggagggcgaggaaggcggtccagaggcggccggcaggtccacgtcctgggcgaccgctctgtcgcagttgggcgagacctacctagtcctgacgggtcgtatttccaagacattttcatattctatccattgttttgtgtgcattttattacttctgtatatagaggtaacaacgctaagcttttttgagatgtctgtttcttctagatgttctgaagtacctgatacatgttaaaattagaggtagtaaaatgacacattttgtaaataactttttgttaaaattcataggaaatgttattttgtgggggggggatggcatggtgtttgtggactggttcagggaaggaggggaaaagggaggtgcagagagctctaagccagtgtgcttacagtgaggcgagattcaccattgtttcttatgattgtgcattttgttttacttatctatgtatacagtgtatctaaaggacaaac

SEQ ID NO: 462993 - DNA, 1812 bp, Homo sapiens
tttctgcagctggcttggatttctcccaagaaaatgggatgagtgctctgtgctaggggtccaaaccacgccatggttcctgtggactctccagggcctggagacagcaaagatggcatcccactcttctcactgggagctttgtctcagtcagctctggtccacagcaggtcaagaaatgccatccaagagtcaagtcttggaatcaggggcctaaagagcccatttagtgctctacccccttcccccactgtggccatgccgggcctaggggttcttcagttagcatgtgatgaatgctgccaggaccgagtcctacccttcaaggcaacagattctcttctggccaagggtgtgtctagaaatgtcatccaggagttaattgatataggagagagtatagctattccagatgaatttaccgaacaagaaaagcagtctggagattggtggaagcgtttggtgtcagcaggaatagctagtgcggttgcacggacatgcacggcacctttagaccgcttgaaatataagaaattgcttagttttgatggtgttcatttaggaattcttgaaagatttatatttggctcattggctggtgtaactgcccagacctgtatttaccccatggaggtactaaagaccagactggctataggtaaaactggagagtattcagggattattgattgtggcaagaagcttctaaaacaagaaggtgtcagatcctttttcaaaggttatactcctaacttgctaggcattgtaccttatgccggcatagatcttgctgtttatgagattttgaagaatttttggctagaaaattatgcaggaaactctgtgaatcctgggataatgattttggtgggatgtagtacattgtctaatacttgtggtcagttagccagtttctctgtgaaccttattagaactcgcatgcaggcttcagccccagtggaaaaaggaaaaacaacttctatgattcagctcattcaagaaatatataccaaagaaggaaaattgggattttacaggggtttcacctcaaacatcataaaggtgcttcctgcagtaggcgttggctgtgtggcctatgagaaagtgaagccactttttggattaacctggaagtgatatataaaattgttgtcattgtaatcacttaattgtaagataatacctgtgttataaagagatgttatcttttcctaagaggaaagaaatgtcagataattgttaaaatattttttcattattacaaaatacataaattaaataataatttttataaagttcttgaataagttaaaatatttaatatccaaagaatactatttacattttctactactctcccttgaatcctaatttaaaatttgttcttgatttgatttgaatgtaacataaaacatttggtcagttataggagtttatctttgaaaacgtttttacatttgaaaacttattttaaaaaagctgagcttgaaaatgctttatacactaacagaaaaatcagtgcatttaaaattgatgttatagcaaataatttggagtctgtttcttttacttaagcaaaatggaaaattggtttctaattccttctatcacattttagatggaataacgataacatctttcttacatctccgggcctttttatttgtaaatgtgaacactgttggttcattttaattcttgatattttcagcttatataaggaagttggcattgataacaaatccaacactggacaaattttatttatcttctggttgaaaacattcaagtgaaagaattttatatattaaa

SEQ ID NO: 462994 - DNA, 927 bp, Homo sapiens
  misc_feature (826)..(826): n is a, c, g, or t
  misc_feature (865)..(865): n is a, c, g, or t
  misc_feature (873)..(873): n is a, c, g, or t
  misc_feature (875)..(875): n is a, c, g, or t
  misc_feature (877)..(877): n is a, c, g, or t
catggatagtgatggatcaatgacagtagactgggatgaatggaagtactactttttactgcatcctgcaacaaatatcactgaaatgattcatttctggaagcattctactggagcatcccgtggcctggaacagagctctggggactggcatccttccactgactttgatgctgatgacagccctgatcgtgtgattcagctggccttaacccgacccacgtgcacgtattcctcagcacatctagagctgaagtcgagagcctctgtgggaacgcttggcagcccatgctgttctaaggctggagcagaatttcttagtctattccaggtagacaggcctgcagggggtccaacccctacaggcccctctgtctggaatagactgctttcatctctgatgttagaaagcagacctgtttcagggtttggggaaggttgttcgatatgaactgggtcctctctaattatttttactgtatgtgtgacttcttcctagaaagaatggaagaatgtttatgttagaacattttatctattctttgtcaattgttgtttgtctgcaattttaaagtagataaaggatagctcaatgtaaatatattcttaataattaactattggttgatgtccactggccatgagatcatattcacttctacatatgatctattacttaggaattatcctgctcctgatgagaaaacagactcagaaagattacaaaattacctaggccacaagtctagtggggagaagacatagcaacttagaaacctagtttcttttgggcttcaaagctaacctcataccattagattggacngacatgacaatactttcgctataatatagtctcagagtnggggtccngntngtgttccaggaaaccggtgtccttatatattccaactctaatgccaacct

SEQ ID NO: 462995 - DNA, 1369 bp, Homo sapiens
cgttttcggcgtgcggggggttgcgccgacacttgaccataaatgtctaaaaatcactcaacttatctacaaacatgcttcatataagaaattgcttagttttgatggtgttcatttaggaattcttgaaagatttatatttggctcattggctggtgtaactgcccagacctgtatttaccccatggaggtactaaagaccagactggctataggtaaaactggagagtattcagggattattgattgtggcaagaagcttctaaaacaagaaggtgtcagatcctttttcaaaggttatactcctaacttgctaggcattgtaccttatgccggcatagatcttgctgtttatgagattttgaagaatttttggctagaaaattatgcaggaaactctgtgaatcctgggataatgattttggtgggatgtagtacattgtctaatacttgtggtcagttagccagtttctctgtgaaccttattagaactcgcatgcaggcttcagccccagtggaaaaaggaaaaacaacttctatgattcagctcattcaagaaatatataccaaagaaggaaaattgggattttacaggggtttcacctcaaacatcataaaggtgcttcctgcagtaggcgttggctgtgtggcctatgagaaagtgaagccactttttggattaacctggaagtgatatataaaattgttgtcattgtaatcacttaattgtaagataatacctgtgttataaagagatgttatcttttcctaagaggaaagaaatgtcagataattgttaaaatattttttcattattacaaaatacataaattaaataataatttttataaagttcttgaataagttaaaatatttaatatccaaagaatactatttacattttctactactctcccttgaatcctaatttaaaatttgttcttgatttgatttgaatgtaacataaaacatttggtcagttataggagtttatctttgaaaacgtttttacatttgaaaacttattttaaaaaagctgagcttgaaaatgctttatacactaacagaaaaatcagtgcatttaaaattgatgttatagcaaataatttggagtctgtttcttttacttaagcaaaatggaaaattggtttctaattccttctatcacattttagatggaataacgataacatctttcttacatctccgggcctttttatttgtaaatgtgaacactgttggttcattttaattcttgatattttcagcttatataaggaagttggcattgataacaaatccaacactggacaaattttatttatcttctggttgaaaacattcaagtgaaagaattttatatattaaa

SEQ ID NO: 462996 - DNA, 1400 bp, Homo sapiens
catggatagtgatggatcaatgacagtagactgggatgaatggaagtactactttttactgcatcctgcaacaaatatcactgaaatgattcatttctggaagcattctactgtataagaaattgcttagttttgatggtgttcatttaggaattcttgaaagatttatatttggctcattggctggtgtaactgcccagacctgtatttaccccatggaggtactaaagaccagactggctataggtaaaactggagagtattcagggattattgattgtggcaagaagcttctaaaacaagaaggtgtcagatcctttttcaaaggttatactcctaacttgctaggcattgtaccttatgccggcatagatcttgctgtttatgagattttgaagaatttttggctagaaaattatgcaggaaactctgtgaatcctgggataatgattttggtgggatgtagtacattgtctaatacttgtggtcagttagccagtttctctgtgaaccttattagaactcgcatgcaggcttcagccccagtggaaaaaggaaaaacaacttctatgattcagctcattcaagaaatatataccaaagaaggaaaattgggattttacaggggtttcacctcaaacatcataaaggtgcttcctgcagtaggcgttggctgtgtggcctatgagaaagtgaagccactttttggattaacctggaagtgatatataaaattgttgtcattgtaatcacttaattgtaagataatacctgtgttataaagagatgttatcttttcctaagaggaaagaaatgtcagataattgttaaaatattttttcattattacaaaatacataaattaaataataatttttataaagttcttgaataagttaaaatatttaatatccaaagaatactatttacattttctactactctcccttgaatcctaatttaaaatttgttcttgatttgatttgaatgtaacataaaacatttggtcagttataggagtttatctttgaaaacgtttttacatttgaaaacttattttaaaaaagctgagcttgaaaatgctttatacactaacagaaaaatcagtgcatttaaaattgatgttatagcaaataatttggagtctgtttcttttacttaagcaaaatggaaaattggtttctaattccttctatcacattttagatggaataacgataacatctttcttacatctccgggcctttttatttgtaaatgtgaacactgttggttcattttaattcttgatattttcagcttatataaggaagttggcattgataacaaatccaacactggacaaattttatttatcttctggttgaaaacattcaagtgaaagaattttatatattaaa

SEQ ID NO: 462997 - DNA, 1323 bp, Homo sapiens
gcaaaagttcaagaggcactcagcctgccaaagagatgcggagcccgcacacccaggtcctgaagagcaagctggaagaggtggtggtgtcctcccaggaccagcagattgtggccctggtgctgacccgtctcaagaaggcccagaggatacgggagctgcagcagcaggcggctaaggcctgggaggagctgaagcgctcggatcagaaggtccagatgaccctggagcgggagcgccggctgctgctgcggcagagccaggagcagtggcaggagaaggagcagcgcaagaccctccagagccctgagcagcgcggcctgcggcgggacagccagaggaagaacgtgcccccgggggaaagccggtggaaggagcaaccagaggaccaggagagcccgcgccaggagaagctggagaaggcgcgcgcccaggcagagcaccgaaaacagtgccaggtgcggcgcctgcgggagcaggagaagatgctacggaacctccgggagcagcacagcctgcagctgcagaggaggctggtggaagcctgtcgcaagaggcacctacatgccgtggagggccagaagaaggtccaggacaccaacctgagctccctcatcaattaccaggcccggaaggtcctcatggactgccaggccaaggctgaggagctccttaggcagctgtccctggaacaaagtttccagcggtcccaggagatacaccagggcctgaggaaggagcggcaacgcgagctgagggagaaggcccagaaggaggaagagcagttgcagcaggccaggtggcgcgcaggggagtcagaggaacagaggaagatgcgcaaaagaattctggtggagctggcggatgagaagatccgacaggccaggagtcacgtgcacaagaccactagggacaaggtgcagcacctccgggagctcaaccacctgagggagaaaaaccaccacatcctgaaactgaaagccgagaaggaggaaaagtgtcacattgagggcatcaaggaggccattaagaaaaaggagcagagggtgcagcacatttcccaagggaaagacccaaacttccaggagttccagaagctccctcaggcctccaggagagaggagagagcgcctcccaacagctcccttgatcagatggtactagaggcccagctccgtgcctgtcagcagaacaggggttactgagaaccaaggacgcctggcttacagtgcgcagccagaaggagatgtggcaatgtgattccttttgtaatctgattataattgaacattgattttaaaaaagcatgtaaaatagctgcaa

SEQ ID NO: 462998 - DNA, 825 bp, Homo sapiens
ccagggggaaaagggacacaggaggcagccgcagagccccagcccctcagttagcagggtgcctactggggccacagtttctacttgtgttcttgatgagccttcccagtctgcaggggagggctcctctgcggatggtcctgtgggtgccatctgagcagcacaaggtagatgcatgcaggaccctgcccccaaggactgagtgtgcacgtggaggcaggcgggcagccgtgggcacacgtgcctcccgtgatgagcaggagctgctggagtcagaccccgagtccattggccgccactttgcttccaacagcagctcagtggcagccgcgatcctggtgcctttcatcgccctcattattgcgggcttcgtgctctatctctacaagcacaggagaagacccaaagttcctttcaatggctatgctggccacgagaacaccaatgttcgggccacatttgagaacccaatgtacgaccgcaacatccagcccacagacatcatggccagcgaggcggagttcacagtcagcacagtgtgcacagcagtatagccacccggcctggccgccaccaccgccaccgagagccccgcctccagcagccgttccccagggggcaggaagtaggctcccctgagcacagtgcccagtgcccatcttcgttcgtctccttgcctgtgtctgctactgctgggactcaggccctcgccctgccgccatctatgccagttaccctggagaggactcctgccgtgtcctgaaaaggcagaaaaggaagaggggctgcagacagaggaagaaagtttatggatttaaaatagca

SEQ ID NO: 462999 - DNA, 637 bp, Homo sapiens
gagatggtcgcatgaccttgagtgagtcaattaacctttctgggcctcattttctgtctgtgtctgtaaatggaaagacttcagctggatcactgtttacccaattgtgctttgtgatgcagatgttaatggatggggtctctggtgaaataagttcagcaaacccaggttcaacacctgttttctcgataggacttcttagagcttctcctgtgcatgatgcatctccagtgcgagaagattctgtatcatttcccaatgccattcactttgtgaaccttgtttggtggaattcctgttactgtttcactggagtccacagtcactacttgagaaactcaaatctaactgatctggaagtctttacaatattctgttctaaagcatgggttgctataagcaaaatcttttgtgaaaaacactgttctaggctccagtttaaataagttctgtgttatggaaaatgggttatgtgaggactttggaatttccttctgtaaaatatcactcaccattcattataattacgtactatgctctaggcattgttctagatgctgggaatatagttgtcaatcaaattctctgctctcttggaacatttatgtgagctgtgggagagataagccaataaaga

SEQ ID NO: 463000 - DNA, 1529 bp, Homo sapiens
aaggggtctttgtgttctcaaccttctgccgcaatcccaagtggaagctctgttggctcgccctctagtcctcttcctgctgagccagtcttcaactaggaatcacaccagagtcaccaggacaaggaaagctaggcccatctgaaggagattctgggcagtgtggtctcagagggcacagtctttctggagtcccgtctctggttaaaaggtttggaaggctcgccacatgaaggaattactgctggatgagagatgctggagctttggactgaccagggactctggccagacctaggctggcccagggacttaaggcccaagggaacataaatgaacaagtgctgttcaagggagccactcacccatctttttctgtggattcgttcctgctgggaacataccaaacacgaaggaaaggggaaactatcttcattttagataaagaactgcacgacttaaactttatttctccataccattctctttgatcttaggacctgaaagatgaaaagaggccatccatgggaacgctggcaggaggagcattgtaggcagaggcagtgcaagtacaaaggccctgcaaggcaaagggcttgccatattatggaaggactgacagtagccctgtacagccacggcgtcagaccctgggaaagtatccagtatcagtcccagtcattgcttaatcatactgggggtcagtcccagtcattgcttaatcatactgggggtcagtcccagtcattgcttaatcatactgggggttcatccaaatgggaggcaatggcaaaagactggaaggtaggagaaagggtgcttcaggtgatatctccagcagtcactgtgcctcctccgtggctgcagctcctactggacattccttccctccggggtcctagcacccactggcagtcccagttgtggtgctagttcccttgattcacttgacaattcattgtggaatcgtgcttctgtattttcaccttttgatcttactgcttctcttttctactaaaatggagaatttcttaaagataggaactatatattatttctctttttatctttagcccgtagcatataatagaggaccactcaatataaagactcaataaattattatattcaaagaaatgacagtaattattcataattagtatctatgaatacattgcacctaggggcactatagtattttagagcttttgattgaaatacaaactgagaatacatgtatttttgtttaatgatatttatcaacattattgtttgtaggttatttctattatgcctataaattatgtttttacattttagaaattcaaaaaaactttatgaagatattatttattagcaaaacatccattcaaagattaatgttttgttattttggacatagatatcaaacctaggtgaatgttaatttgtgactgatagtatgacaacatacacatgaaccgatgtttgacacttgctgtgtctttgataagtcaatataatttgagaggcagtattatgtaatggtg

SEQ ID NO: 463001 - DNA, 1429 bp, Homo sapiens
tttgcagatgtttaaagctgattgctcttttaagggattttcatgggttgctctgagactcttccttttccccacctttctgcagccttaggtatccagcagcagttcatctccagctttcctgtattgaggctcctcactcctgcaggaggtcattataaacacgggctaagcaacaccacacaactccctttccctcatgggccacatctggtccataggaaacatgtttgtccaggaaaactctgggaatgcagccccttccccataactcagcactctggatttagatttctcaagcatgaaccagtcagaagtcccctgtgtccctcaaactttagaagacacatattaagctccacggatggttccataaaagatagaattcttggaacccaatacttccctccacagaaatccttttcaaaagtcttcctgatctccaattcagcatccctttacgccatcagtgtgggtaatcatttaagaaatgaggtgattattcaagtagaaagaaaaacatcgctaacaatgttggcagccatctttggagaccacttgccgtaactgcatggaatgccaacccccaaaggatgcttttgtgaggacaaaagtgagcaggtggtgacggtaaaagatacagagattcctccctggagagcaatagaaatcaggaggcagtggtctcgatgaaaaccagcagaagtgaatagggacccatgtactagttgaatccatgtatttccaacatggtgcgacgtgtatgtggtagcagtggacccaaacaccacagaaaacttggggcagccacacaatggtgttatttcagtctataacaatgttccataaccacctttttttttacttaatatgtcatacattttccatgttattaaatgtctatgtgtgatttaaatcatttatattatgttaaataaagcatatagattctgagataagtactaatactttcattttaaagatgggcaaactgatgtgcagaaagtttaaaaacgtctaccattcccacaactagtaagtgaggggctcatattgaaatccagtcggggctgactccaaaagccaggattttctcactacactatgttgatcctcagggcataaaaaaaccaggcccagcacataccctctacttttgatatctggcagaaggcctggggagcgaggtgtctgtatgagaaagcagagtggtcgaaatacagcccctaccaccatcttcttgaaatcgttctattattttgcagttaacaagctgatggcaatttaaattcagttcaggtgtttaaatactagacactgggaacacacagataaacagggatgccagtttaaacagctgtatctgcttcaacacatttcagaagcaggagcaacagggagaccaaattaaggcctggcaccttgtgtg

SEQ ID NO: 463002 - DNA, 479 bp, Homo sapiens
tttgcattgagagcctaggctcaactttcctaggctccctggtacagccctccctttccacccctcaggctgtttccctccctgttttcctcagaagaagagttccaaacaaaagatctactaccctgagaagcggtgaagtgctcctggggcccaccaaggccacacaagtcaaggagtggatggccttgccccagctatggctcagatcacctttgcaggatgacatcttgttgggagatggtcatcagagacagggccatggaagacgctgtcaggaggaggcacagaggaaaggctatgggagcacaaagcaagaaagtggccttctgcaagccaggaagagaggcctccccagaaaccaactctaccagcacattgatcttggacttttggcctctagaacattgagaaaataaaagtctgctgttaaaccacccaacctttggtatctttctatggcagcctgagctgactaa

SEQ ID NO: 463003 - DNA, 349 bp, Homo sapiens
acgcgtgaagccgtgttcacgaggcgagcagcgaagacagagactcacgcacagatctggattttcatctggtattggattccttctgcccggaagactcctttgacgtttctgtagtgtgggtcagctggtagtgaattcggtcagcttatgaactcaaaagaggtgtaggaggagagaagctcaattatcaccctggtctcctggagtatcccaggcacagtcccaagagttcagcttttcatactcgagttcctgcgtacagtgtgagcctgtggaaagctctcgcctcgcttgatgatgtcttctctttgcctccctgatgcttgggtcctcccataccctttct

SEQ ID NO: 463004 - DNA, 1079 bp, Homo sapiens
tctctctctctctctctctctctctctctctctctctcgacggaatctggattttcatctggtattggattccttctgcccggaagactcctttgacgtttctgtagtgtgggtcagctggtagtgaattcggtcagcttatgaactcaaaagaggtgtaggaggagagaagctcaattatcaccctggtctcctggagtatcccaggcacagtcccaagagttcagcttttcatactcgagttcctgggtcctgaaggcctttttggggaaagtactgatgttcgtgtcaaggttgggaagaaagggtttgggaggaaccaagcaacagggaggcaaagagaagacatcaacaagcgaggcaagaactttccacaggctcacactggatacaggaccagagacaagaagctggagactgtctttgaagcagccagtgggtctgcttggtctctgcgtttctacgtatttggccctaaaaccggcgcgacttttatcgtctctgctgtcggatccctgcaatacaaagaggcctgaggaggacactctgaagaggaaagccccgcgatcatccggtttcacccctgttttcatctactcttttcctcagcgaagcctatatgggttcccgatgtcacatcgcagctaccgcattggagggttaagagccgctgacaaatctctttcgggaagggaagaagagttccaaacaaaagatctactaccctgagaagcggtgaagtgctcctggggcccaccaaggccacacaagtcaaggagtggatggccttgccccagctatggctcagatcacctttgcaggatgacatcttgttgggagatggtcatcagagacagggccatggaagacgctgtcaggaggaggcacagaggaaaggctatgggagcacaaagcaagaaagtggccttctgcaagccaggaagagaggcctccccagaaaccaactctaccagcacattgatcttggacttttggcctctagaacattgagaaaataaaagtctgctgttaaaccacccaacctttggtatctttctatggcagcctgagctgactaa

SEQ ID NO: 463005 - DNA, 9701 bp, Homo sapiens
agccgccgccgccgccgccgcctcgggaagcttgccacccgctaggagggaagatgaaggagatttgcaggatctgtgcccgagagctgtgtggaaaccagcggcgctggatcttccacacggcgtccaagctcaatctccaggttctgctttcgcacgtcttgggcaaggatgtcccccccgatggcaaagccgagttcgcttgcagcaagtgtgctttcatgcttgatcgaatctatcgattcgacacagttattgcccggattgaagcgctttctattgagcgcttgcaaaagctgctactggagaaggatcgcctcaagttctgcattgccagtatgtatcggaagaataacgatgactctggcgtggagatcaaggcggggaatgggacggttgacatgtccgtcttacccgatgcgagatactctacactgctccaggaggacttcgcctattcagggtttgagtgctgggtggagaatgaggatcagatccaggagccacacagctgccatggttcagaaggccctggaaaccgacccaggagatgccgtggttgtgccgctttgcgggttgctgattctgactatgaagccatttgtaaggtacctcgaaaggtggccagaagtatctcctgcggcccttctagcaggtggtcgaccagcatttgcactgaagaaccagcgttgtctgaggttgggccacccgacttagcaagcacaaaggtacccccagatggagaaagcatggaggaagagacgcctggttcctctgtggaatctttggatgcaagcgtccaggctagccctccacaacaggaagatgaggagactgagagaagtgcaaaggaacttggaaagtgtgactgttgttcagatgatcaggctccgcagcatgggtgtaatcacaagctggaattagctcttagcatgattaaaggtcttgattataagcccatccagagcccccgagggagcaggcttccgattccagtgaaatccagcctacctggagccaagcctggccctagcatgacagatggagttagttccggtttccttaacaggtctttgaaacccctttacaagacacctgtgagttatcccttggagctttcagacctgcaggagctgtgggatgatctctgtgaagattatttgcctctccgggtccagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagttgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagtattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacgtgataaagctgttgctctggagcgggctatagatgaaaaattctctgctctagaagagaaagaaaaagaactgcgccagcttcgtcttgctggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagccctgccggctagggagaatttcttccccatgtatatggagaaaggaagaaatcagagtcagcgggcaaaaagagtataatttaacctgctgtctggaagccatctgtgaagggaatcacttttcttttctggacttgtttccaggtgcagctgcaggggatgacaccgaagatacaagcactgagttcactgacagtattgaggaggaggctgcacaccatagtcaccagcaagaaaatggtcccttaaaggtagattttgagcttctccttgttatgtccttggaaggtaaatttttgcctgacaccaagttcccttcctactccaagcattcatatgcttttcctaacagacacatcccaccttgtctttcttccaagcttgtcaaggtggctttggagaaaagtctggcaactgtggagacccagaacccatctttttcccctccttctccgatgggaggggacagtaacaggtgtcttcaggaagaaatgctccacctgagggctgagatccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaaacaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccatcgaaagaataaacacagaactggttggttcccctgggaagcaccaacaccaagaggaggggaatgtgactgtgaggcctttccccagaccccagagccttgaccttggggctaccttcacagtggatgcccaccaagctaacgagctggagaaatacagagttatgcttagtgaatccttggtgaagcaggacagcaagcagatccaggtggacttccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcgaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccagaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccagcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccgtgccttgtctgactcccaccgctctcccagcagcacctctttcctgtctgatgagctggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaagcccattcaggtaccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatctggaacctgcgccagcgcctggaggagtccatctgcatcaatgactgcctacgggagcaactggaacaccggctgacctctactgctcgtggaaggggatccacttctaacttctacagtcagggcctggagtccatacctcagctctgcaatgagaacagagtcctcagggaagaaaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccaggtaagaggggacccattgacagagaaggtagcattcttcattcttacattcattcttacattacaagaggaagggatattggcaagacaattgatgtcctcttttggaaacctaaatgttccctctgctattcctgatttttgtgtgtcagtggggtggggggaggggcgctttgagcagaagaaaggacttctctgggaatgccttgtcactcccaagttgagagagtaaaactctgttatagaagtcttcagtatatcagagacatgaaaaaagaagggttcccatgcttccaattagatataggacattagtctcaccatcacctaggaagcttctatactggctgtgatgcttggtcccagcataagccctgtaactgcttgtcagaatgcaaacagcactgtaggaacagtaaggagactgtgctggtgtgtctgttctgctctgaactaatgtaggtaatggtgtgttttcaagcaaagttacttgacctccctcagcctccatttccatatctgcaaaataaaagtgatagtcttcatgaccccctgagttgacatctggggctcagatgtaaccctaactgtaaccctttatgaccctctgagttgacatctggctctcagcttgttgctctggtgtggctgagtagctctgccatctcagtgggccttgcctctccctggtcagactgcagcacaagctggttctcctgcagcaacagtgtgaagagaaacagcagctctttgagtccctccagtcagagctacaaatctacgaggcactttatggcaattccaagaaggggctgaaaggtatgtgttcttctcccctcaccccatgagctttttgcccttgcataggatgctagtgaggtctttcctttgggagttgtggagatcatgggaagctacagagttctgtcgcagaaacccccacccgagcctggggctcccagtaggagctctcaaacacaaagcccaacgggacaggttggtggcacgagcaagatccggcctgatcattcctaattactttaagaaaatctagacattcctatcaatgtctagattgtaacatttttgaaagcaaaagaactgtcctaatgatatcatcatttgaaaaggcctttaatattgttggtaatacatactgacaacccattcagcccaatgtagcaggcagtctgctcccaccctgaccctttccgtagtgacatctggctctcagcttattgccctttcatgtaattttcataaatcctgatttagtttcctgattttctaaagagaaggtgaactggaatttgaagaaatacaggggcttaccaggctgggcgaatagcttaagtacaaagtcatggtgagtgttgagtcagtggggaccagcctgcccacaggagaaaattaaaagacacaaaaacaaaaacaaaaaaaccttatagaaataccactaataggacctaaatttcaatcctggatttaaatattaaggacatttattgaagactttgctgcctgctgaaataataatctaatatttgagaattttgatatatttcttcattctttaaatggagaagggtattcaaaacataatgtgaataagtcacagcaggctggaacagaggacgacatcaatgtcgtgaaatttagcaaagataaaaagcaaaatcctgagctcgattaaaaatatcagtggtagaaatataggttgagggtagaaatataggacaggcagccattcatggacatgagggtttggggtttggtagaaacatgttcacacaagtaaggtgtaggacaaaggttgctagaaatgccagctcaaactggaactacagtagtgactcatttcaaagctacaaccactaaagctccataatctcttatctgtaatttcaaaatccagtaagatttccaaattaaatttttcaaatactcatttagtgacaaaatctagatgatctgacatgaggatattcataagtctttatttatctatttagaatattcacatagctcattgcggaaatagttatatttggagcaaactgaggatatcattatgaataacagaagattcagttgtgttgtcattttctttttcaggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggcattcatgagcttcggagcagcaccagtgccctgcaccatgccctagaggagaagtgctttgaagaaaaacttgaggtatatgaaatggttaaaaatcagaaactaaaccttttaacatggacatcaaagctttgccataagcaattcagcatattcctagaaatgtttctaatccataacctgagagaatgttgatctccatagtgtgaaaatgacttgggccagtttaacttgctcttttttttattttttcactaattcccttttgtttttctctgataattcttctctttcctgagcctctttagagcagcacttacaggattgcctctgtaaagccttattcctgtcccagaaaaggtgaaatccctaagggctctgccgtgtactccagccttgtgacccttgccttccaggaaccatgcaagaagcgcagccaccagaagtccttaaaacagcaggaaaggtgagcctgtcccccttttgtgcagctacctatctgctgaggagcatctgggcctcattcctccaagtccactggagggtccagaagagggagtcagagatgtatcctggtggagctgggagaaaggcagaaagcctttgtgacagctatggaataccgttagccaaggtccacttggcccagcactaagcaaaagatgcgtagtttgcacagaaggttttgtgatactgcctctcaacagccccagcagcttgggaactagcaagagcacatttcttgcctcatcagctgtcctgagatggaaaactcagtggatataggaccctgattccgatgaaaggggcacgtggtcccaatgctggagctcctctggcaggttctaaaagcacactacggagcagcggtgccctgccggacactgctggcgggggctcagtgagcactactcacagatccacacctgaccctgttgggtcgagtcaggctgggctttggtctgcactgtagcacctgtgttctttgagttcacatcatgaatgtggtgatttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccacatattgaaggccaacataactggtggacagggtgggtgacagaaaatgaaagtctttttggtgattgtttaagcaagatgtgtataaagaaataaatagtttttctttcactgctttgtttcccatttctgcaccaatcccttgacagtataaagaactggaaagagaaaatgggaaagacaaactgtgtttaagaagcatatagtctaatgcttgaactgtaactttaaaagattaaggttttccttctttgtcattttgatttcctttttatcactggttttgatggatttgattaaggcgttccttggtgaagttttcttcatgtttcttgttcttagaataatcatatttctgtaatatttgaagtttatggtttccatggagcttctaaatctttcatccagtatgttttaaatatctttgtctctcttctccactacacgcccttcagggattccatttagccctatactggggggtttaaagttttgatgccaatggtctttttatgttttcaagtcatttgttactgtgtgtttcatttatgttagtttcaacttctattccttctagttcaataatcttctcttctgcaatgtttaatccactgccttcttccatttcagactgtaaatcatactttttatctacagaatttgatatttaaaaaatctt

SEQ ID NO: 463006 - DNA, 6296 bp, Homo sapiens
tagaggatccacagagatcgctgtatcggggggaaacacctagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcgaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccagaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccagcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccgtgccttgtctgactcccaccgctctcccagcagcacctctttcctgtctgatgagctggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaagcccattcaggtaccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatctggaacctgcgccagcgcctggaggagtccatctgcatcaatgactgcctacgggagcaactggaacaccggctgacctctactgctcgtggaaggggatccacttctaacttctacagtcagggcctggagtccatacctcagctctgcaatgagaacagagtcctcagggaagaaaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccaggtaagaggggacccattgacagagaaggtagcattcttcattcttacattcattcttacattacaagaggaagggatattggcaagacaattgatgtcctcttttggaaacctaaatgttccctctgctattcctgatttttgtgtgtcagtggggtggggggaggggcgctttgagcagaagaaaggacttctctgggaatgccttgtcactcccaagttgagagagtaaaactctgttatagaagtcttcagtatatcagagacatgaaaaaagaagggttcccatgcttccaattagatataggacattagtctcaccatcacctaggaagcttctatactggctgtgatgcttggtcccagcataagccctgtaactgcttgtcagaatgcaaacagcactgtaggaacagtaaggagactgtgctggtgtgtctgttctgctctgaactaatgtaggtaatggtgtgttttcaagcaaagttacttgacctccctcagcctccatttccatatctgcaaaataaaagtgatagtcttcatgaccccctgagttgacatctggggctcagatgtaaccctaactgtaaccctttatgaccctctgagttgacatctggctctcagcttgttgctctggtgtggctgagtagctctgccatctcagtgggccttgcctctccctggtcagactgcagcacaagctggttctcctgcagcaacagtgtgaagagaaacagcagctctttgagtccctccagtcagagctacaaatctacgaggcactttatggcaattccaagaaggggctgaaaggtatgtgttcttctcccctcaccccatgagctttttgcccttgcataggatgctagtgaggtctttcctttgggagttgtggagatcatgggaagctacagagttctgtcgcagaaacccccacccgagcctggggctcccagtaggagctctcaaacacaaagcccaacgggacaggttggtggcacgagcaagatccggcctgatcattcctaattactttaagaaaatctagacattcctatcaatgtctagattgtaacatttttgaaagcaaaagaactgtcctaatgatatcatcatttgaaaaggcctttaatattgttggtaatacatactgacaacccattcagcccaatgtagcaggcagtctgctcccaccctgaccctttccgtagtgacatctggctctcagcttattgccctttcatgtaattttcataaatcctgatttagtttcctgattttctaaagagaaggtgaactggaatttgaagaaatacaggggcttaccaggctgggcgaatagcttaagtacaaagtcatggtgagtgttgagtcagtggggaccagcctgcccacaggagaaaattaaaagacacaaaaacaaaaacaaaaaaaccttatagaaataccactaataggacctaaatttcaatcctggatttaaatattaaggacatttattgaagactttgctgcctgctgaaataataatctaatatttgagaattttgatatatttcttcattctttaaatggagaagggtattcaaaacataatgtgaataagtcacagcaggctggaacagaggacgacatcaatgtcgtgaaatttagcaaagataaaaagcaaaatcctgagctcgattaaaaatatcagtggtagaaatataggttgagggtagaaatataggacaggcagccattcatggacatgagggtttggggtttggtagaaacatgttcacacaagtaaggtgtaggacaaaggttgctagaaatgccagctcaaactggaactacagtagtgactcatttcaaagctacaaccactaaagctccataatctcttatctgtaatttcaaaatccagtaagatttccaaattaaatttttcaaatactcatttagtgacaaaatctagatgatctgacatgaggatattcataagtctttatttatctatttagaatattcacatagctcattgcggaaatagttatatttggagcaaactgaggatatcattatgaataacagaagattcagttgtgttgtcattttctttttcaggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggcattcatgagcttcggagcagcaccagtgccctgcaccatgccctagaggagaagtgctttgaagaaaaacttgaggtatatgaaatggttaaaaatcagaaactaaaccttttaacatggacatcaaagctttgccataagcaattcagcatattcctagaaatgtttctaatccataacctgagagaatgttgatctccatagtgtgaaaatgacttgggccagtttaacttgctcttttttttattttttcactaattcccttttgtttttctctgataattcttctctttcctgagcctctttagagcagcacttacaggattgcctctgtaaagccttattcctgtcccagaaaaggtgaaatccctaagggctctgccgtgtactccagccttgtgacccttgccttccaggaaccatgcaagaagcgcagccaccagaagtccttaaaacagcaggaaaggtgagcctgtcccccttttgtgcagctacctatctgctgaggagcatctgggcctcattcctccaagtccactggagggtccagaagagggagtcagagatgtatcctggtggagctgggagaaaggcagaaagcctttgtgacagctatggaataccgttagccaaggtccacttggcccagcactaagcaaaagatgcgtagtttgcacagaaggttttgtgatactgcctctcaacagccccagcagcttgggaactagcaagagcacatttcttgcctcatcagctgtcctgagatggaaaactcagtggatataggaccctgattccgatgaaaggggcacgtggtcccaatgctggagctcctctggcaggttctaaaagcacactacggagcagcggtgccctgccggacactgctggcgggggctcagtgagcactactcacagatccacacctgaccctgttgggtcgagtcaggctgggctttggtctgcactgtagcacctgtgttctttgagttcacatcatgaatgtggtgatttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccacatattgaaggccaacataactggtggacagggtgggtgacagaaaatgaaagtctttttggtgattgtttaagcaagatgtgtataaagaaataaatagtttttctttcactgctttgtttcccatttctgcaccaatcccttgacagtataaagaactggaaagagaaaatgggaaagacaaactgtgtttaagaagcatatagtctaatgcttgaactgtaactttaaaagattaaggttttccttctttgtcattttgatttcctttttatcactggttttgatggatttgattaaggcgttccttggtgaagttttcttcatgtttcttgttcttagaataatcatatttctgtaatatttgaagtttatggtttccatggagcttctaaatctttcatccagtatgttttaaatatctttgtctctcttctccactacacgcccttcagggattccatttagccctatactggggggtttaaagttttgatgccaatggtctttttatgttttcaagtcatttgttactgtgtgtttcatttatgttagtttcaacttctattccttctagttcaataatcttctcttctgcaatgtttaatccactgccttcttccatttcagactgtaaatcatactttttatctacagaatttgatatttaaaaaatctt

SEQ ID NO: 463007 - DNA, 1968 bp, Homo sapiens
agccatatgcagaagattgaagctggaccctttccttatgccacatgcaaaatcaactcaagatggatcaaagacttaaatcaaaaaacaaacagaaaaacaaaccatccataaacagaaaacctacagaatgggagaacaaattgcaaactatgcacctgacaaaggtctaacacccagcatttataaggaacttaaacaaatttatgagaaaaacaaccccattaaaaagtgggcaaaggacataaacagccatgcagccaacaagcatgtgaaaaaaaattcactatctctgatcattagagaaatgaaaatcaaagccataatgagatactatctcacaccagtcagaatggctattattggaaagccaaaaaacaatagatgctggcaagattgcagagaaaaggcaacacttatacactgttggtgggagtgtaaattcgttcaaccattgtggaaagcagtatggcgattcctcaaaaaagctaaaagcagaactaacattttacccagcaatcccattattgggtatatatccagaggaatataaatcattgtatcataaagacacatgcatgtgaatgttcattgcagcactattcacaatagtaaagacgtgaaatcaacctaaacacccatcaatgacagattggataaagaaaatgtgtaaagaaacttatgaatttcacttgacagatgtttctttataagatttttgcattgcactttttaatttaacaaacaaaacaaaatttctttactttggattctattactcattcgttagagtcagaatctaattacattcgggtatctgctctccataaagacatgtgctgcatgaaaaggtgattctatccccaattgtaggtaataaactctactctggctaagcaaagcatgataattccacttctctcatcagtgattggtttagaaatgggcatgtgacccacatctggccaataagatttaattcacattcctcattatattcatctttacaacaactaccaacagttgcttgaaaattaactcttctatttttgaataaagaaaatgaggcaaaatagtttggcaataaatattaactaataaacagttaactgttgaatatctattgcacacaagatatcagagtaccacagcatgcatgttagagttgttgaacatcaaaagcatctgttaactgacaagtgagaagatgagaggggggatgaatagatgctgacataatgatattatatggagaaaaagtcattttttaaagatcacaaaaggagaagcaggttccaggatgaaccacaaaaacagtaactcaacttctgtcctgggctctttatattaaatctcaccagaaacccattttacaggtgggaaaagcttggtccacctcagccttgggcccatgcttttatatctagtattaacattcattctggatgtgtagaagtctctgccctctttcagacaacagttactgctatggtttgaatgtatgtgtccctccaagatcctcatgttggaatttaaaccccaaggtgatggtattaagaggtgaagccttttggaaagtgattaagtcatgatggctctgccctcaagaatacattagtgctcttataacagaagttgaaggaacccccctagtgccttttgccttctccattccacaatgtgtggatataacattctgccatatgagaatttagcaaaaagacaccatcttgaagaagagacaaccttcgccagacaccaaatctgctggcactgtgctcttggacttccttatcaattaatgattctatggtattttgttatagcaatgggaacagactaagacagttaaagagcgacacacttgcattgagtgtaaaaggagggaaacttacagtccttttaagcagaaaccaagcaagttgctagacagctggctggtacaactggaagatgaggggggtggtg

SEQ ID NO: 463008 - DNA, 1589 bp, Homo sapiens
tggaactaggaaaaaatttgcaaggtttgaaggaatctcttcaagcggaaagacaaagttcccgccaagacttaggataccatttttgatggcacagagcttggtgttccataggccacaaggggttttagacccgggacccaggacatgttccaagactcttttacattatgtcagacaagcaggccctgcctcagcccttctaccgacacagaaagtggaacaacgggtttggtggaaagacccgataacaaaaggttgtgaaacaggacagaatcaacagccaatttgggtgccatcgagatatctaaagccctactatgagccagataacgaggaagaggttttgggaggatcccaaacacccactggtggcagcattgtccaagttgatgctgaggatgacccccaactgtcacgagcaacactcatcgaaagcagccacctacctggggacagatcaagaagctgtcacagatggtggaagaaaacctgaggaaagcaggacaagcagtcacatctgcagatgcggatcctgactcctgcaagaagtagctcactgtgataaagccgcctttgcttttattgccctggtaaaacaaaaagggggacatgctgggaataggccccaagcctggccataaacaagccataagaaaagtcataaacaagatctctgcagcactgtgacatgctcgtgatggttatgatgcacacactggaggttgctggttcaccagaatgagggcaaggaacacctggcccacccagggcggaaaactgctcaaggtgttcctaaaccacaaacaatggcataagcaatctgtgccttaatgacatgctcctgctgcagataacaagccagagcctgtccctttgttctccttaaagaatactttcagttaatctacaaactacagaaacgatgtttatcacaggctgtcaataaataggtgggtcaaactctgttcgaggctctcagctctgaaggctgttagccccctgatcccactttgcactctatttctgtctatgtctttattcctctagtgctgctggattgtggtctccatgaccgacctggtcttggcaaatattacatgccaatgttaataatatttttaaaaaatctttacactataggtatataaaatattctagcaaaaaaaaaagttaatccattatactcaaactgcatttttctggaattacaaagataatataacattggaatgtcaatcagttatctttccacattttaaaaaaacttttatttacttacacatttaaatattaggtatctatcaagggcaagtacagtcagtcctaggtacctgaattttctgagtaaggcaagatcatcaaagaggaatcagggaaaagcattcaataaattcttaagccattcatgggaaagattccctaagcaatgaaaagtagaaaaaaaccttgaccttttaaaaatctacagcaaccaatacagtgattagtaatgatggaaaacatctgccattaggattagaaataaaagtatgcttgttttactacttctagttattattctagtattttctgcctagacaagacat

SEQ ID NO: 463009 - DNA, 1150 bp, Homo sapiens
ttcattgttacctgaaggagatgaagaatcttcgcaaactcgttttctccaggtgccatcattactcttcggacaatgacctcgaggaatggttactcaccaaattcagcctgtgttcctcaggctggaacacctccaattgcttaaagtaaaattgatcaccttcttcagtgggcacctggaacagctgatcagctacgtgctgctgttccgcatcagtcttgaacccctcggagctctgctagagaaaattgctgccactctcaagaccctcatcttcgagggctgtcagatccactactgccaactcagcgccatcctgcctggcctgagccgctgctcccagctcaccaccttctactttggcagaaattgcatgtctacggacaccctgaaggacctgctgcgccacaccagtgggctgagcaagttaagcctggagacgtatcctgcccctgaggagagtttgaattccttgcatgggggtgtctgctcccactgtgtggtccctcctggcacctgctgtaattttggagtggagttggggtcaagcatgtatgctgtggcagcccagatgagcgtgtgcatgctcagtgctggcctttggatgctccttgatgcaagtgacctgggcgccatgggtggtggtgggaggcagacagactcctggatgggaagacgagggtacctggtgaggctctaccttgtgaccaaggggggcctgaagcccgtgggctggtccaccagtgctatggaccagagtgggaatatgtggtgccttttctgtgcctgccaatggctacctatgacccaagcagcacatacttccttccccatgatgccccaacagccccagactcagggaaaacatcaggatgaacagtggcagagtgaaactacccactcttgggatgattttcctgcagacaagcaatccactctggggccttttctctactgagagctgtggagatgatgagatgactttcctggaaagagcagcagacaccactgtgtactccagggacaaacatggaagctgcttttgctgtgcctggttcatttgcagccttgcaaaaatctggcacctgtgctggcacctggagctgcctgccccactgctgtgggagccagtgactgtccaaagtga

SEQ ID NO: 463010 - DNA, 3201 bp, Homo sapiens
attttacccagcccctgttcaagatggagttgctgtggttcacacatctctgacaaaaatacagggctattcggagtcaccagacctggagtttgagtatgctgacacagacaagtgggctgcagagctctcggagctttacagctacacggaagggccagaattcctgatgaatcgaaaatgctttgaggaggacttccggatccatgtgacagacaagaagtggactgagctggataccaaccagcaccggacccatgccatgaggctcctggatggcttggaagtcactgccagggagaagagactcaaggtggctcgagcaattctctatgttgctcaaggcacgtttggggagtgcagctcggaggcagaggtgcagtcctggatgcgctacaacatctttctcctcctggaggtgggcacgttcaatgctttggtggagcttctgaacatggaaatagacaacagtgccgcctgcagcagtgctgtgaggaagcctgccatctccctggctgacagcacagacctcagggtcctgctcaacatcatgtacctgatagtggagaccgttcatcaggagtgtgagggtgacaaggctgagtggaggaccatgcggcagaccttcagagccgagctgggctccccgctgtacaacaatgagccatttgccatcatgctgtttgggatggtgaccaaattttgcagtggtcacgcccctcactttcccatgaagaaagttctcttgctgctctggaagacagtattgtgcacgctaggcggctttgaggagctgcagagcatgaaggctgagaagcgcagcatcctgggcctccccccgcttcctgaggacagcatcaaagtgattcgcaacatgagagcagcctctccaccagcatctgcttcagacttgattgagcagcagcagaaacggggccgccgagagcacaaggctctgataaagcaggacaacctagatgccttcaacgagcgggatccctacaaggctgatgactctcgagaagaggaagaggagaatgatgatgacaacagtctggagggggagacgtttcccctggaacgggatgaagtgatgcctcccccgctacagcacccacagactgacaggctgacttgccccaaagggctcccgtgggctcccaaggtcagagagaaagacattgagatgttccttgagtccagccgcagcaaatttataggttacactctaggcagtgacacgaacacagtggtggggctgcccaggccaatccacgaaagcatcaagactctgaaacagcacaagtacacgtcgattgcagaggtccaggcacagatggaggaggaatacctccgctcccctctctcagggggagaagaagaagttgagcaagtccctgcagaaaccctctaccaaggcttgctccccagcctgcctcagtatatgattgccctcctgaagatcctgttggctgcagcacccacctcaaaagccaaaacagactcaatcaacatcctagcggacgtcttgcctgaggagatgcccaccacagtgttgcagagcatgaagctgggggtggatgtaaaccgccacaaagaggtcattgttaaggccatttctgctgtcctgctgctgctgctcaagcactttaagttgaaccatgtctaccagtttgaatacatggcccagcacctggtgtttgccaactgcattcctttgatcctaaagttcttcaatcaaaacatcatgtcctacatcactgccaagaacagcatttctgtcctggattaccctcactgcgtggtgcatgagctgccagagctgacggcggagagtttggaagcaggtgacagtaaccaattttgctggaggaacctcttttcttgtatcaatctgcttcggatcttgaacaagctgacaaagtggaagcattcaaggacaatgatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatgatcttgatgcccggccttgggacttccaggcagaggagtgtgcccttcgtgccaacattgaacgcttcaacgcccggcgctatgaccgggcccacagcaaccctgacttcctgccagtggacaactgcctgcagagtgtcctgggccaacgggtggacctccctgaggactttcagatgaactatgacctctggttagaaagggaggtcttctccaagcccatttcctgggaagagctgctgcagtgaggctgttggttaggggactgaaatggagagaaaagatgatctgaaggtacctgtgggactgtcctagttcattgctgcagtgctcccatcccccaccaggtggcagcacagccccactgtgtcttccgcagtctgtcctgggcttgggtgagcccagcttgacctccccttggttcccagggtcctgctccgaagcagtcatctctgcctgagatccattcttcctttacttcccccaccctcctctcttggatatggttggttttggctcatttcacaatcagcccaaggctgggaaagctggaatgggatgggaacccctccgccgtgcatctgaatttcaggggtcatgctgatgcctctcgagacatacaaatccttgctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtattctgtgtcatgttggggtttttaatgtgattgtgtattctgtttacattaaaaagaagcaaaaataattcccgttggcttgtctacaggaaatatggcctctacgtatctcctccaggtctagaaagtggttttttctgct

SEQ ID NO: 463011 - DNA, 1507 bp, Homo sapiens
taggctaggtagaggccgggtgttgaatcggccgattcttcaatcaaaacatcatgtcctacatcactgccaagaacagcatttctgtcctggattaccctcactgcgtggtgcatgagctgccagagctgacggcggagagtttggaagcaggtgacagtaaccaattttgctggaggaacctcttttcttgtatcaatctgcttcggatcttgaacaagctgacaaagtggaagcattcaaggacaatgatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatgatcttgatgcccggccttgggacttccaggcagaggagtgtgcccttcgtgccaacattgaacgcttcaacgcccggcgctatgaccgggcccacagcaaccctgacttcctgccagtggacaactgcctgcagagtgtcctgggccaacgggtggacctccctgaggactttcagatgaactatgacctctggttagaaagggaggtcttctccaagcccatttcctgggaagagctgctgcagtgaggctgttggttaggggactgaaatggagagaaaagatgatctgaaggtacctgtgggactgtcctagttcattgctgcagtgctcccatcccccaccaggtggcagcacagccccactgtgtcttccgcagtctgtcctgggcttgggtgagcccagcttgacctccccttggttcccagggtcctgctccgaagcagtcatctctgcctgagatccattcttcctttacttcccccaccctcctctcttggatatggttggttttggctcatttcacaatcagcccaaggctgggaaagctggaatgggatgggaacccctccgccgtgcatctgaatttcaggggtcatgctgatgcctctcgagacatacaaatccttgctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtattctgtgtcatgttggggtttttaatgtgattgtgtattctgtttacattaaaaagaagcaaaaataattcccgttggcttgtctacaggaaatatggcctctacgtatctcctccaggtctagaaagtggttttttctgct

SEQ ID NO: 463012 - DNA, 769 bp, Homo sapiens
agaagcctgctgaaccctgatggttcaaagccagatacatgtagagtgggcttgtggcacatcggtgggggcttttcagaatgtgcatattaggggagaaaaaaaaatcatgtgattaaaattgcacccaaaataccagcgtttcagtttggaatcaaattcatagagcagcagtatgatcttaccacttacatagggtgtaacttatctttctggtcctatggcagtcctgaatttggtgagttaacatgggtccatgccattgtgaggatttttctaggctcaggtgtaactggtttcttgccctgcagtgacagacaagaagtggactgagctggataccaaccagcaccggacccatgccatgaggctcctggatggcttggaagtcactgccagggagaagagactcaaggtggctcgagcaattctctatgttgctcaaggcacgtttggggagtgcagctcggaggcagaggtgcagtcctggatgcgctacaacatctttctcctcctggaggtgggcacgttcaatgctttggtggagcttctgaacatggaaatagagtgagcatttttgagaggctgagtagggaaggggaggctgggatgggaagggggacagagcttgcagaactaactggctttgagagggttaaatggggcagaagttctggtcccaggctgtgttctgaccacctgggttgaataacggagttggtcacttacaccttgaagattaatggagactaatgacaggtccctgcag

SEQ ID NO: 463013 - DNA, 624 bp, Homo sapiens
gagagagcgagaccatctcaatgctgggattagaccacaaggttgccccaggccctgccctcaaagagctcccagtccacctcccagtgcacaggctgagacacgtctagtgcagggttaagaatacagactgagtcaggaacctgcctctgatgcctgggtccaccactttatggatggcaacttaggcaagttactgggtctctctatgctttatttccttgtctgtgaaataggaataataatacctttatagggttataataataaggatgaactgagttattacaagtaaaatgcttggcacattgtttgtgttcagggtttgctgttatcatcattaacatcattatgtacatcactgtttacaggttttcctccagccagctaggaagctggctcaggagattgtattctgggctggggttttatgcttgtactcattatgttaagggagaagaagaagttgagcaagtccctgcagaaaccctctaccaaggcttgctccccagcctgcctcagtatatggtgagtggtgcctgcagtgggacactcccactacactggccttagagcaggccctgccgtcctcctgccacctgcagaccaacaggaggactgctc

SEQ ID NO: 463014 - DNA, 2705 bp, Homo sapiens
ttgaagagtatgtcataggtgcagagttagtgtatctgcactagggtcagtcagcctgcatctccactctttccttgttcctttttctcctttcccttgcggatgtcacggaattctccttgggagtggcttcagtccattgttcaggagttgcctgggtctctataaagacatgggtcatgatgtcatgaatgtttctgagcctgacacaatggtcaggggccagcctgtggacacattgaccctggctctgcttccctgtctgtgatgcagtgcacgctaggcggctttgaggagctgcagagcatgaaggctgagaagcgcagcatcctgggcctccccccgcttcctgaggacagcatcaaagtgattcgcaacatgagagcagcctctccaccagcatctgcttcagacttgattgagcagcagcagaaacggggccgccgagagcacaaggctctgataaagcaggacaacctagatgccttcaacgagcgggatccctacaaggctgatgactctcgagaagaggaagaggagaatgatgatgacaacagtctggagggggagacgtttcccctggaacgggatgaagtgatgcctcccccgctacagcacccacagactgacaggctgacttgccccaaagggctcccgtgggctcccaaggtcagagagaaagacattgagatgttccttgagtccagccgcagcaaatttataggttacactctaggcagtgacacgaacacagtggtggggctgcccaggccaatccacgaaagcatcaagactctgaaacagcacaagtacacgtcgattgcagaggtccaggcacagatggaggaggaatacctccgctcccctctctcagggggagaagaagaagttgagcaagtccctgcagaaaccctctaccaaggcttgctccccagcctgcctcagtatatgattgccctcctgaagatcctgttggctgcagcacccacctcaaaagccaaaacagactcaatcaacatcctagcggacgtcttgcctgaggagatgcccaccacagtgttgcagagcatgaagctgggggtggatgtaaaccgccacaaagaggtcattgttaaggccatttctgctgtcctgctgctgctgctcaagcactttaagttgaaccatgtctaccagtttgaatacatggcccagcacctggtgtttgccaactgcattcctttgatcctaaagttcttcaatcaaaacatcatgtcctacatcactgccaagaacagcatttctgtcctggattaccctcactgcgtggtgcatgagctgccagagctgacggcggagagtttggaagcaggtgacagtaaccaattttgctggaggaacctcttttcttgtatcaatctgcttcggatcttgaacaagctgacaaagtggaagcattcaaggacaatgatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatgatcttgatgcccggccttgggacttccaggcagaggagtgtgcccttcgtgccaacattgaacgcttcaacgcccggcgctatgaccgggcccacagcaaccctgacttcctgccagtggacaactgcctgcagagtgtcctgggccaacgggtggacctccctgaggactttcagatgaactatgacctctggttagaaagggaggtcttctccaagcccatttcctgggaagagctgctgcagtgaggctgttggttaggggactgaaatggagagaaaagatgatctgaaggtacctgtgggactgtcctagttcattgctgcagtgctcccatcccccaccaggtggcagcacagccccactgtgtcttccgcagtctgtcctgggcttgggtgagcccagcttgacctccccttggttcccagggtcctgctccgaagcagtcatctctgcctgagatccattcttcctttacttcccccaccctcctctcttggatatggttggttttggctcatttcacaatcagcccaaggctgggaaagctggaatgggatgggaacccctccgccgtgcatctgaatttcaggggtcatgctgatgcctctcgagacatacaaatccttgctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtattctgtgtcatgttggggtttttaatgtgattgtgtattctgtttacattaaaaagaagcaaaaataattcccgttggcttgtctacaggaaatatggcctctacgtatctcctccaggtctagaaagtggttttttctgct

SEQ ID NO: 463015 - DNA, 1616 bp, Homo sapiens
aagttctcttgtaacagatatttcctcatcttataggtggggaaactggggtgggacacatcaggtagattcctacttctgctccaacaagtgagggaggaaagctgggagctggctcaggcacggctgctccaccaggccctgggcctttgctcatggtgggcatctggttcctctcccctctgcagcatttctgtcctggattaccctcactgcgtggtgcatgagctgccagagctgacggcggagagtttggaagcaggtgacagtaaccaattttgctggaggaacctcttttcttgtatcaatctgcttcggatcttgaacaagctgacaaagtggaagcattcaaggacaatgatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatgatcttgatgcccggccttgggacttccaggcagaggagtgtgcccttcgtgccaacattgaacgcttcaacgcccggcgctatgaccgggcccacagcaaccctgacttcctgccagtggacaactgcctgcagagtgtcctgggccaacgggtggacctccctgaggactttcagatgaactatgacctctggttagaaagggaggtcttctccaagcccatttcctgggaagagctgctgcagtgaggctgttggttaggggactgaaatggagagaaaagatgatctgaaggtacctgtgggactgtcctagttcattgctgcagtgctcccatcccccaccaggtggcagcacagccccactgtgtcttccgcagtctgtcctgggcttgggtgagcccagcttgacctccccttggttcccagggtcctgctccgaagcagtcatctctgcctgagatccattcttcctttacttcccccaccctcctctcttggatatggttggttttggctcatttcacaatcagcccaaggctgggaaagctggaatgggatgggaacccctccgccgtgcatctgaatttcaggggtcatgctgatgcctctcgagacatacaaatccttgctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtattctgtgtcatgttggggtttttaatgtgattgtgtattctgtttacattaaaaagaagcaaaaataattcccgttggcttgtctacaggaaatatggcctctacgtatctcctccaggtctagaaagtggttttttctgct

SEQ ID NO: 463016 - DNA, 2015 bp, Homo sapiens
aagggatttgatcactgtacgtgaaaatattaaggacagaatatcgcgaggtattggtcagccaagatggcttctaacactggccgccacacttaatatggcggccagggaaatttcctggagaaaatcacgcgagagttgcatcacggcggctgtgcgcgagttaagctgggggtgtggagcagccaagatggagccggcagtcggcggtccgggcccactgatcgtgaacaacaaacagccccagcccccgccacctccgccgccggcagccgcacagccaccacccggggcaccgcgggccgccgcgggcctcctgcctgggggcaaagcccgcgagttcaaccgcaaccagcgcaaagactcagagggctattcggagtcaccagacctggagtttgagtatgctgacacagacaagtgggctgcagagctctcggagctttacagctacacggaagggccagaattcctgatgaatcgaaaatgctttgaggaggacttccggatccatgtgacagacaagaagtggactgagctggataccaaccagcaccggacccatgccatgaggctcctggatggcttggaagtcactgccagggagaagagactcaaggtggctcgagcaattctctatgttgctcaaggcacgtttggggagtgcagctcggaggcagaggtgcagtcctggatgcgctacaacatctttctcctcctggaggtgggcacgttcaatgctttggtggagcttctgaacatggaaatagacaacagtgccgcctgcagcagtgctgtgaggaagcctgccatctccctggctgacagcacagacctcagggtcctgctcaacatcatgtacctgatagtggagaccgttcatcaggagtgtgagggtgacaaggctgagtggaggaccatgcggcagaccttcagagccgagctgggctccccgctgtacaacaatgagccatttgccatcatgctgtttgggatggtgaccaaattttgcagtggtcacgcccctcactttcccatgaagaaagttctcttgctgctctggaagacagtattgtgcacgctaggcggctttgaggagctgcagagcatgaaggctgagaagcgcagcatcctgggcctccccccgcttcctgaggacagcatcaaagtgattcgcaacatgagagcagcctctccaccagcatctgcttcagacttgattgagcagcagcagaaacggggccgccgagagcacaaggctctgataaagcaggacaacctagatgccttcaacgagcgggatccctacaaggctgatgactctcgagaagaggaagaggagaatgatgatgacaacagtctggagggggagacgtttcccctggaacgggatgaagtgatgcctcccccgctacagcacccacagactgacaggctgacttgccccaaagggctcccgtgggctcccaaggtcagagagaaagacattgagatgttccttgagtccagccgcagcaaatttataggttacactctaggcagtgacacgaacacagtggtggggctgcccaggccaatccacgaaagcatcaagactctgaaacaggtgagtggctttgggtgagcttttggcttgtttggtcctaagtgagtagagtgaaaccagcctgtagggagaagccttttaagactgttgtctgcctgcaagaacctggggtagaggccggggtggactttgcaataaccttgcaaacagtctttcgtaagttttgcttgttttattataagttttacttgttttagctgagcttttgtttgggactgactgggaagtctttaaagattatattacctgaccaccgggcaccaaggcatgcacctgtagtcccagctactcaagaggttgatgcaggaggattgtttgagcacaggagatcaaggctacagtgagctatgatcatggtcctgcactctagcctgggccacagagtgagacccggattctttaaaaaaaa

SEQ ID NO: 463017 - DNA, 595 bp, Homo sapiens
aagggatttgatcactgtacgtgaaaatattaaggacagaatatcgcgaggtattggtcagccaagatggcttctaacactggccgccacacttaatatggcggccagggaaatttcctggagaaaatcacgcgagagttgcatcacggcggctgtgcgcgagttaagctgggggtgtggagcagccaagatggagccggcagtcggcggtccgggcccactgatcgtgaacaacaaacagccccagcccccgccacctccgccgccggcagccgcacagccaccacccggggcaccgcgggccgccgcgggcctcctgcctgggggcaaagcccgcgagttcaaccgcaaccagcgcaaagactcagagggctattcggagtcaccagacctggagtttgagtatgctgacacagacaagtgggctgcagagctctcgggtaacgcacagacctttgtgttatttgggggtggttttttccttattggtctttaataaaattaataatgaatatcatttagggcttcattgctttccctagttctatcaaatatatatatatatatatatatatatatatatatatatatatgt

SEQ ID NO: 463018 - DNA, 292 bp, Homo sapiens
aagctgaggcggaaggctttgggagggtcctgatacctttgtgtcacctccaggctccccgctgtacaacaatgagccatttgccatcatgctgtttgggatggtgaccaaattttgcagtggtcacgcccctcactttcccatgaagaaagttctcttgctgctctggaagacagtattggtgagcacctccttggaggaggagaacggtgctatgggatgggcagtagggagactgttccttgaatatccttttgaatattgaattatgtgactgtaaaactgctttggt

SEQ ID NO: 463019 - DNA, 536 bp, Homo sapiens
tagccaggtgtggtggtgcacacctgtagtcccagctacttgggaggctggagcaggaaaattgcttgaacctgggaggcggaggtggcagtgagccaagatcatgccactgcactccagtctgggcaacagaggaagacttcatctcaaaaaaataaaaataaaaaatatctggggtttgggattttagctagggatttttgtggtgacttaatcctctttcagaagactgtgtttgaagacaaatgtgtggggattttgctagagtgcagggagtttggccagagaatgttttccccagcccttcttttcccatctctcccaccagcacaagtacacgtcgattgcagaggtccaggcacagatggaggaggaatacctccgctcccctctctcaggggtaagttggaggtcctcagtccgggcgcggtggctcacgcctgtaatcccagcactttgggaggccgaggagggcagatcatgaggtcaggagattgagaccatcctggctaacatggtgaaaccccgtctctact

SEQ ID NO: 463020 - DNA, 384 bp, Homo sapiens
gctctgagagcaggggattcctggtagaggcctggagacccggctgtcctgagatcatgtgtgagggacttttggaaactgctgcacacactgcagccatgagggctgattgttcctgggtttaccctgcaggaagcaggtgacagtaaccaattttgctggaggaacctcttttcttgtatcaatctgcttcggatcttgaacaagctgacaaagtggaagcattcaaggacaatggtaagtgagtcagtgtagtcagcaggcttggaacttggagctcaaagaagagtgctgggagcagggagtccccagggtggggctcactgtgccttctcacttaactttgctgtagccgtatccttgcattttaagggccaattccca

SEQ ID NO: 463021 - DNA, 3507 bp, Homo sapiens
aagggatttgatcactgtacgtgaaaatattaaggacagaatatcgcgaggtattggtcagccaagatggcttctaacactggccgccacacttaatatggcggccagggaaatttcctggagaaaatcacgcgagagttgcatcacggcggctgtgcgcgagttaagctgggggtgtggagcagccaagatggagccggcagtcggcggtccgggcccactgatcgtgaacaacaaacagccccagcccccgccacctccgccgccggcagccgcacagccaccacccggggcaccgcgggccgccgcgggcctcctgcctgggggcaaagcccgcgagttcaaccgcaaccagcgcaaagactcagagggctattcggagtcaccagacctggagtttgagtatgctgacacagacaagtgggctgcagagctctcggagctttacagctacacggaagggccagaattcctgatgaatcgaaaatgctttgaggaggacttccggatccatgtgacagacaagaagtggactgagctggataccaaccagcaccggacccatgccatgaggctcctggatggcttggaagtcactgccagggagaagagactcaaggtggctcgagcaattctctatgttgctcaaggcacgtttggggagtgcagctcggaggcagaggtgcagtcctggatgcgctacaacatctttctcctcctggaggtgggcacgttcaatgctttggtggagcttctgaacatggaaatagacaacagtgccgcctgcagcagtgctgtgaggaagcctgccatctccctggctgacagcacagacctcagggtcctgctcaacatcatgtacctgatagtggagaccgttcatcaggagtgtgagggtgacaaggctgagtggaggaccatgcggcagaccttcagagccgagctgggctccccgctgtacaacaatgagccatttgccatcatgctgtttgggatggtgaccaaattttgcagtggtcacgcccctcactttcccatgaagaaagttctcttgctgctctggaagacagtattgtgcacgctaggcggctttgaggagctgcagagcatgaaggctgagaagcgcagcatcctgggcctccccccgcttcctgaggacagcatcaaagtgattcgcaacatgagagcagcctctccaccagcatctgcttcagacttgattgagcagcagcagaaacggggccgccgagagcacaaggctctgataaagcaggacaacctagatgccttcaacgagcgggatccctacaaggctgatgactctcgagaagaggaagaggagaatgatgatgacaacagtctggagggggagacgtttcccctggaacgggatgaagtgatgcctcccccgctacagcacccacagactgacaggctgacttgccccaaagggctcccgtgggctcccaaggtcagagagaaagacattgagatgttccttgagtccagccgcagcaaatttataggttacactctaggcagtgacacgaacacagtggtggggctgcccaggccaatccacgaaagcatcaagactctgaaacagcacaagtacacgtcgattgcagaggtccaggcacagatggaggaggaatacctccgctcccctctctcagggggagaagaagaagttgagcaagtccctgcagaaaccctctaccaaggcttgctccccagcctgcctcagtatatgattgccctcctgaagatcctgttggctgcagcacccacctcaaaagccaaaacagactcaatcaacatcctagcggacgtcttgcctgaggagatgcccaccacagtgttgcagagcatgaagctgggggtggatgtaaaccgccacaaagaggtcattgttaaggccatttctgctgtcctgctgctgctgctcaagcactttaagttgaaccatgtctaccagtttgaatacatggcccagcacctggtgtttgccaactgcattcctttgatcctaaagttcttcaatcaaaacatcatgtcctacatcactgccaagaacagcatttctgtcctggattaccctcactgcgtggtgcatgagctgccagagctgacggcggagagtttggaagcaggtgacagtaaccaattttgctggaggaacctcttttcttgtatcaatctgcttcggatcttgaacaagctgacaaagtggaagcattcaaggacaatgatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatgatcttgatgcccggccttgggacttccaggcagaggagtgtgcccttcgtgccaacattgaacgcttcaacgcccggcgctatgaccgggcccacagcaaccctgacttcctgccagtggacaactgcctgcagagtgtcctgggccaacgggtggacctccctgaggactttcagatgaactatgacctctggttagaaagggaggtcttctccaagcccatttcctgggaagagctgctgcagtgaggctgttggttaggggactgaaatggagagaaaagatgatctgaaggtacctgtgggactgtcctagttcattgctgcagtgctcccatcccccaccaggtggcagcacagccccactgtgtcttccgcagtctgtcctgggcttgggtgagcccagcttgacctccccttggttcccagggtcctgctccgaagcagtcatctctgcctgagatccattcttcctttacttcccccaccctcctctcttggatatggttggttttggctcatttcacaatcagcccaaggctgggaaagctggaatgggatgggaacccctccgccgtgcatctgaatttcaggggtcatgctgatgcctctcgagacatacaaatccttgctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtattctgtgtcatgttggggtttttaatgtgattgtgtattctgtttacattaaaaagaagcaaaaataattcccgttggcttgtctacaggaaatatggcctctacgtatctcctccaggtctagaaagtggttttttctgct

SEQ ID NO: 463022 - DNA, 3303 bp, Homo sapiens
agaagcctgctgaaccctgatggttcaaagccagatacatgtagagtgggcttgtggcacatcggtgggggcttttcagaatgtgcatattaggggagaaaaaaaaatcatgtgattaaaattgcacccaaaataccagcgtttcagtttggaatcaaattcatagagcagcagtatgatcttaccacttacatagggtgtaacttatctttctggtcctatggcagtcctgaatttggtgagttaacatgggtccatgccattgtgaggatttttctaggctcaggtgtaactggtttcttgccctgcagtgacagacaagaagtggactgagctggataccaaccagcaccggacccatgccatgaggctcctggatggcttggaagtcactgccagggagaagagactcaaggtggctcgagcaattctctatgttgctcaaggcacgtttggggagtgcagctcggaggcagaggtgcagtcctggatgcgctacaacatctttctcctcctggaggtgggcacgttcaatgctttggtggagcttctgaacatggaaatagacaacagtgccgcctgcagcagtgctgtgaggaagcctgccatctccctggctgacagcacagacctcagggtcctgctcaacatcatgtacctgatagtggagaccgttcatcaggagtgtgagggtgacaaggctgagtggaggaccatgcggcagaccttcagagccgagctgggctccccgctgtacaacaatgagccatttgccatcatgctgtttgggatggtgaccaaattttgcagtggtcacgcccctcactttcccatgaagaaagttctcttgctgctctggaagacagtattgtgcacgctaggcggctttgaggagctgcagagcatgaaggctgagaagcgcagcatcctgggcctccccccgcttcctgaggacagcatcaaagtgattcgcaacatgagagcagcctctccaccagcatctgcttcagacttgattgagcagcagcagaaacggggccgccgagagcacaaggctctgataaagcaggacaacctagatgccttcaacgagcgggatccctacaaggctgatgactctcgagaagaggaagaggagaatgatgatgacaacagtctggagggggagacgtttcccctggaacgggatgaagtgatgcctcccccgctacagcacccacagactgacaggctgacttgccccaaagggctcccgtgggctcccaaggtcagagagaaagacattgagatgttccttgagtccagccgcagcaaatttataggttacactctaggcagtgacacgaacacagtggtggggctgcccaggccaatccacgaaagcatcaagactctgaaacagcacaagtacacgtcgattgcagaggtccaggcacagatggaggaggaatacctccgctcccctctctcagggggagaagaagaagttgagcaagtccctgcagaaaccctctaccaaggcttgctccccagcctgcctcagtatatgattgccctcctgaagatcctgttggctgcagcacccacctcaaaagccaaaacagactcaatcaacatcctagcggacgtcttgcctgaggagatgcccaccacagtgttgcagagcatgaagctgggggtggatgtaaaccgccacaaagaggtcattgttaaggccatttctgctgtcctgctgctgctgctcaagcactttaagttgaaccatgtctaccagtttgaatacatggcccagcacctggtgtttgccaactgcattcctttgatcctaaagttcttcaatcaaaacatcatgtcctacatcactgccaagaacagcatttctgtcctggattaccctcactgcgtggtgcatgagctgccagagctgacggcggagagtttggaagcaggtgacagtaaccaattttgctggaggaacctcttttcttgtatcaatctgcttcggatcttgaacaagctgacaaagtggaagcattcaaggacaatgatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatgatcttgatgcccggccttgggacttccaggcagaggagtgtgcccttcgtgccaacattgaacgcttcaacgcccggcgctatgaccgggcccacagcaaccctgacttcctgccagtggacaactgcctgcagagtgtcctgggccaacgggtggacctccctgaggactttcagatgaactatgacctctggttagaaagggaggtcttctccaagcccatttcctgggaagagctgctgcagtgaggctgttggttaggggactgaaatggagagaaaagatgatctgaaggtacctgtgggactgtcctagttcattgctgcagtgctcccatcccccaccaggtggcagcacagccccactgtgtcttccgcagtctgtcctgggcttgggtgagcccagcttgacctccccttggttcccagggtcctgctccgaagcagtcatctctgcctgagatccattcttcctttacttcccccaccctcctctcttggatatggttggttttggctcatttcacaatcagcccaaggctgggaaagctggaatgggatgggaacccctccgccgtgcatctgaatttcaggggtcatgctgatgcctctcgagacatacaaatccttgctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtattctgtgtcatgttggggtttttaatgtgattgtgtattctgtttacattaaaaagaagcaaaaataattcccgttggcttgtctacaggaaatatggcctctacgtatctcctccaggtctagaaagtggttttttctgct

SEQ ID NO: 463023 - DNA, 2368 bp, Homo sapiens
gatagcgccactgcactccagcctgggcgacagagcgagaccatctcaaaaaaaaaagttagaggtcctcttcagcccccgggatccccagctcttcccaggcattgtgctgggattagaccacaaggttgccccaggccctgccctcaaagagctcccagtccacctcccagtgcacaggctgagacacgtctagtgcagggttaagaatacagactgagtcaggaacctgcctctgatgcctgggtccaccactttatggatggcaacttaggcaagttactgggtctctctatgctttatttccttgtctgtgaaataggaataataatacctttatagggttataataataaggatgaactgagttattacaagtaaaatgcttggcacattgtttgtgttcagggtttgctgttatcatcattaacatcattatgtacatcactgtttacaggttttcctccagccagctaggaagctggctcaggagattgtattctgggctggggttttatgcttgtactcattatgttaagggagaagaagaagttgagcaagtccctgcagaaaccctctaccaaggcttgctccccagcctgcctcagtatatgattgccctcctgaagatcctgttggctgcagcacccacctcaaaagccaaaacagactcaatcaacatcctagcggacgtcttgcctgaggagatgcccaccacagtgttgcagagcatgaagctgggggtggatgtaaaccgccacaaagaggtcattgttaaggccatttctgctgtcctgctgctgctgctcaagcactttaagttgaaccatgtctaccagtttgaatacatggcccagcacctggtgtttgccaactgcattcctttgatcctaaagttcttcaatcaaaacatcatgtcctacatcactgccaagaacagcatttctgtcctggattaccctcactgcgtggtgcatgagctgccagagctgacggcggagagtttggaagcaggtgacagtaaccaattttgctggaggaacctcttttcttgtatcaatctgcttcggatcttgaacaagctgacaaagtggaagcattcaaggacaatgatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatgatcttgatgcccggccttgggacttccaggcagaggagtgtgcccttcgtgccaacattgaacgcttcaacgcccggcgctatgaccgggcccacagcaaccctgacttcctgccagtggacaactgcctgcagagtgtcctgggccaacgggtggacctccctgaggactttcagatgaactatgacctctggttagaaagggaggtcttctccaagcccatttcctgggaagagctgctgcagtgaggctgttggttaggggactgaaatggagagaaaagatgatctgaaggtacctgtgggactgtcctagttcattgctgcagtgctcccatcccccaccaggtggcagcacagccccactgtgtcttccgcagtctgtcctgggcttgggtgagcccagcttgacctccccttggttcccagggtcctgctccgaagcagtcatctctgcctgagatccattcttcctttacttcccccaccctcctctcttggatatggttggttttggctcatttcacaatcagcccaaggctgggaaagctggaatgggatgggaacccctccgccgtgcatctgaatttcaggggtcatgctgatgcctctcgagacatacaaatccttgctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtattctgtgtcatgttggggtttttaatgtgattgtgtattctgtttacattaaaaagaagcaaaaataattcccgttggcttgtctacaggaaatatggcctctacgtatctcctccaggtctagaaagtggttttttctgct

SEQ ID NO: 463024 - DNA, 2165 bp, Homo sapiens
aagggatttgatcactgtacgtgaaaatattaaggacagaatatcgcgaggtattggtcagccaagatggcttctaacactggccgccacacttaatatggcggccagggaaatttcctggagaaaatcacgcgagagttgcatcacggcggctgtgcgcgagttaagctgggggtgtggagcagccaagatggagccggcagtcggcggtccgggcccactgatcgtgaacaacaaacagccccagcccccgccacctccgccgccggcagccgcacagccaccacccggggcaccgcgggccgccgcgggcctcctgcctgggggcaaagcccgcgagttcaaccgcaaccagcgcaaagactcagagggctattcggagtcaccagacctggagtttgagtatgctgacacagacaagtgggctgcagagctctcggagctttacagctacacggaagggccagaattcctgatgaatcgaaaatgctttgaggaggacttccggatccatgtgacagacaagaagtggactgagctggataccaaccagcaccggacccatgccatgaggctcctggatggcttggaagtcactgccagggagaagagactcaaggtggctcgagcaattctctatgttgctcaaggcacgtttggggagtgcagctcggaggcagaggtgcagtcctggatgcgctacaacatctttctcctcctggaggtgggcacgttcaatgctttggtggagcttctgaacatggaaatagacaacagtgccgcctgcagcagtgctgtgaggaagcctgccatctccctggctgacagcacagacctcagggtcctgctcaacatcatgtacctgatagtggagaccgttcatcaggagtgtgagggtgacaaggctgagtggaggaccatgcggcagaccttcagagccgagctgggctccccgctgtacaacaatgagccatttgccatcatgctgtttgggatggtgaccaaattttgcagtggtcacgcccctcactttcccatgaagaaagttctcttgctgctctggaagacagtattgtgcacgctaggcggctttgaggagctgcagagcatgaaggctgagaagcgcagcatcctgggcctccccccgcttcctgaggacagcatcaaagtgattcgcaacatgagagcagcctctccaccagcatctgcttcagacttgattgagcagcagcagaaacggggccgccgagagcacaaggctctgataaagcaggacaacctagatgccttcaacgagcgggatccctacaaggctgatgactctcgagaagaggaagaggagaatgatgatgacaacagtctggagggggagacgtttcccctggaacgggatgaagtgatgcctcccccgctacagcacccacagactgacaggctgacttgccccaaagggctcccgtgggctcccaaggtcagagagaaagacattgagatgttccttgagtccagccgcagcaaatttataggttacactctaggcagtgacacgaacacagtggtggggctgcccaggccaatccacgaaagcatcaagactctgaaacagcacaagtacacgtcgattgcagaggtccaggcacagatggaggaggaatacctccgctcccctctctcagggggagaagaagaagttgagcaagtccctgcagaaaccctctaccaaggcttgctccccagcctgcctcagtatatgattgccctcctgaagatcctgttggctgcagcacccacctcaaaagccaaaacagactcaatcaacatcctagcggacgtcttgcctgaggagatgcccaccacagtgttgcagagcatgaagctgggggtggatgtaaaccgccacaaagaggtcattgttaaggccatttctgctgtcctgctgctgctgctcaagcactttaagttgaaccatgtctaccagtttgaatacatggcccagcacctggtgtttgccaactgcattcctttgatcctaaagttcttcaatcaaaacatcatgtcctacatcactgccaagaacagcatttctgtcctggattaccctcactgcgtggtgcatgagctgccagagctgacggcggagagtttggtgagtggctgggctctcc

SEQ ID NO: 463025 - DNA, 352 bp, Homo sapiens
tgaggagctgcagagcatgaaggctgagaagcgcagcatcctgggcctccccccgcttcctgaggacagcatcaaagtgattcgcaacatgagagcagcctctccaccagcatctgcttcagacttgattgagcagcagcagaaacggggccgccgagagcacaaggtgaggacgacagaggtccctgtgactcctgagggccctcaaggtgcatgcttgcagcagcacagtccttggaggagcagggctgctggaaatgatctctgatcagccagtcagaatcatgcctccacagcgaggatactttgtccccagctctggtccagtgtatggtgagtgctcagcacgtgg

SEQ ID NO: 463026 - DNA, 1270 bp, Homo sapiens
agaaacacctacttggaaagcaccgaaacaactgaattggaaaatgtggaaaggggattgggggaggggactctttctgagatctggctccagtactaacagcaaagggaacttgggcaaattacagactctctgtgccttggttttgtcatcagcaaaacagaatcatcccataaactacctggacccatttcaaggagctttgggaagagcccagatcactgatggaattggacagtgcgtggaaatggttcagcaggacgagggatcaccaaccacccgtgaccatgagcttgatcttgccagaccgttacctggtacactggctgctacctccctcactcttgtcagagtcggagctacaggcagtgccttcagctctgagctcaggcatcccggtccctgtttttgcggttaaggactctaaagtgttgtgtcgtgttcatcaactttttctcaacctccctggctctacctcttctgccacaaacgtcagcatggtggtatctgccgaccctttgtccagcgagagggcagagatgaacatcctagaaatcaaccaggaattgcgctcgcagctggcagagagcaatcagcagttccgagacctcaaagagaaattccttataactcaagctactgcctactccctggccaaccagctgaagaaatacaagtgtgaagagtacaaagacatcatagactctgtgctgagggatgaactgcagtccatggagaagctggcagagaagctcaggcaagctgaggagctcaggcagtataaagccctggttcactctcaggcaaaagagctgacccagttacgggagaagttacgggaagggagagatgcctcccgctggctgaacaagcatctgaaaaccctcctcactcctgatgaccctgacaagtcccagggtcaggacctccgagagcagctggctgaggggcacaggctggcagagcaccttgttcacaagctgagcccagaaaatgatgaagatgaagatgaggatgaagacgacaaagacgaggaggttgagaaagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaa

SEQ ID NO: 463027 - DNA, 2945 bp, Homo sapiens
tcattgccccagcaaccacagggcctgggactggggggttcccagatccttgaagctcactccgcctcctcactctcactgcatttcccaccttcctgtgtgccttgcggcatcttcatcactgaggcacctggttacgcttcacctcttgtttcctgccctcactgcattccctcacctctacctttttatccttccaccctaggcttctctcctccctcttccctcactcctgactcttcctcttcccagcggacggctggaggaccgctcagtctctcctctctcacttcccttcctctctctcaccttcaccacccaacacctccctccctgcctctttctttctgctccctcattctctccccaccactctcttctcgtggcccccttgcccgcgcgccctcttcccttccccttgcctcactctctcagctttcttcccacagttgagctcgggcagctctttctggggatagctatggggctttgggggaagaaagggacagtggctccccatgaccagagtccaagacgaagacctaaaaaagggcttatcaagaaaaaaatggtgaagagggaaaaacagaagcgcaatatggaggaactgaagaaggaagtggtcatggatgatcacaaattaaccttggaagagctgagcaccaagtactccgtggacctgacaaagggccatagccaccaaagggcaaaggaaatcctgactcgaggtggacccaatactgttaccccaccccccaccactccagaatgggtcaaattctgtaagcaactgttcggaggcttctccctcctactatggactggggccattctctgctttgtggcctacagcatccagatatatttcaatgaggagcctaccaaagacaacctctacctgagcatcgtactgtccgtcgtggtcatcgtcactggctgcttctcctattatcaggaggccaagagctccaagatcatggagtcttttaagaacatggtgcctcagcaagctctggtaattcgaggaggagagaagatgcaaattaatgtacaagaggtggtgttgggagacctggtggaaatcaagggtggagaccgagtccctgctgacctccggcttatctctgcacaaggatgtaaggtggacaactcatccttgactggggagtcagaaccccagagccgctcccctgacttcacccatgagaaccctctggagacccgaaacatctgcttcttttccaccaactgtgtggaaggaaccgcccggggtattgtgattgctacgggagactccacagtgatgggcagaattgcctccctgacgtcaggcctggcggttggccagacacctatcgctgctgagatcgaacacttcatccatctgatcactgtggtggccgtcttccttggtgtcactttttttgcgctctcacttctcttgggctatggttggctggaggctatcatttttctcattggcatcattgtggccaatgtgcctgaggggctgttggccacagtcactgtgtgcctgaccctcacagccaagcgcatggcgcggaagaactgcctggtgaagaacctggaggcggtggagacgctgggctccacgtccaccatctgctcagacaagacgggcaccctcacccagaaccgcatgaccgtcgcccacatgtggtttgatatgaccgtgtatgaggccgacaccactgaagaacagactggaaaaacatttaccaagagctctgatacctggtttatgctggcccgaatcgctggcctctgcaaccgggctgactttaaggctaatcaggagatcctgcccattgctaagagggccacaacaggtgatgcttccgagtcagccctcctcaagttcatcgagcagtcttacagctctgtggcggagatgagagagaaaaaccccaaggtggcagagattccctttaattctaccaacaagtaccagatgtccatccaccttcgggaggacagctcccagacccacgtactgatgatgaagggtgctccggagaggatcttggagttttgttctacctttcttctgaatgggcaggagtactcaatgaacgatgaaatgaaggaagccttccaaaatgcctacttagaactgggaggtctgggggaacgtgtgctaggcttctgcttcttgaatctgcctagcagcttctccaagggattcccatttaatacagatgaaataaatttccccatggacaacctttgttttgtgggcctcatatccatgattgaccctccccgagctgcagtgcctgatgctgtgagcaagtgtcgcagtgcaggaattaaggtgatcatggtaacaggagatcatcccattacagctaaggccattgccaagggtgtgggcatcatctcagaaggcactgagacggcagaggaagtcgctgcccggcttaagatccctatcagcaaggtcgatgccagtgctgccaaagccattgtggtgcatggtgcagaactgaaggacatacagtccaagcagcttgatcagatcctccagaaccaccctgagatcgtgtttgctcggacctcccctcagcagaagctcatcattgtcgagggatgtcagaggctgggagccgttgtggccgtgacaggtgacggggtgaacgactcccctgcgctgaagaaggctgacattggcattgccatgggcatctctggctctgacgtctctaagcaggcagccgacatgatcctgctggatgacaactttgcctccatcgtcacgggggtggaggagggtgaggaggcagggtgcccatggtggagacttcaaccctggactcagggagactgagactctggtatacataatatcgtcattgtcctctcactggacttcaagagagatccagaattctgcattccaggttccctgctttctgcctggagct

SEQ ID NO: 463028 - DNA, 817 bp, Homo sapiens
gttgcttccaagatggctgaataggaacagctccggtctacagcttcaagtgagatagacgcagaagacaggtgatttctgcatttccaactgaggtacctggttcatctcactgggactcgttggacagtggatgcagcccacggaggatgagccaaagcagggtggggtgtcgcctcacccgggaagtgcaaggggttgggggatttctttttcctagccaagggaagctgtcccatgcccatggagccttgcctgctgctagcacagcagtctgagatcaacctgatagttggatatatatatatatatatatgcggaatgctacatcacaagaataagaatgtgaaaagaaccagtttcttttgtaatcctaaacgttctagtctgagaattaaaagccattgttcgaagaagggtgcccagggtccagctggtcgccgaaagcttgtccgcaatacaggctaaggaccagcttctttggaagagaacagatgagggaagcaggagagaaaaaagggagaggcagacgtcacttccccttgccggctccggcagcggatgagccagcgcaggggctgctgcttcgccacatgctgcttcgccacgaaggagttcccgtgccgtgggagcgggttcaggaccgctggttttgtttgctgcagaaacgcatactgggcgtcagcgtaagctgagaatcaggtctttgttcccatctgtaacttcactgaaactaaaaatttgggacatcgtggttctcacgtttgtaatcccagcaatctatgagtgtggcccaaggaagccaaaatttagacaa

SEQ ID NO: 463029 - DNA, 3084 bp, Homo sapiens
ttccctagagcctcctccgcaaagctgaggagctcctgccaagcaccgccttaggtattacttcctccagaggctcccagcaccatgacggtttcatacactctcaaagtggcggaggcccgcttcggaggtttctctggcctgcttctccgctggaggggaagcatctacaagctcctctacaaggaattcctcctctttggggccttgtacgctgtgcttagcatcacctaccggctgctgctgacccaggagcagaggtacgtgtatgctcaggtggcccggtactgcaaccgctcagcagacctcattcccttgtcctttgtattgggtaaggctcccttctagttttccctgtgtcccccttactgtgttccctgacctctgggttgggttgacagctccgagggtcagaattacccaacagatggtgtggtgacacacctgcagtctcagctactcgagaggctgaggtgagaggatcgcttgagcccaggagttccagtccagcctgggcaatgtagcgagactctgctaaaaaaaaaaaaaaaaaaaaaaagaattactcaacacggtggcagagccttcctggtcagccagagcaggcccagcaggcacaggagctgggtgctgggtccaggacttccagagggcagggccctatcacttgccggaccctcacttccagcaaggcacaagacacctgctggcctcacaagcccaccctgggcactgcaggggagctggacagaggtgacaaccccttccccaccctcctgggaagcagtctcctggctttgaatccccactttccctctgctgaaggaagtttgccctcctccctcctcctggcctcgcacagcagggcactggagctgaatgtttccttccccctgccacgattcaactggcctggaccaggccctttgctgggggaggctctccactctcccttcctactccctctatcacggcggccaagcaggtttctatgtgactctcgtggtgaaccgctggtggtcccagtacacaagcatcccgctgccagaccagctgatgtgcgtcatctcggctagcgtgcacggcgtggaccagcggggccgcctgctgcgccgcaccctcatccgctacgcgaacctggcgtccgtgctggtgctgcgctcggtcagcacccgcgtgcttaagcgcttccccaccatggagcacgtggtggacgcaggtgcgccgcccgccgggagcctctgggggtccggcccacagccggatgcaggaacgcggaaccgcgagtcctgggacagccggtggacgcgagggaggggagccagacggcggaacagcagcctcccctggcggcagagggtgcaactgcaccccacctgctttaccccctcaggtttcatgtcccaggaagagaggaaaaagtttgagagcctgaaatccgacttcaacaagtactgggtcccctgcgtctggttcaccaacctggcggcccaggcccggagggacgggcgaatacgtgacgatatcgctctctgtctacttttggaagagctgaacaagtaccgagccaagtgcagcatgctattccactatgactggatcagcatccccctcgtggtgaccatagccgtctactctttctttgccctctccctggttggccgccagtttgtggagccagaggcaggggctgccaaacctcagaagcttctgaagccaggccaggagccagccccagccctgggagacccggacatgtacgtgcctctcaccactctgctgcagttcttcttctatgctggctggctcaaggtggctgaacagatcatcaacccatttggtgaggatgatgacgactttgagacaaatcagctcatagaccgcaacttgcaggtgtccctgctatccgtggacgaaatgtaccagaaccttccccccgctgagaaggaccagtactgggatgaggaccagccgcagccaccctacactgtggccacggcggccgagtctctgcggccctcattcctgggctccaccttcaacctgcgccgatcccgcgtccccgctcccgccctgtgccccggctcagcccgccctcccgcccgcagcatgagcgacgaccctgagcagagcctgcaggtggaggcgtcccccggatctggtcggcccgcgcccgccgcgcagaccccgttgctcggccgcttcctgggcgtaggggcgccctccccggccatcagcctccggaacttcggccgcgtgcgaggcaccccccgccccccgcatctgctgcgcttccgggcggaggagggcggcgaccccgaggccgcagcccgcatcgaggaggaatcggcggagtccggggacgaggccctggagccctgaggtctcgcctgcccccgcccggtttcccccacccactgccctccttccctcccgtgcccggtcctgccagccagctctattagagcagcttttcctgtgtgccttgaaggccagagcatttagggacagaacttgaaagagaagatggcgaaaagggcctgagccagggctgggaatgtgtccactttggtgggagagaaggtcggttgcttgggggacgtgaagctagaaaaataaatgagcccaggcatagaggactagagcccaggtgatgctgtgctgcttgtccaggaaacacaatttgagagtcatgtgaaacgtgcttgaaggggtataccttaccctggtaaccttactcaaaagaagggtcagtgtgtgctgggggacttttgccttgtttgtaatgttaaagtttttgtttacattgagaatatattcaagtttttgtttaagtgttgtttagtttttgtttatattgagaatatatttattacttgtgcagttataattgtttaaaattgaattggcatgcatgcagtaggatgaagatgaaggaagggtttgggaatctgtcttggaggctgattaaagtcagatgtgaaggcagccatccaccacccaccctagacctagcatttggacttgtgtgccaagctcttctccactgccaccaaccacacagggggaaaaagtacagtttac

SEQ ID NO: 463030 - DNA, 3259 bp, Homo sapiens
caacagccatttgatgccagtaaacctcctattgactttttggaaaaagcaggatgaaatgcacttttctggaatatctggatggcaaaacatctgtatcagcattaatataagcccaacttcaatgtctcagggcttatggaaaatatttgcatttttctttcctcaagagactgccttatttcatatatgtatgtgtgtgtatgtgtgtttatatataattttatatgtatatgtgtgtatgtatatatacacgtatatgtgtaaatatacgtatatatacacgtatacacatacatatacgtgtatacgtgtatatatacatatatacatatatgcatacatatatatatacgggcaaagacttaatatactatccacaggctattcagattgttcaagaggctctcagttgaagaagcaaacagacaaacaaaacggtttcatacacaggcaggcatttggctgagtaggtcggcaggatatggaaacttgctttgaggtgtttttggattctcacctagaattctactacttaatggctgtgtggcttctttgcaggctatatactgaattcataaaggatgttatgagagtaaattcaaagaattctgatgttttgaaatttgttgtgacttggttaactatggtgaaatgttacattcgtgttacattatggcttttgtttatacgggtctgattatgggataacttaataaagttgtaaaaaactctatgtttttcaaaaattctgtgtttttcttatgtgaagaatttgtttcaactattcttcaaacaccagaaaaggagtcaccgtatactttacttttcatataaagattactcaatatattttaaaatgggtgttccagaattagacttccagattccttgaattgagagtgtggaaaaggataggcagctcctgtaataggagacattcttttaaaagcctggaatgctgaaaccctcttagactgaaaacatgtcaggacatgcctttttgggatactgtcaaacggtttaggctcagaattccacattccgtacttttgaagttgttttctgttggcaaatgacctcttgattattttcatgtgttttacatagtttgaaagtggctgactgagaatttgaatataggtccgacataattcaaatattgtgctcttgaccacttaactaaattaactctactttctgattgattcacatatgttgaaatctactcattctcctcctagtgtcattatgtttgtttattctctcctttatatttttaaggcctgctggtctatcctttccaggatctacacttatgctggacccactaagctgtcctagaacatcatagtaaatgttcaccagatattaattatttgagtgagaatggttgtgagcattgggtactcccccagccagtacccttctctcttgcagtagtatattttgtagattaaataaaactcaagataaaaaaaacaaattaataaatgatcaatggaaacagaaatttggaacataaaagtattatttcaaaatgaacacattatatgtaaaagctcacaaccaggaatttcttcagttgggtttgcagcaatgttatgtcactaatactatatttctctctgtatggccaaacctgtaaagcctcaatatctgattatggagcacatctagactgttaaaaagctttctataatattaataaaatcaaataataaataaaaattaaattgactaatcatagcaatttcattttgagaatgttttgtaggctgaaggcaaatccttgagatatttttgcaggagcgtcattgcgaaacagaatctgcagtagaactatgtcatcttctggttctgagtgtgccctctcattgctggcagatggcaagtatttatttgcttgctagctctttagtggaactggtcttctgtttccactgtcgcctcgtgtgacacaaactgccacctatctcccaaggttctttctttgtaacagaaccctagtttttggctggactcatttccccagtggtagaggctgctggctggtcatgtcatgagcccaggtcttcttcttgggcacaaccagatgccatttctcagcctcccttgcagttatatgcagctgtgtgtttgagttctggccgttagtgagtggaagtgatgtgtcccttctactcacacttctgtagtcctggcctacagaaactcacaatggttctctatactctttatctttccacagcttaatgcagttaagtaacaagatcttggaagacaagtgttgaaggtgaaagaggcacaagatagaagaaacctgggtccttagatccttgcttggaggaaaaccacctgccaatccagaacatcattttggacttcatttcatattagatattatgttaccaatgagcagggactatgatgaatgtgtctttagaacacccaatgaagtgccacttgccacaagaagctaagtcacaatctgatggccagaggaggcaatcattcttcctacagttttgtgcataaaccttcctgcctctctgctggggaccacctatggggaaaggaaaacttctctctcatggctctcctttcccaggaaaactttagctcctgttgagaccaacaccttccctggagaatgcagagtgaagggattaggcccatcacaattttccattcatgatgttgggtcaagcaaggcatcacacagaatgaatagaaacagaaacagccccacatgtgaagtaggagccatgctggaatgaacaagggccacggtatggcagttacctcttgttagtgtgcaagactatgcaaagccttctccctaatgctgattttctatttctaaattgctgtgggcatagagaaactcacactggttaaggatatgtgtgcaataaacataaatgcttttcaagtcaggaactgagggctggttcttctctgagaaaagcataagaaaagcgtctctcaagtgttgttttattttttaaaaaattcattgtttctaagctattttctagatatgtgaggctagcaatggctcagttctatgtaaataaaaatatatattaagtattgtcaacctacccgccccacccctggcagagattgcttactcaaatgcttacattcggatgatatatatctttcttgccctgaagttttgaaaattttaatagctccatggattgaaatgacatgagagaaaaatatttcaagtctcttttagaatttttat

SEQ ID NO: 463031 - DNA, 1318 bp, Homo sapiens
tctttccctctttctgggtctccatggaacagacagctgagacaagcctgctagcctcattgcctttgcacaagctcttccctctgcctggaacacttgttgcttcaggagtcggctcgatgtaacttctacagggacctgagccccaatccaagttagacacctggttattgcagcagcctgtatctcaccgtcccagaatgaatcatgactgcaatgaaaacgatggcatgagcatttgttaccatcaggcttccgccctagattatgagctccctgaggacaagcagagggttcatctctctttatagctagaacccagcacagcgcctggcactcaggaggcacccaattactttggctgactggatagacatacatacagacggacggataaatggctggaagaggagtgattgaaaaaatacattttaaaatgccctggctgcatttcttagagcagttataatgcgcgcaattcacacgggaattattttcaccctttgagggtccgcacccaccggtgccccagtcgcctttcccaggcaaggccactgggcggggcatccggggccgtcggagtgacgtaacagcggggcgcgtccggagccggccctcacttcctgattggcaagcgcggtggccacacccaccgccgcagccgtcggagtagagatggtggcagcgatgggcggagggggaggcccggcgttcgcgcagacggcggtggggcggtggggcggtggggcggtggggcggccgcgccggcttcagggcgtcggggtctcccggggcacgttcatgaagccggcgaggtggagactgggcgccgagcggtttgcgaggctcgcgcggttccggggggcagtgggacggcggagggctcgtgcgctgcggctggaccgctccccgcggcgggccgggcacaggcgaggaaagtcccagaaacacagccccaccctccctctcaccctccttgacacgctcgcctcttccccaccaccccaaactcagacccagaagaactgcgggaaactaggcgcctgcagacctggtttcttagccctaactctgtgtgacccagaacaggagtccatgacttgtggacgttatgacacaaacctctgctgggatcacttcttccctgagccatcccctcacaccttttacctggctaactcctcatccctgatcatcatggaagaggatggatcctgacccctaaggtgggtctcagttcagctgaggactgacctaaacactcttcccttccctatttaacttgtatttatccttcaaaaaaaaaaaatctcagttt

SEQ ID NO: 463032 - DNA, 1185 bp, Homo sapiens
gtgaattattcctgcttttaggtcacagtttcagtacagaactctgagaggcccaaaaatgtgaatgtggtcttccagtcacttactaagtaagtgccctgttcgttatcggatcgactgccgtgatattgcaatgcttgtgttcaagtcacccttatttgacttaataatggccccaaagtgcaagagtagtcatgctagcaatttggatatggcaaagagaagccataaagttctttctttaaatgaaaagtggacgagcatctactgtgctttcacagcggctatcactattgccagcagcaagactgtcagctcggcgccctcgtctggttggatgggaaactgcaactgccgtcctctcatttcctcacatggtggagaacaaggagcaagagcaactctcatttctcttatgagggagaatcctattcatgaagcctctacccacgtgacctaattacctccaaaggcctatctaatactgtcacactgggtcttaggatttcagcataggcattttggggggacacaaacatttagtccataacacttgagttgcatctttttaaatgcatattctgaggccccaacccaagactctgtgcttgagaaacagatacagtgatataaaattttgatggctggaactttccttagtctttgaaaagagttgagacaatagacatcatagagaagttcagggggccgggcgaggtgcctcatgcctgtaatccctgcactttggaggccaaggtagagtgattaagctcaagagttcaagaccagcctgggcaacacggcaaaactccatctcccaaaaaaataccaaaaaattatctgggagtggtggtgcacatctgtagtcacagctacttgggaggctgaggtgggaggaatacttgagcctgggaggttgacgctgcagtgagccaagatcccaccgctgcactccagcctgggtgacagagtgagactgtctcaaaaagagtgagagaaagaagttcaggggcctctgaagacaaactgtttcaccatttagcaaataaccaggaagagatgaaagtggatgagaaaccctgtgatgggggcatctgtcaagttgataagccaggtaggattctgctgggcatcagttacatgaagcagacaaaagatatcattcttagaaatgactgttgaact

SEQ ID NO: 463033 - DNA, 1357 bp, Homo sapiens
gtgaattattcctgcttttaggtcacagtttcagtacagaactctgagaggcccaaaaatgtgaatgtggtcttccagtcacttactaagtaagtgccctgttcgttatcggatcgactgccgtgatattgcaatgcttgtgttcaagtcacccttatttgacttaataatggccccaaagtgcaagagtagtcatgctagcaatttggatatggcaaagagaagccataaagttctttctttaaatgaaaagtggacgagcatctactgtgctttcacagcggctatcactattgccagcagcaagactgtcagctcggcgccctcgtctggttggatgggaaactgcaactgccgtcctctcatttcctcacatggtggagaacaaggagcaagagcaactctcatttctcttatgagggagaatcctattcatgaagcctctacccacgtgacctaattacctccaaaggcctatctaatactgtcacactgggtcttaggatttcagcataggcattttggggggacacaaacatttagtccataacacttgagttgcatctttttaaatgcatattctgaggccccaacccaagactctgtgcttgagaaacagatacagtgatataaaattttgatggctggaactttccttagtctttgaaaagagttgagacaatagacatcatagagaagttcagggggccgggcgaggtgcctcatgcctgtaatccctgcactttggaggccaaggctggtctcaaactcttgaactccagcaatccaccctccttggcctcccaaagtgttgggattacaggcatgagccacagtccctcctaaccccctacccctgttttttttttgagacaaaaaaagagatgggaaagaaaaagccccaaagaaactgctcagtacaccaaggatcacaaaagggtaatttgtaatttggtgatttgtatgtagtgtagcacagaaaaaaaattgcacaagtttttccataaatgagaccaaaggttcaaattcatcctgtgtcaggttcaaattcatcctgtgtctgctctgcagccattttagtaagctgggcaaggaggtcatttagaaattgggtttttcctctttcccctgactcttcgcaccaagtcacatccctgatgtagatactcttgggggaggggaaaacatctggctctatgcaaacagggctcatcaaaaatctttatgtgccaaaatggatactgacattgctatgaacaaatctgttttttcttccctccctgcctaaagactcctaataagggacattaaatcatacacaactgaatctaagatatgaaaaactagtttcaatgac

SEQ ID NO: 463034 - DNA, 1427 bp, Homo sapiens
tttggtcagaacttccccaagtggagtgaaactcaggagctgagaaaccgagtcactgtgaaaagatgggaaattatctcctgcgaaaactcagttgcctgggagagaatcaaaagaagcccaagaaaggaaacccagatgaggaaagaaaacggcaggaaatgactacatttgaaagaaaacttcaagatcaagataagaaaagccaagaagtttcatccacttctaatcaggaaaacgagaatggcagtggttctgaagaagtgtgctacactgtcattaatcacatcccccatcagagatcctccctgagctccaatgatgatggctatgagaacattgactccctcacaaggaaagtgagacagtttagagaaaggtcagagacagaatatgcccttcttaggacttctgttagtaggccttgttcctgcacccatgagcatgattatgaagttgtgtttccacactaaaatcctcaagctgctttatcaccttccagcaatgaagacaatgcagaatagcagactctggcgaagttgttcaccctgagcagtgcatgaaacattcctttctggctaaagtttagaaatattatcttattatatatccttaggcaactctgatatgtggcatctctgtggcttaggtgaaatcatagaaattgacacaatgacctaaaatattctatgtgtttttgcttgtaaagtttgaggacatggaggtgataaaaaaaactttcttaggacaataatgtaaaatgaaaataaatttctaatccccctgactaactgaatggaccctcttctaggccaaagagacctcagatgaacctgaaagactgaattctggccatgataggaagggaggtgagacacaccttgttataccccttcccttttggagtttatgcacaagtgaccaggatgagtcataagactgatgaaatagactgattgtggcaataagagtcccaattccaacctgactctggtgtagatcacacactgtctgagggattccatctatgagactttgtctacataacagagaccttggtttccacaacccctttattttagctaaagcattcttttctactgacttcttaagtctttagacaaagcttaactctttcaaccaattgccaatcagacaaactttgaatctacctatgacctgtaagctctctcctgcttcaagatcttgcctctttaagctgaaccgatgtgcactttccatttaatgatttatgtctttgcttgtaactcctgtctccctaaaatgtataaaagtaaacggtgacctgaccacctcaggcacactttctcaggacctcctgagagtgtatcccaggccatggtaagtcatgttggctcagaatcaacctctttaaatattttacagaatttgggttttggttacca

SEQ ID NO: 463035 - DNA, 1379 bp, Homo sapiens
tcgtgtgcctggaaatggctaacatggggaattttatgttatatgaattagttacacacacatttgtaggcaatttgggagtgttcttggtcctcctggctttgcctggaaagaatgccctccccacccgctctggttccagcccaccacccttacaggcctgcaaagctccctcttcaactctggactttgtaccagtcaccggacgttcagttgtttatcaacctgagcacctgcctgctgaggtgtctgcccctctagggcccgctggacgcttctctggatcccagctgtacaaaccgcaagcattggggggtgagggtgaggtctacacccataaagttcttggcaaaagcttgggggagaggttctgccggccccagccggaagcttactccgcggattgtgcacagttcttgaaggtgggaacagaagagaaggcccgggggggccggggagggggtacccaggctctgcacagtacccaaggggcttctggcagcaggaaggaagctacacatcagagttggggacttgtgccctggggctgcctggcatctgggggcctcctcagagccagggctctttctggttgaggctgagactcactggtgtcatcaggcccctccatgaatgagacaaacaaaacacttgttgggccttcggagctccccacagcgtctgctgtggcccctggcccaggcactggggctcgggcatggcctgtgctggtaggatttgtgctgggggctgtggtcctctcgctcctcattgcacttgctgccaaatgccacctctgccgccgataccatgccagctaccggcaccgcccactgcctgagacaggaaggggaggccgcccacaggtggctgaagatgaggatgatgatggcttcatcgaggacaattacattcagcctgggactggcgagctggggacagagggtagcagggaccacttctccctctgagctcccatctttagaccctccccactccctccatgcctgacagcttaaggacagtggttatgacatgggggccttgaacctcagggacagaggtggctggggcttaaaggttggccagggatggagtaaaccccacttccctgacactagccagcaaagtgacaatgaccctctcttgctcaataactctcaactgttccctgctgttctcaggataaagccaaacaaaggcttgagtgtggacataaggccctctgtgatcatgcctctcggcctcttggtttcttttcttgccttcccctactttactgtcgaaatcaatgttattctccctcccaccacttcccatgcagtttccccaggcacctttgctcacattggtccccctgcctacgctactcttctcct

SEQ ID NO: 463036 - DNA, 1177 bp, Homo sapiens
gaccttcaaagtagtgtctctgcttaaaagtgtgggaccatccagttgcaggaaaacaagcttaacacgcccactgattctacattatgctcctacctcccagcagcctctccaggcccagaactttctccagtcagcctctacagaccaagctcatgactcacaatggcctatttaggcccataccctacctcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcacctccaggcccagcctctgcctcccgtcggcctctacaatcccaacatctgcctcacagcagattcttcaggcccagcatctgcctcactgcctagcgtttgctgctttgcatcctctccaggccctggacttcctccagtcggcctctccaggcccagctcttcctctcggcggcctctgcaggcccagactgtcgtcaagtcggcctgtccagggccagctcctgcctcccggcggcctctgcaggcccaagtcgtcctcaagttggcctccccaggcccagcaacggcctctcggcggcctttccgggtgcaaaaccgcttcggcaggcccagctcccgcctgccagtggcctcttcaggcccatggggctcattcctcacaacggcctttccaggcccagtttttcccttccggcggcctctccgggcccagaacctcctcaagtcggcctctccagacccacttgcagcctccgggcgtcctctctgggcccagctcttcctcccggctgctctccaggcccgactcctgcctctcaacaacctttttggactcagtgcctacccatctcctggcggccttggtcggcccacagcttcctcaagccaagctccccaggcccaggtcaggcctcacggtggcctctccaggatgagctcctgccctccgatggcatctgcaggccccaaatggtctccggtcggtgggctcctccacgccaagcttgggcctcccggcgacctctgcagacccaagttgtcctgaagtcggcctctccc

SEQ ID NO: 463037 - DNA, 1244 bp, Homo sapiens
cggctcccacttggttgcgactacaggtgcttgcaccatgcccaactaatatttgggaattttcatataagtggattccagaggggtgacagcaaaacgtgggaccatccagttgcaggaaaacaagcttaacacgcccactgattctacattatgctcctacctcccagcagcctctccaggcccagaactttctccagtcagcctctacagaccaagctcatgactcacaatggcctatttaggcccataccctacctcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcacctccaggcccagcctctgcctcccgtcggcctctacaatcccaacatctgcctcacagcagattcttcaggcccagcatctgcctcactgcctagcgtttgctgctttgcatcctctccaggccctggacttcctccagtcggcctctccaggcccagctcttcctctcggcggcctctgcaggcccagactgtcgtcaagtcggcctgtccagggccagctcctgcctcccggcggcctctgcaggcccaagtcgtcctcaagttggcctccccaggcccagcaacggcctctcggcggcctttccgggtgcaaaaccgcttcggcaggcccagctcccgcctgccagtggcctcttcaggcccatggggctcattcctcacaacggcctttccaggcccagtttttcccttccggcggcctctccgggcccagaacctcctcaagtcggcctctccagacccacttgcagcctccgggcgtcctctctgggcccagctcttcctcccggctgctctccaggcccgactcctgcctctcaacaacctttttggactcagtgcctacccatctcctggcggccttggtcggcccacagcttcctcaagccaagctccccaggcccaggtcaggcctcacggtggcctctccaggatgagctcctgccctccgatggcatctgcaggccccaaatggtctccggtcggtgggctcctccacgccaagcttgggcctcccggcgacctctgcagacccaagttgtcctgaagtcggcctctccc

SEQ ID NO: 463038 - DNA, 1139 bp, Homo sapiens
tggaaataaagtgcctaataaatgtaaatgtgcttaaatcttttggcccagctcctacctcccagcagcctctccaggcccagaactttctccagtcagcctctacagaccaagctcatgactcacaatggcctatttaggcccataccctacctcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcacctccaggcccagcctctgcctcccgtcggcctctacaatcccaacatctgcctcacagcagattcttcaggcccagcatctgcctcactgcctagcgtttgctgctttgcatcctctccaggccctggacttcctccagtcggcctctccaggcccagctcttcctctcggcggcctctgcaggcccagactgtcgtcaagtcggcctgtccagggccagctcctgcctcccggcggcctctgcaggcccaagtcgtcctcaagttggcctccccaggcccagcaacggcctctcggcggcctttccgggtgcaaaaccgcttcggcaggcccagctcccgcctgccagtggcctcttcaggcccatggggctcattcctcacaacggcctttccaggcccagtttttcccttccggcggcctctccgggcccagaacctcctcaagtcggcctctccagacccacttgcagcctccgggcgtcctctctgggcccagctcttcctcccggctgctctccaggcccgactcctgcctctcaacaacctttttggactcagtgcctacccatctcctggcggccttggtcggcccacagcttcctcaagccaagctccccaggcccaggtcaggcctcacggtggcctctccaggatgagctcctgccctccgatggcatctgcaggccccaaatggtctccggtcggtgggctcctccacgccaagcttgggcctcccggcgacctctgcagacccaagttgtcctgaagtcggcctctccc

SEQ ID NO: 463039 - DNA, 1092 bp, Homo sapiens
  misc_feature (3)..(3): n is a, c, g, or t
  misc_feature (5)..(9): n is a, c, g, or t
  misc_feature (12)..(12): n is a, c, g, or t
  misc_feature (14)..(16): n is a, c, g, or t
gtntnnnnntgntnnnagattgtaaaacactcagattgacttttattaccttgatcagtacaaaaagtacttactgggtttatatcgtttctcttttggtgccgagcggcttctgaggtggagatatggatctgggggatgtcagcgtagagaaggtgatggaatccacagacggcatgagctctccacagatgtgtggggatatcctgcacatacatcagctctcagggctggaggtgaccgtggaggagagggatcctgtgagctctaatacaaaaaaccgagacattctgaacgttgctatagaggttagcaaagcagaaggctctgagggtagaggatgtgcctggcaaaatccaagtgggtttctggctgaagctgttctgtgggctgccatgtttgtgggacatctcatctgcagccgccgcagcgacctccttgtccgtccagccaaggggagggaccggaagccaagcggaggggccggtagcgccgtcgttgctgatgcttctgcttttggaattcggatcataaactgacagggttcttcctgtttcttaataaagctatttgttttactgtctaatgtgtttctaagcagaaatagacaaacaaaaggacaattgattctagaagagagatttagtatggagtatttgaagaaaagtattgccttagaaataaggatgttttgtagttaattttacattaaaagttctgccatattgattaggatttagaaataacatacgaagagttcttcctgagtagcagtataggaacaccagaactctataaacattttattcatcattcttcatctgatttttttccaaaatctttttgctccctttgatttctctctttttttctgctctttcaaatgcctagacagagccatattgattaggccagtatttacatatcacatgcccctgacgtgggtttaatgccccgtagtgtttgatgctgtggtctgggaaagaatggaacaggtagctgcccgctgagtcaacgaggcccatgcagttatcatcgatttttatttttctctttaatcatttagccaaggttgcctctttaaaatatcta

SEQ ID NO: 463040 - DNA, 968 bp, Homo sapiens
gcctaggacagctcctctcctgccagagctaggcaggcgccgaagtagccgcatggccccgtcagaagaccccagggactggagagccaacctcaaaggcaccatccgtgagacaggcctggagaccagctccggtgggaagctggctggccatcagaagaccgtccccacggctcacctgacttttgttattgactgcacccacgggaagcagctctccctggcagcaaccgcatcaccaccccaagcccccagtcccaatcgagggcttgtcaccccaccaatgaagacctacatcgtgttctgtggggaaaactggccccatctgactcgggtgacccccatgggtgggggatgccttgcccaggccagggccaccctgccgctctgcagagggtctgtggcctcagcttccttcccagtcagcccgctctgcccccaggaggttcccgaggctaaggggaaacccgtgaaggctgcgcctgtgaggtcttcaacttggggaacagtcaaggactcactgaaagccctctcctcttgtgtctgtgggcaggccgattagctggaagggccgggctctgatgcccagaggctgcaattcccagggcctggccctgcttccccagctaagcaggagtcttttgtgcttgagccaaggaaacatcattagatccgctaaggggcatctgaaacatccgtcgagtggcagaggcaggataagtcacctgcacatgaagagactcattcattcatacagcaaatattactggtacatcttccacatgccaggccctgcaaagtgctggggagataccatggttttcctggagctggtatttttggggtggagggaacccaccctgaataaataaagtaacccaataaataaagaagatgattttgaacagcgatgaatgctctgcaggaactgaaacaggatgctagagggagagtgattggggtgaaga

SEQ ID NO: 463041 - DNA, 7280 bp, Homo sapiens
  misc_feature (6052)..(6052): n is a, c, g, or t
cgtctagcgctctctgtatcaatgccccaactctggttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaaggcttgtcactggccctttttgagcagggtaggggaagggagctctccaaatcccttgggcccttttctgcaaaccttcctccatcatctgccctgtgcctgacacaagggacacacgggacatgcagaaccagatcagccaccgctgccgggcggactcaccgtctgcagaccctcaggccctgggagtttctcggcccgacctttgccctccgtcctgttcctgtttgctgcagcagccaggggaggagcagccaccagctcaagccccagggcacgtctgcaccgccgcccaccatctgcagcccaccccggggcaggacgctcctgcctccacagccccgggggcctgtcagaccaggacccttaccctctagacatggcctcggtcccctgcaaaccccagccccgtagccctgcgaggttacagacagcctaaacgccaccaccacagggcctgtgccgtgcccctgacccgggcacagaaggccactggcccggaggccatggagacggtgcccccagcagtggacctggtgctgggtgcttctgcctgctgcctggcctgtgtcttcaccaaccccctggaggtggtgaagacgcggctgcagctgcagggggagctgcaggcccggggcacctacccacggccctaccatggcttcatagcctctgtcgctgctgtggcccgagcagacgggctgtggggcctgcagaaggggctggctgccggccttctgtaccaaggcctcatgaatggcgttcgtttctactgctacagcctggcgtgccaggctggcctcacgcagcaaccaggtggcaccgtggttgcgggagccgtggcgggggcactgggagccttcgtggggagccctgcttacctgatcaaaacgcagctgcaagctcagacagtggccgcagtggccgtgggacaccagcacaatcaccagactgtcctgggtgccttggagaccatctggcggcagcaagggctcttggggctgtggcagggcgttggtggggctgtgccccgagtcatggtgggctcagctgcccagctggccaccttcgcctctgccaaggcctgggtacagaagcaacagtggctccctgaggacagctggctggtggccctggctgggggcatgatcagcagcatagccgtggttgtcgtcatgactcccttcgatgtggtcagcacgcggctatacaatcagccggtggacacagctggcaggggccagctctatgggggcctcaccgactgcatggtgaagatctggcggcaggagggccccctggcactctacaagggcctgggccccgcctacctgcgcctgggcccccacaccatcctcagcatgctcttctgggacgagcttcggaaactggctgggcgggcccagcacaagggcacctagacgacggccctcacccccacgtcctgacacggccggcacttggccggaagtgagagcctgctccaggacaactggctgtcccggggcgggccatgggcccaggccctgccagaggtcccgggagagtgtggacagctctggtccatccagccccttggcccacccaggtccagagcatccacttcaagttaccacccattctgtcttccagacagttctcttccttctctgtactgcgtactgggtcaccacatcccagagccttgctcagttatagcaactgctgcgggcgtgcacatggcataggcccagtaacttacatacatcggctcacttaggcctcagacagcagcacgaggcaggcacttttacttcttttaccattagaaagccaaggcctagagtggtgggctttgaccacagccacacaattttgaagtggcagagccaggactggagcttagccctgctcaccctagacctatgcgcttgacaagtgcgtgactgtgacaggcccatgggcccggactgcccataggggtcactgtaccatggcaaaggctgaggtgcaccaggaggctgtggcgtcgtcacctgccttatttgctggagaagctgtagcaaagaaccacagactgggcgacttagacaatagaaatgtattttctcacagttctggaggctggatgctggagaccaaggtgtcagtgggctggtttcttctgaggcctctgtccatggcttgcagatgctgctttcnctctgtgtctgcacatggtggtccctcgatgtgcgtctgggtcctgatctcctcctcttataaggacacaaatcatgttggcttagggcccaccctcatgaccccactttaatttttttttttttttttgagatgaagtctcactctgccacccaagctggagtgcagtggcacgatctcggttcactgcaaccttggcctcctaggttcaagcaattctcctgccccagcctcctgagtagctgggattacaggtgtgtgccaccacacccggccaatttttgtatctttagtagagatggggttttgccatgttggccagactggtctcgaactcctgacctcaagtgatccactggccttggcctcccaaagtgctgggattacaggcatgagccacctcacttggcccaattttaacttaattatctctgtcaagagcctatctccatatacagtcacatcctgagctactagggggtaggacttcaacatgcacttctgcaggggccgcagttcagccaacatcatctttttttttgagatggagtctcgctttgttgcccaggctggagtgcggtggtgcaatctcggctcaccacaacctccacctcccaggttcaagtgattctcctgcctcagcctcccgagttgctgggactataggtgtgcgccaccatgcccagctaattttgtatttttagtagagacaggctttcgctgtgttggccaggctggtcttgaatgcctgaccttgccgcccgcctcggcctcccaaaatgctgggattacaggcgtgagccaccgcgcctggcctcagccaacatcatctaagggctctcacggagggcctcccagctgcccgccctgtgggcatttgcacatatcctgacaagcctgaaagaagctccgggtgcccattgttcagtccaggtgcccattgttcccgggactgaggcccgggaaagggaagcgacgtggcagggccagcagcagaccctgggcctttctctagactgagcaccattccccgtgggtgtgctctcagcgccgcaccgaccttcacactgcagagatggatgccaactccctggcaggggcaggactgctgccgagcagccccacctgccctcccagccacaccccaagtctgtaagggccgctcccaggaacacctgctactgcacactccaaaccaataaagttttatattttgtttacttcaaaa

SEQ ID NO: 463042 - DNA, 1216 bp, Homo sapiens
tatccaagttaaaatgattacgcagccagggatttgcaccaaccagtctcacactataagcggcagtgattctattattaaccccccgcccacgatgataaagaaaaaatgaggaaatgctgtgaagaactaatagaacgtttcagaagcagaacaagtcgagagcagtgatgacccttttgttcctgctagtacctcctgtctgtctggccgaactcaccatcagatgatgtcttgaacctcacctagatgggctggtggtgtgtggccaggttaagagcaccaacaggagtaagaaagtgacctgcctggttttaccgtgtgtactaggggaggggttgaaagctttcggttgatacatcacctctgggagttgaagaagaatgcaattaagagagctaaagaagtcagtatagaatctgaaactcagaggtcaactgatgtgtcaaagatacctccacaaatcagtaccttgattaaaactaaaattggagtcatcttcatatcttcatctttctccctcttcattaggaccgattgtagtctgtttccctctcactcacttgcaatctttattgctttagtgttgcatttgatttttatctttgtttttgttttaaatactgtcattaaagtcatagaaaaatctaaaataaaactggttgaataaaaattttaaaatcgactctaatgtaataaaccagacaaaaatgatactttacatgttatatcttccctttaaactacaaatattcattgagtctataagcaacagggaccatggggggcctcagacttcagcacctgagaggcagtttcagtcgtattggggagatgcaggcatctgggttgctgcacatcaccagggcagggttctctcagcagccctggagtgcagagttcccatcagctcagcagtgaggggcacatggggctccagtgaggaaacagagaaagttaaaagctgtgagactgaaagtaacttgcaacgtttgaacagcagcaagaagatctgtggccccagactgagtcctgatgagacatatggtgtctgggcaaggggtgtggtggaggaggtgaagttggattgccgtttatacacacaggaatattggggctgggcaggttggcatggaacgctgaaactgaaatttgggactccagttgcccagtacacatctacatgaagatgatgcaaggctagtgtatacacgaa

SEQ ID NO: 463043 - DNA, 1486 bp, Homo sapiens
tttcctaggaagctgatgcttacaacaatggagattagcaatacctggacagagttgagcttcaaaggatactgagaaatggctaaagcagatgataaagaaaaaatgaggaaatgctgtgaagaactaatagaacgtttcagaagcagaacaagtcgagagcagtgatgacccttttgttcctgctagtacctcctgtctgtctggccgaactcaccatcagatgatgtcttgaacctcacctagatgggctggtggtgtgtggccaggttaagagcaccaacaggagtaagaaagtgacctgcctggttttaccgtgtgtactaggggaggggttgaaagctttcggttgatacatcacctctgggagttgaagaagaatgcaattaagagagctaaagaagtcagtaggtatctctcctgaacaattctggttttcttctaatagcttttacaatttttacctctgttatgaaatgcaaacttttaaccaatattagtaatagtaatctcaaatctcatcatcatcaaaatcttatttatgaaatataggagttagttcatatacagccttagccttttccacattataaaatatattccatatatatgtgtgatcttcatttaatattcaagtaaatgttgtaagatattgttatttttattctaacatttcacaggtatagaatctgaaactcagaggtcaactgatgtgtcaaagatacctccacaaatcagtaccttgattaaaactaaaattggagtcatcttcatatcttcatctttctccctcttcattaggaccgattgtagtctgtttccctctcactcacttgcaatctttattgctttagtgttgcatttgatttttatctttgtttttgttttaaatactgtcattaaagtcatagaaaaatctaaaataaaactggttgaataaaaattttaaaatcgactctaatgtaataaaccagacaaaaatgatactttacatgttatatcttccctttaaactacaaatattcattgagtctataagcaacagggaccatggggggcctcagacttcagcacctgagaggcagtttcagtcgtattggggagatgcaggcatctgggttgctgcacatcaccagggcagggttctctcagcagccctggagtgcagagttcccatcagctcagcagtgaggggcacatggggctccagtgaggaaacagagaaagttaaaagctgtgagactgaaagtaacttgcaacgtttgaacagcagcaagaagatctgtggccccagactgagtcctgatgagacatatggtgtctgggcaaggggtgtggtggaggaggtgaagttggattgccgtttatacacacaggaatattggggctgggcaggttggcatggaacgctgaaactgaaatttgggactccagttgcccagtacacatctacatgaagatgatgcaaggctagtgtatacacgaa

SEQ ID NO: 463044 - DNA, 6834 bp, Homo sapiens
tatagcttcaggcttttggctaagataccctgtctacgctgttctcctctatcttctctattatagtgacgtctgtgtacattctacctcagcgtctacgctgttctcctctatcttctctattacagtgggtgtctgtgtacattctttctcagcgtctacactattctctatcttctctattacagtgggcgtctgtgtacattcttgctcagcatctacgctgttctccatcttctctatcacagtgggcgtctgtttacattcttgctcagcgtctgcgctgttctccatcctctgtatcacagtggacgtttgtgtacattcttgctcagcgtctacgctgttctcctctatcttctctattacagtgggcgtctgtgtacattctcgctcagcgtctacactgttctctactctattacagtgggcatctgtgtacattcttgctcagcgtctacactgttctcctctgtcttctctatcacagtggacatctgtgtacatacttgctcagcgtctacactgttctctatcttctctattacagtggaaatctctgtacattcttgctcattatctacactgttctcctctatcttctctatcacagtggacatctgtgtacattcttgctcagcatctacactgttctctatcttctctatcacagtgggtgtctgtgtacattcttgctcagcgtctacactgtcctctatcttctctattacagtggacgtctgtgtacattctacctcagcgtctatgctgttctcctctactctatcacagtgggtgtttgtgtacattcttgctcagagtctacactgttctcttctatcttctctattacagtgggcgtctgtgtacattctacctcagcgtctacgctgttctcctctatcttctctattacagtggacatctgtgtacattcttgctcagagtctacactgttctctatcttctctattacagtgggcgtctgtgtacattcttgttcagcatctacgctgttctccatcttctctgttacagtggctgtctgtgtacattctcgctcagcatctatgctgttctcttctaggaatagcatctccgtgtttactttgtttaacttccaccttggataaagccttggtgtcattgtcaatcaagatctcctggtaagcatccaccccaccaagccagcgaatcaggtgtgctcttctgaattttgtacgtgacaagatattggaaatgtgtcaaacgttgtcctgaagggagggagtatccagtaatttctgtttagagccctgtaactgctctaagccctcacagtaaatacttttttcaaaacaaaacaaaacttaaaatagcctggttggctgtataccaaagttccctgtttggtgcactgaattggaaataattccacaagcagatgcattcatttgtttaatccaagaattattaagtgatttccttattctttatatatccagtgtgaggtgctgagtgcattcatagaagagaaatatcaggttccctgtccctggggtgtgctcagctcagtgacttcacagagggcacgtgatcttagagtagtagcagacgtggagcatagcctgaggcacaatcccagactgaattttgtattaggtatagtgacagttaatctaactctaaaaacatcagttatggacataaggatgggaacagtaggtactgggactactagagggggaagaggggatgggggcaagggctgaaaaactacccattgggtactaggctcaccccctgggtgatggagtcatttctaccccaagcctcagcgccacactacatacccatgtatcgagcctgtggatgtacccccgaatctaaaatagaagttgaaattataagcaaaaatttacattaaaaaaccctttaatgcccattagttacttataatctgtttaaagaatagccagttgctctcagccttttcatttgtttcattaattgcatctgtttatttactcagtctggtcaagaaaaatacccttaatcgtttatattaaaaagtaggtgccactataaaattctaagcttttgctgaaaatcgtgacctttgattgttcatactggtaatttatttctcatttttatgttgcaattacaacattcaaagcagtagactaagatctaatgatttagaagcaccagaggcattgctgggccaggatgacaagcctttaatgactctcttaggcagtaaaaaagccactgcaattgctgtatgaatattcatttaagaagcattcattggttgtaaatcttttaacatgtagactttaaaaaagatgaataacatactatgtaccccggtcattcttattgaatgtgtcttcagatattttttatcaaattcattttactgctctttttgcttatgaaaataaaatagtatttcattagttgagctcatttgaatattagaaataaacagagttcatatcatgtgaaattgctgacagctcttaaaatcagtcctgcactttgcccagaggcattattcacattgctggttacatctgttcttgggaaagagaacctgccttgactgtgaatgggggtccagtttgccccaggtttagtccctgtgatactcagcaaatgttgcctggttctttactaaatatggctaccctgtgatgagaagctttgggctgattgggccttatttgtcttcttttctcttactgggaaagcaaagactgctgaacataactgatgtcagaatgggcccgtgttagctatatactgtgtacaggtcaagcacataactattaatagtaaaaatcaacttagacaggggaacgggattcagatccagcagttttatcctagcccacactcttaaccacaattacaatggcaaacaaataaatatttttaattgtatgcagtatgatttagtattggaaagactgtttaaattttttaaatagactttaaattttagaaagtgtagatatacagcaaaattgtgaatagtacagagtgttcccctatatattctgtacccagttttccctattgacaccttatattagtatggtgcattattacaattaatgaaccaatattgatatactggtactaactaaagtccatactttattcagattcccttggattttacccagtgtctgtaccagtatgccacacaggataccacgttatttttggtccttgtgttgctttaggcttctcttggtacagtttttcatactttctttgtttttgatgatccttgacagtttggaggaatattattggtcaggtattttgtagaacgtaccttacgtggaaagaaggtaatacctgtctgaattttttttcatgattagagtggagttacggattttggggaggaagaccacagagataaagtgccgttttcattacatcctacctggaatatgctctattgacttgacttgttgattttgaccttgatcacctagctgaggtcgcgtttgtcagccttcgccactgcagagctcctccttttcccttccacactgtcctcgtcacagggacgtcactaggcaccacccagacctaaggagaggggagccacgttccacctccttgaaggaggagtatttaatatgtaaattatttggaattcctctgaacaggagatttgtcttttatttatatcagtatgtattcgtacacaatttattttatatctctagttataatccaatactactttatgttcttgcccaaaatattctaacttttggccgcagggaactttttcagttgatttctgtgtccgtttgacatatcctcatcattgcagagttgtttttttttttctttagcacctcctcactttctggcactacaagatgcttcaggcttattttttatgtttcctgctcatatcctagaagcagccatttcttcaatgtgccctgttttcttttattggagaatagttttagaaattggagaatttagaaattggagaatagttttagaaaacaagattgggcactatttatgtttattgctaatgagttttctttgcttctaggccctatgaaagttttaacttttaaattttttaagctgcttgagctgctatactaagcaactatttctgtaaatgttggtggccaaaagtgttaaataaatagtttaaaatttgtttttcattggggaaagaatgttgtattgtagttacagttgagaattgccaaaaataaaatttaaaaagaacaatacttagaagaacatttctaaaaacatttcttagaattgtataattgtctcagtcaacttgcttttattatttttcaagataatttttaatgattttatacaaagcagtgattccctgggtaatgattgtgaagattttgccttttgtgcttctcttttacagtggatttttcatttatttaacttggattagaattagaaatgcaaatacgtcagcaattgaatttaccccttggaatcttgctttttgctggacatttactatctgaattacacaaaggaaaaaagacaaggagcagtgtctgtacccaggagttattgtctagtagttaataacaagcactgtacaagcattgatcagtcaaaacaggaaatttagaaacaaccaggagaccatatcagatgtattctgggcaaatatcacccctgcccaggcctaaagaactgccaaaaatctttaaaatattggcttataaataatgtgaagtagaaaaaaaatttaaacatgacatctcagtgatatttctgcaaagggaggtttttttttaaataaagaagtgacagtaaaattgattttcactagctttaaagacagtatcatcctctgtatcgtaagatattactctgagaaacaccccttcattctttcaggtgaaaggcagcctattatcacaggcagccaaccactgcaacagctggtattgacaaaggctctgaccccttttggttaaaaatgaagcaaaaatctgagtgttcgtagggcttcctaacctccggttgagctatatgtaagaacccttcacccattataataatccaggtatgcgatgttgtattacagtgacctgcagggtcatgacttagtgagaggcattctttgtcaacacagggaaagttaacacagaaggtaaaatttagaagaaaggtgaatggttataatattctttcagtgcgtgtgtgtgtgtgtgtgtgcgcgcgtgcacgcacatttgtgtgtatatatttgtatattccttcagcaacatgtcatatggtctaggaatccctgggcgatttctggttttggagaataggatgtgaatgtacctctgaaactgacagaatgatgtattaccttgtaggtcactggagtagagtccagatgtgcttaagcatttatgaaaagttacctattgtcacagaggccccgtaccacatgagtcctgtgagactttaaaggaaatctaaccaaaattgaactctatttcaggtatagcattttctgtggtttgataatgacattatacctattaaaataattttttgccctcattattaaaaccattagtttatttagtgacttcacagtcacaagttttttatatttcctgggcaagcaaaacctcagtagcataaacttagttttgtcactgccccggggatcccacttcatatgggccaataaatttccaggcaactacaagtattatgtcatatgtgcaaaaatgtgatgtcttttttgatccaaacctttgccagacattcaagagaggttaggatgtagtaagtgtttgtaaaagactggagctctcagtaggccaagtatagcgtagaaactggcagtggtgaaaacctggctgcaggtacaagagaacacacgtatatggattgtagttacagctttagtgtgagcgaattaatcttcattgtacgagggacccaatgtaattcttcagacgtttttgtggaaaatcttcgtgaaggagacttagatcattgttgtgccgtagaatttctctgataatggaaatgttctctctttgttgtgcaatatggcaatcagtagccgttttcatgtatcaaacacttgaaatgcgttgaatgtgactgaggaattgaatttcaaatttaattttaatgatgttttaaatttaaatagctacatgtggttagtgactaccttttggatagcacagctctagatggctaggtttggcatgtctactcgtgagataatgtctgtgaaaaactgtggcatgcagccgggtgcagtggctgacgcctgtaatcccagcactttcggaggcctaagcaggcggaacacgaggtcgggagttcgagaccagcctggccgatatagtgaaaccctgtctctactaaagatacaaaaattagccgggcatgatggcacatgcccgtagtcccagctactcgggaggctgaggcaggagaaccgcttgaacccaggaggtgggaggttgtggtgagctgagatcgcactactgcactccagcctgggtgactgggcgagcctccatgtcaaaaaaaaaaaaacaaaaaaaccccacaagaactgtagtatatgaagtgttcaaaaaaatgtttacttttccccttaggaagtgtgtagacccccttgatacttttttaaaacaacaacccacaggttaataaatcttttgttttaactttcccagtatagtgccattgctcatgtacctcttaaatttcatgatggtatgaggaacctttagagctgcagttatagagaagtacataaaaacagcgtacctctcttaattgtgc

SEQ ID NO: 463045 - DNA, 696 bp, Homo sapiens
agaggatccggggaagaagatcaaacccaccatgcgccagctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacaaaattgaaaagaaggggaaggggaaaaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacat

SEQ ID NO: 463046 - DNA, 3520 bp, Homo sapiens
tttaatcttctgtcatctctgtcccacctggctcatcagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagtggccattactgagctgagagatgtcattgccacagggaggacctataggcacatgctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagtggccattactgagctgagagatgtcattgccacagggaggacctataggcacatgctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttcgctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaccatgttggcttttctcttgacgtgggagtggccattactgagctgagagatgtcattgccacagggaggacctataggcacatgctcagcagggagctgctggatgagaaagggcctgaagtcttgcaggactcactggatagatgttcttcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagagccgctggcaggagacagcatgtcacccaggactctgccggtgcagaatatgaacaatgccatgttcttgcagaaaacgcttagcctgagtttcataggagatccacattgaaatatattaac

SEQ ID NO: 463047 - DNA, 1015 bp, Homo sapiens
  misc_feature (283)..(283): n is a, c, g, or t
  misc_feature (396)..(396): n is a, c, g, or t
atggttctcctcatctacatagagaaacagctccacacccccatgtacttcctcctcagtcaactgtcccttatggacctcatgctcatctgcaccactctacccaagatgatcttcagctacttgtctgggaagaaatctatctctctggcaggttgtggaactcagatattcttctatgtgtccctgcttggagctgaatgtttcttgttggctgtcatggcttatgaccgctatgtggctatatgtcaccctcttcagtacaccatcctcatgaatccgnaactctgtgtcttcatgactgttgcttcctggaccttggggtctcttgatgggatcatagtgcttgcagctgtcctgtcattttcttactgcagctctctggaaattcatcantttttctgtgatgttgctgcccttttacctctatcctgcacagaaacatctgcatttgaaagactacttgtcatttgttgtgtggtaatgctaatctttccagtttcagttatcatactttcctattcccatgtccttcgagccgtcatccacatgggctctggggaaagtcgtcgcaaggccttcactacctgctcctcccacctgtctgtggtcggactctactacggtgctgctatgttcatgtacatgagaccagcttctaaacatacgccagaccaggacaagatggtgtcggccttctacactattctcacccctatgctgaaccctctcatttatagcctccgcaacaaagaagtgttcagggcactacagaagaaggctccactgatcgttcacatgcaaggacagcaatttaacaataatccatacacgaacaacacattcatgagagccaaaaatcagaggggaattactgatcccagtggtcaaaacttgtgttcccacaaaccttgacactgagggctaaaatgcgctgaggctctaagtaaacttaaaaggcggtctatgccataagtactgcaactcttagatgtttcgggctacagccctccct

SEQ ID NO: 463048 - DNA, 1301 bp, Homo sapiens
ctcgcctttatccgtttttccaggtccttcacgtcctcctcttcttcctcccattggttacatcaaaggtccgggggccccccagggccaccttgtcttcctccaccaaagccacctcggtccatgcccagccaccacggaagccacttctgtctctaccacagccacctctgaacattccaccgggaccaccatgatccatgaggccacctcttcctccccacatgccaccagggccacctctgccatgatcaccacccgggggtgggaagggtggcgggaggaagccttcaggctttggagccttacacttgttgctctctgttctccaggcgaagttctggtttccacaacccggattgggacactgcctgtctccagcttggtgctggacgtttcctcctccagaggtgttccctcgggaaccctggggtcctcttggagggaggcctcctctatctcctccacggcctcccatgtgacccatgggtcccccaggacttcctgggcctcctggacctccgcagagtggtggtggcatccctctgccctcacggggtggcataccaccctgcatactgttcactggaggcctcttccgagcaagagagactttaagtttgctcccttgaaaatctttcccatcaaaccattccacggcagctttggcagtagactcataaggacatttatgcttgtcggatcatgtgttctgatttctggtactcgatgccctgccaaggattgattcactcttgccacatgttccccaggcctagtgcatcaataggctaatagtgaagtaaatgggctttggagtcagacagacatcctaggtgggcatctcagcaccagcacatattagctgttcttcagcagttttctcatctgtaaaggagagataataacacttacctcacaagatttggggtatttggctttgttttttattttttcaagcagtgagttaagaaatattgtgtaattattacatactttaaacagtttcaagcatatagtaagcacttgataaatgttagctgtctttattttggaaacattggtgctgtaaatttaaattctgcttatcttcattcaagtcaaaattatataagactcttttctgtttcccaagtctgtagttgtacttttctaattgtaaaacatggtatctggtataaatgggtcccctccttgggggagcgtctcctttttagcccagaaagtaaaggcaaaattttgcagtgcttctttctaattttcagactgctctagagtgaatcctatttaatcagcttatt

SEQ ID NO: 463049 - DNA, 1092 bp, Homo sapiens
  misc_feature (5)..(5): n is a, c, g, or t
  misc_feature (7)..(9): n is a, c, g, or t
  misc_feature (11)..(11): n is a, c, g, or t
gtagntnnntnaggtggcagcggggtggctgcccaggggacagtcccctcctcctcagctggctggatgctcacagcgcgcccttcctgagctcttggcaaatgcacgtgttaacccgctgcggggaggaagctggaagtgccggggagtaggggagtgagggagggctggacttccgcaggagaaataaagcgacttgcagtgacactggctgtcccccttccctccccgcctcgctgccctctcagcctcctgcttaaggagactcttctggagaaacatgctttaggaggcctgaaagccaaggctgctccgtggctgtggaggtcaaggctgtgtgcgtaagaagcccagggcgtgggtctggccttgtgtgggcctggtgctccttctccactgggaattagggattaatcccagaattttcagaaaaaatttttttgagaagatgagcttaaatgacagtatcttctcccggattagaattacgcttgcattatgatggaaataatgaacaggttgtaattttaaaatgtgtcattttgtcaggaagattactaagtgatgcactttataagctgttacccaccaatgttgacagatactttctggaggtggaaaaagaggtatcagaatccaaagaaacactgcccccaccaaaatttgagacccatttacttgcatcagtgacactgaacacccagctttgtttcatttggtgcagagaaaagtgggctgtgtgcctttcctccctgcccagactcccgtgtggtggcattgaagagtgtccttcatggggggacagctgggccacataccccggcggcagcatggaggccccagggacagtggcagcagacggcttagcctcaactaatagcaaacaggactttcaacctctttctcactggcaagttttcagggtttaagacgtattgtctttagaagcgagggactctgtgtgtgctccaagaatgggttactagtccagcaggaaagaacaatgagtacaggcaggactccttccttttttagtttggaaattaactcatctttagtcattttacagtctaaaatcctttttggaataag

SEQ ID NO: 463050 - DNA, 1378 bp, Homo sapiens
gcttcctctcagcccgctctgagctggaagcagcatgtgggacctggccctgatcttcctcgcagcagcctgcgtgttctcactaggggtcactctgtgggtcatttgcagccattttttcactgtgcacatccctgcagcggttggccaccctgtgaaactgagagtcctccattgcatcttccagctgctgttgacttgggggatgatatttgagaagctcagaatctgttctatgccccaatttttctgtttcatgcaagatctgcctccgctaaagtatgaccccgatgttgtggtcacggatttccgctttgggacaatccctgtgaagctgtaccaacccaaggcatccacctgcaccctgaagcctggcatcgtgtactaccacggtggcgggggcgtcatggggagtttgaaaacccaccatggcatatgctctcgtttgtgcaaggagagtgactccgtggttctggcagttggttaccgcaagttacctaagcataagtttccagtgccagtaagagactgcttggtggccaccatccacttcctgaagtccctggatgcatatggagtggatccagcccgggttgtggtctgcggtgacagtttcggaggggcaatagccgcagtggtttgtcaacaacttgtggacaggccagatctgccccggatccgggctcagatcctgatctatgccattctccaagccctggatttacaaaccccttcgtttcaacagaggaaaaacatcccactgctcacctggagtttcatctgctactgtttttttcaaaacctggatttcagctcctcctggcaagaggtcatcatgaaaggtgcccatttgcctgctgaagtctgggaaaagtacagaaagtggttgggcccagaaaacatccctgagaggtttaaggagaggggttaccaactgaagccccatgagcccattaatgaagctgcttacttggaagtaagtgttgtcctggatgtgatgtgctcgcccctgattgcagaagatgacatagtgtctcagctcccggaaacctgcatcgtgagctgtgagtatgatgctctccgggacaattcactgttgtacaagaaaaggctggaagacctgggagtgcccgtgacctggcaccatatggaggatggtttccatggagtgctcaggaccattgacatgagcttcttgcactttccctgctccatgagaattctgagtgcattagttcaatttgtaaagggactccggtaagagctgttctcagcctccctaaggggcagttcaggctcccagattgatccagactgtgtgtgactttcgtccatttgacttgactttggaatagcacaagggcatcatgtacttcac

SEQ ID NO: 463051 - DNA, 2615 bp, Homo sapiens
aggagggcgccacccaacgggcgggcgccaggggcaaccctgagaagctgacccttgagcccagagggggcaccgggcccagggatggccgctgacccccaggacccgcgcctggcccgaccagcgagttgcggcgggagaaggacgcggccaggcccagcatggagccccggcgcgaggccggggctggacctggacctgccggtcgggcctcatcaatgctgggcaggcagcctcggggccgcaccggtgagggtttccgcccggagtctttggcattctcctcctcctggcgtcccgggggcagaggcctgctggccatggacctgctggctggaggaaccacactcagggtggccttcaccaggcatctgtctacccaccccagcctcttgctcagtgatgtcaaggcactccgaagccttgtcaacaacccgcgatacagtgatgtttgcttcgtggttggtcaagaacggcaggaggtatttgcccatcggtgcttgttggcctgtagatgcaacttcttccagcgacttctgggcacagagccaggccccggggtgcccagtcctgtggtgctaagcactgtgccaactgaggccttcctggcagtgctggagttcctatataccaacagtgtcaagctgtaccgccactctgtgctggaagtgctgacagcggctgtggagtatgggctggaggaactgagagagtcccgccactagggagaggagaagacttcccagaggaggaaacatttgtgttcgatctggtagaacaaataggattttgttcctaggggaagtgggaagatggtattctagtcacagaggcaccaaaggagctagtgagacatttggtgtgtctgaactgtgaggagagggcaagacgagactgcagaggacgccagggcctggttcatgtagggccctcaagcttttggacttcttttaagcagagggcagtggagattcactgaaggtttccgataagggagtgaagaattggaaactcaggggagaagggattggaagaggtggagaggactcgctagtccagtcaggaggctagtgcagcagtcaagagatgagagatgtcacggatgaaattcaagtttctgctaaaaatagaagtatccttgagtcaggaagggaacaagtggaggaagataagcatcctgaaagaaggggagaattttgcatggcctttatctggttttgattagtggcgaatgtactagaagctgtgcctgcagtttgtggtgaaggtgctggatgtggacttggtttgtgaggccctgcaggtggccgtaacctttggcctggggcagctgcaggagcgctgcgtggctttcatagaggcccacagccaggtactgctcccttcatactcctcaccctacgcaccgcattctgctcctccctgacccatttgccggctcgcaggaggccctccggacccgaggcttcctggagctgtcggcggccgcgctgctgcccctgctccgcagcgacaagctctgcgtggacgaggctgaactggtccgcgcggcccgaagctgggcgcgcgtgggcgcggtgagtggggctgggggagcgcaagggcacggaaggaggtgctggccacgagactggtgagcgggcggcaggacaggtgcccgactcagggctggcgtttgcaggcggtgctggagcggccggtggctgaggtggcggccccggtggtgaaagagctgagactagccttgctggccccggcggagctgagcgccctggaagagcagaaccggcaggaaccactcatcccggtggggacgcggggaaccggcccagctccactcagcagggggtacagggcgctgggagggggcaggagcagcccggcccacggtcctcggggcgaggggccaccgcgggactgcgcactaactggccttgctctgcaggtggagcagattgtggaggcgtggaaatgccatgccctgcggagaggggatgaggcccggggcgccccgtgtcgccgccggagaggcaccctgccccgggagcatcaccgctttctggacctgtccttcaaatgatccaacgccgggactcgcagggagccctcgacccgcccagctgagcctgccccaaactacagctcccgaagtgctcggcgttcggagcgggcttccgttcccagcgtgcccagtgagccgggcgccggaagaaccgttgtctgccacgcgcagccccttgtgcgggatcaagcccgtgtgggcgaggtggggtcgggccgggcagggcttgggctgggcctccctgagggggtgaaactcgaaaacgaggatttccttcgttccacaccctgactctacgccctgcccctgggcattgtcgtctactagtctattctgatgactcccacatatctatctgttcagctcagctccctctttcttttctttttctttctctttctttctttctttctttctttctttctttctttctttctttctttctttctttctttctttttctttctttctctttccttccttccttccttccttccttctttctttctctttctctatctctttctttctttctttctttctctcctctctc

SEQ ID NO: 463052 - DNA, 2373 bp, Homo sapiens
aggagggcgccacccaacgggcgggcgccaggggcaaccctgagaagctgacccttgagcccagagggggcaccgggcccagggatggccgctgacccccaggacccgcgcctggcccgaccagcgagttgcggcgggagaaggacgcggccaggcccagcatggagccccggcgcgaggccggggctggacctggacctgccggtcgggcctcatcaatgctgggcaggcagcctcggggccgcaccggtgagggtttccgcccggagtctttggcattctcctcctcctggcgtcccgggggcagaggcctgctggccatggacctgctggctggaggaaccacactcagggtggccttcaccaggcatctgtctacccaccccagcctcttgctcagtgatgtcaaggcactccgaagccttgtcaacaacccgcgatacagtgatgtttgcttcgtggttggtcaagaacggcaggaggtatttgcccatcggtgcttgttggcctgtagatgcaacttcttccagcgacttctgggcacagagccaggccccggggtgcccagtcctgtggtgctaagcactgtgccaactgaggccttcctggcagtgctggagttcctatataccaacagtgtcaagctgtaccgccactctgtgctggaagtgctgacagcggctgtggagtatgggctggaggaactgagagagtcccgccactagggagaggagaagacttcccagaggaggaaacatttgtgttcgatctggtagaacaaataggattttgttcctaggggaagtgggaagatggtattctagtcacagaggcaccaaaggagctagtgagacatttggtgtgtctgaactgtgaggagagggcaagacgagactgcagaggacgccagggcctggttcatgtagggccctcaagcttttggacttcttttaagcagagggcagtggagattcactgaaggtttccgataagggagtgaagaattggaaactcaggggagaagggattggaagaggtggagaggactcgctagtccagtcaggaggctagtgcagcagtcaagagatgagagatgtcacggatgaaattcaagtttctgctaaaaatagaagtatccttgagtcaggaagggaacaagtggaggaagataagcatcctgaaagaaggggagaattttgcatggcctttatctggttttgattagtggcgaatgtactagaagctgtgcctgcagtttgtggtgaaggtgctggatgtggacttggtttgtgaggccctgcaggtggccgtaacctttggcctggggcagctgcaggagcgctgcgtggctttcatagaggcccacagccaggtactgctcccttcatactcctcaccctacgcaccgcattctgctcctccctgacccatttgccggctcgcaggaggccctccggacccgaggcttcctggagctgtcggcggccgcgctgctgcccctgctccgcagcgacaagctctgcgtggacgaggctgaactggtccgcgcggcccgaagctgggcgcgcgtgggcgcggcggtgctggagcggccggtggctgaggtggcggccccggtggtgaaagagctgagactagccttgctggccccggcggagctgagcgccctggaagagcagaaccggcaggaaccactcatcccggtggagcagattgtggaggcgtggaaatgccatgccctgcggagaggggatgaggcccggggcgccccgtgtcgccgccggagaggcaccctgccccgggagcatcaccgctttctggacctgtccttcaaatgatccaacgccgggactcgcagggagccctcgacccgcccagctgagcctgccccaaactacagctcccgaagtgctcggcgttcggagcgggcttccgttcccagcgtgcccagtgagccgggcgccggaagaaccgttgtctgccacgcgcagccccttgtgcgggatcaagcccgtgtgggcgaggtggggtcgggccgggcagggcttgggctgggcctccctgagggggtgaaactcgaaaacgaggatttccttcgttccacaccctgactctacgccctgcccctgggcattgtcgtctactagtctattctgatgactcccacatatctatctgttcagctcagctccctctttcttttctttttctttctctttctttctttctttctttctttctttctttctttctttctttctttctttctttctttctttttctttctttctctttccttccttccttccttccttccttctttctttctctttctctatctctttctttctttctttctttctctcctctctc

SEQ ID NO: 463053 - DNA, 2414 bp, Homo sapiens
aggagggcgccacccaacgggcgggcgccaggggcaaccctgagaagctgacccttgagcccagagggggcaccgggcccagggatggccgctgacccccaggacccgcgcctggcccgaccagcgagttgcggcgggagaaggacgcggccaggcccagcatggagccccggcgcgaggccggggctggacctggacctgccggtcgggcctcatcaatgctgggcaggcagcctcggggccgcaccggtgagggtttccgcccggagtctttggcattctcctcctcctggcgtcccgggggcagaggcctgctggccatggacctgctggctggaggaaccacactcagggtggccttcaccaggcatctgtctacccaccccagcctcttgctcagtgatgtcaaggcactccgaagccttgtcaacaacccgcgatacagtgatgtttgcttcgtggttggtcaagaacggcaggaggtatttgcccatcggtgcttgttggcctgtagatgcaacttcttccagcgacttctgggcacagagccaggccccggggtgcccagtcctgtggtgctaagcactgtgccaactgaggccttcctggcagtgctggagttcctatataccaacagtgtcaagctgtaccgccactctgtgctggaagtgctgacagcggctgtggagtatgggctggaggaactgagagagtcccgccactagggagaggagaagacttcccagaggaggaaacatttgtgttcgatctggtagaacaaataggattttgttcctaggggaagtgggaagatggtattctagtcacagaggcaccaaaggagctagtgagacatttggtgtgtctgaactgtgaggagagggcaagacgagactgcagaggacgccagggcctggttcatgtagggccctcaagcttttggacttcttttaagcagagggcagtggagattcactgaaggtttccgataagggagtgaagaattggaaactcaggggagaagggattggaagaggtggagaggactcgctagtccagtcaggaggctagtgcagcagtcaagagatgagagatgtcacggatgaaattcaagtttctgctaaaaatagaagtatccttgagtcaggaagggaacaagtggaggaagataagcatcctgaaagaaggggagaattttgcatggcctttatctggttttgattagtggcgaatgtactagaagctgtgcctgcagtttgtggtgaaggtgctggatgtggacttggtttgtgaggccctgcaggtggccgtaacctttggcctggggcagctgcaggagcgctgcgtggctttcatagaggcccacagccaggtactgctcccttcatactcctcaccctacgcaccgcattctgctcctccctgacccatttgccggctcgcaggaggccctccggacccgaggcttcctggagctgtcggcggccgcgctgctgcccctgctccgcagcgacaagctctgcgtggacgaggctgaactggtccgcgcggcccgaagctgggcgcgcgtgggcgcggcggtgctggagcggccggtggctgaggtggcggccccggtggtgaaagagctgagactagccttgctggccccggcggagctgagcgccctggaagagcagaaccggcaggaaccactcatcccggtggggacgcggggaaccggcccagctccactcagcagggggtggagcagattgtggaggcgtggaaatgccatgccctgcggagaggggatgaggcccggggcgccccgtgtcgccgccggagaggcaccctgccccgggagcatcaccgctttctggacctgtccttcaaatgatccaacgccgggactcgcagggagccctcgacccgcccagctgagcctgccccaaactacagctcccgaagtgctcggcgttcggagcgggcttccgttcccagcgtgcccagtgagccgggcgccggaagaaccgttgtctgccacgcgcagccccttgtgcgggatcaagcccgtgtgggcgaggtggggtcgggccgggcagggcttgggctgggcctccctgagggggtgaaactcgaaaacgaggatttccttcgttccacaccctgactctacgccctgcccctgggcattgtcgtctactagtctattctgatgactcccacatatctatctgttcagctcagctccctctttcttttctttttctttctctttctttctttctttctttctttctttctttctttctttctttctttctttctttctttctttttctttctttctctttccttccttccttccttccttccttctttctttctctttctctatctctttctttctttctttctttctctcctctctc

SEQ ID NO: 463054 - DNA, 284 bp, Homo sapiens
gctgggtgactcaccgctccaagcctgctcactgcttctggggtggaactagtgtcttggagcagggacaccgccacccaacccacattcatttctgttcccagctgtgcctgcagtttgtggtgaaggtgctggatgtggacttggtttgtgaggccctgcaggtgggtgctgctggacaggcatggtaggagtctggctctgtgtgtggaaatgggctcccagcacctgggagcctgggcctgctgtgtctggcctggaaataacttgggtacatggtggtg

SEQ ID NO: 463055 - DNA, 2477 bp, Homo sapiens
aggagggcgccacccaacgggcgggcgccaggggcaaccctgagaagctgacccttgagcccagagggggcaccgggcccagggatggccgctgacccccaggacccgcgcctggcccgaccagcgagttgcggcgggagaaggacgcggccaggcccagcatggagccccggcgcgaggccggggctggacctggacctgccggtcgggcctcatcaatgctgggcaggcagcctcggggccgcaccggtgagggtttccgcccggagtctttggcattctcctcctcctggcgtcccgggggcagaggcctgctggccatggacctgctggctggaggaaccacactcagggtggccttcaccaggcatctgtctacccaccccagcctcttgctcagtgatgtcaaggcactccgaagccttgtcaacaacccgcgatacagtgatgtttgcttcgtggttggtcaagaacggcaggaggtatttgcccatcggtgcttgttggcctgtagatgcaacttcttccagcgacttctgggcacagagccaggccccggggtgcccagtcctgtggtgctaagcactgtgccaactgaggccttcctggcagtgctggagttcctatataccaacagtgtcaagctgtaccgccactctgtgctggaagtgctgacagcggctgtggagtatgggctggaggaactgagagagtcccgccactagggagaggagaagacttcccagaggaggaaacatttgtgttcgatctggtagaacaaataggattttgttcctaggggaagtgggaagatggtattctagtcacagaggcaccaaaggagctagtgagacatttggtgtgtctgaactgtgaggagagggcaagacgagactgcagaggacgccagggcctggttcatgtagggccctcaagcttttggacttcttttaagcagagggcagtggagattcactgaaggtttccgataagggagtgaagaattggaaactcaggggagaagggattggaagaggtggagaggactcgctagtccagtcaggaggctagtgcagcagtcaagagatgagagatgtcacggatgaaattcaagtttctgctaaaaatagaagtatccttgagtcaggaagggaacaagtggaggaagataagcatcctgaaagaaggggagaattttgcatggcctttatctggttttgattagtggcgaatgtactagaagctgtgcctgcagtttgtggtgaaggtgctggatgtggacttggtttgtgaggccctgcaggtggccgtaacctttggcctggggcagctgcaggagcgctgcgtggctttcatagaggcccacagccaggtactgctcccttcatactcctcaccctacgcaccgcattctgctcctccctgacccatttgccggctcgcaggaggccctccggacccgaggcttcctggagctgtcggcggccgcgctgctgcccctgctccgcagcgacaagctctgcgtggacgaggctgaactggtccgcgcggcccgaagctgggcgcgcgtgggcgcggtgagtggggctgggggagcgcaagggcacggaaggaggtgctggccacgagactggtgagcgggcggcaggacaggtgcccgactcagggctggcgtttgcaggcggtgctggagcggccggtggctgaggtggcggccccggtggtgaaagagctgagactagccttgctggccccggcggagctgagcgccctggaagagcagaaccggcaggaaccactcatcccggtggagcagattgtggaggcgtggaaatgccatgccctgcggagaggggatgaggcccggggcgccccgtgtcgccgccggagaggcaccctgccccgggagcatcaccgctttctggacctgtccttcaaatgatccaacgccgggactcgcagggagccctcgacccgcccagctgagcctgccccaaactacagctcccgaagtgctcggcgttcggagcgggcttccgttcccagcgtgcccagtgagccgggcgccggaagaaccgttgtctgccacgcgcagccccttgtgcgggatcaagcccgtgtgggcgaggtggggtcgggccgggcagggcttgggctgggcctccctgagggggtgaaactcgaaaacgaggatttccttcgttccacaccctgactctacgccctgcccctgggcattgtcgtctactagtctattctgatgactcccacatatctatctgttcagctcagctccctctttcttttctttttctttctctttctttctttctttctttctttctttctttctttctttctttctttctttctttctttctttttctttctttctctttccttccttccttccttccttccttctttctttctctttctctatctctttctttctttctttctttctctcctctctc

SEQ ID NO: 463056 - DNA, 2518 bp, Homo sapiens
aggagggcgccacccaacgggcgggcgccaggggcaaccctgagaagctgacccttgagcccagagggggcaccgggcccagggatggccgctgacccccaggacccgcgcctggcccgaccagcgagttgcggcgggagaaggacgcggccaggcccagcatggagccccggcgcgaggccggggctggacctggacctgccggtcgggcctcatcaatgctgggcaggcagcctcggggccgcaccggtgagggtttccgcccggagtctttggcattctcctcctcctggcgtcccgggggcagaggcctgctggccatggacctgctggctggaggaaccacactcagggtggccttcaccaggcatctgtctacccaccccagcctcttgctcagtgatgtcaaggcactccgaagccttgtcaacaacccgcgatacagtgatgtttgcttcgtggttggtcaagaacggcaggaggtatttgcccatcggtgcttgttggcctgtagatgcaacttcttccagcgacttctgggcacagagccaggccccggggtgcccagtcctgtggtgctaagcactgtgccaactgaggccttcctggcagtgctggagttcctatataccaacagtgtcaagctgtaccgccactctgtgctggaagtgctgacagcggctgtggagtatgggctggaggaactgagagagtcccgccactagggagaggagaagacttcccagaggaggaaacatttgtgttcgatctggtagaacaaataggattttgttcctaggggaagtgggaagatggtattctagtcacagaggcaccaaaggagctagtgagacatttggtgtgtctgaactgtgaggagagggcaagacgagactgcagaggacgccagggcctggttcatgtagggccctcaagcttttggacttcttttaagcagagggcagtggagattcactgaaggtttccgataagggagtgaagaattggaaactcaggggagaagggattggaagaggtggagaggactcgctagtccagtcaggaggctagtgcagcagtcaagagatgagagatgtcacggatgaaattcaagtttctgctaaaaatagaagtatccttgagtcaggaagggaacaagtggaggaagataagcatcctgaaagaaggggagaattttgcatggcctttatctggttttgattagtggcgaatgtactagaagctgtgcctgcagtttgtggtgaaggtgctggatgtggacttggtttgtgaggccctgcaggtggccgtaacctttggcctggggcagctgcaggagcgctgcgtggctttcatagaggcccacagccaggtactgctcccttcatactcctcaccctacgcaccgcattctgctcctccctgacccatttgccggctcgcaggaggccctccggacccgaggcttcctggagctgtcggcggccgcgctgctgcccctgctccgcagcgacaagctctgcgtggacgaggctgaactggtccgcgcggcccgaagctgggcgcgcgtgggcgcggtgagtggggctgggggagcgcaagggcacggaaggaggtgctggccacgagactggtgagcgggcggcaggacaggtgcccgactcagggctggcgtttgcaggcggtgctggagcggccggtggctgaggtggcggccccggtggtgaaagagctgagactagccttgctggccccggcggagctgagcgccctggaagagcagaaccggcaggaaccactcatcccggtggggacgcggggaaccggcccagctccactcagcagggggtggagcagattgtggaggcgtggaaatgccatgccctgcggagaggggatgaggcccggggcgccccgtgtcgccgccggagaggcaccctgccccgggagcatcaccgctttctggacctgtccttcaaatgatccaacgccgggactcgcagggagccctcgacccgcccagctgagcctgccccaaactacagctcccgaagtgctcggcgttcggagcgggcttccgttcccagcgtgcccagtgagccgggcgccggaagaaccgttgtctgccacgcgcagccccttgtgcgggatcaagcccgtgtgggcgaggtggggtcgggccgggcagggcttgggctgggcctccctgagggggtgaaactcgaaaacgaggatttccttcgttccacaccctgactctacgccctgcccctgggcattgtcgtctactagtctattctgatgactcccacatatctatctgttcagctcagctccctctttcttttctttttctttctctttctttctttctttctttctttctttctttctttctttctttctttctttctttctttctttttctttctttctctttccttccttccttccttccttccttctttctttctctttctctatctctttctttctttctttctttctctcctctctc

SEQ ID NO: 463057 - DNA, 2511 bp, Homo sapiens
aggagggcgccacccaacgggcgggcgccaggggcaaccctgagaagctgacccttgagcccagagggggcaccgggcccagggatggccgctgacccccaggacccgcgcctggcccgaccagcgagttgcggcgggagaaggacgcggccaggcccagcatggagccccggcgcgaggccggggctggacctggacctgccggtcgggcctcatcaatgctgggcaggcagcctcggggccgcaccggtgagggtttccgcccggagtctttggcattctcctcctcctggcgtcccgggggcagaggcctgctggccatggacctgctggctggaggaaccacactcagggtggccttcaccaggcatctgtctacccaccccagcctcttgctcagtgatgtcaaggcactccgaagccttgtcaacaacccgcgatacagtgatgtttgcttcgtggttggtcaagaacggcaggaggtatttgcccatcggtgcttgttggcctgtagatgcaacttcttccagcgacttctgggcacagagccaggccccggggtgcccagtcctgtggtgctaagcactgtgccaactgaggccttcctggcagtgctggagttcctatataccaacagtgtcaagctgtaccgccactctgtgctggaagtgctgacagcggctgtggagtatgggctggaggaactgagagagtcccgccactagggagaggagaagacttcccagaggaggaaacatttgtgttcgatctggtagaacaaataggattttgttcctaggggaagtgggaagatggtattctagtcacagaggcaccaaaggagctagtgagacatttggtgtgtctgaactgtgaggagagggcaagacgagactgcagaggacgccagggcctggttcatgtagggccctcaagcttttggacttcttttaagcagagggcagtggagattcactgaaggtttccgataagggagtgaagaattggaaactcaggggagaagggattggaagaggtggagaggactcgctagtccagtcaggaggctagtgcagcagtcaagagatgagagatgtcacggatgaaattcaagtttctgctaaaaatagaagtatccttgagtcaggaagggaacaagtggaggaagataagcatcctgaaagaaggggagaattttgcatggcctttatctggttttgattagtggcgaatgtactagaagctgtgcctgcagtttgtggtgaaggtgctggatgtggacttggtttgtgaggccctgcaggtggccgtaacctttggcctggggcagctgcaggagcgctgcgtggctttcatagaggcccacagccaggtactgctcccttcatactcctcaccctacgcaccgcattctgctcctccctgacccatttgccggctcgcaggaggccctccggacccgaggcttcctggagctgtcggcggccgcgctgctgcccctgctccgcagcgacaagctctgcgtggacgaggctgaactggtccgcgcggcccgaagctgggcgcgcgtgggcgcggcggtgctggagcggccggtggctgaggtggcggccccggtggtgaaagagctgagactagccttgctggccccggcggagctgagcgccctggaagagcagaaccggcaggaaccactcatcccggtggggacgcggggaaccggcccagctccactcagcagggggtacagggcgctgggagggggcaggagcagcccggcccacggtcctcggggcgaggggccaccgcgggactgcgcactaactggccttgctctgcaggtggagcagattgtggaggcgtggaaatgccatgccctgcggagaggggatgaggcccggggcgccccgtgtcgccgccggagaggcaccctgccccgggagcatcaccgctttctggacctgtccttcaaatgatccaacgccgggactcgcagggagccctcgacccgcccagctgagcctgccccaaactacagctcccgaagtgctcggcgttcggagcgggcttccgttcccagcgtgcccagtgagccgggcgccggaagaaccgttgtctgccacgcgcagccccttgtgcgggatcaagcccgtgtgggcgaggtggggtcgggccgggcagggcttgggctgggcctccctgagggggtgaaactcgaaaacgaggatttccttcgttccacaccctgactctacgccctgcccctgggcattgtcgtctactagtctattctgatgactcccacatatctatctgttcagctcagctccctctttcttttctttttctttctctttctttctttctttctttctttctttctttctttctttctttctttctttctttctttctttttctttctttctctttccttccttccttccttccttccttctttctttctctttctctatctctttctttctttctttctttctctcctctctc

SEQ ID NO: 463058 - DNA, 2173 bp, Homo sapiens
cggcggtacatggcatcgaagacctgatgatccagcacaactgctcccgccagggccctacagcccctcccccgccccggggccccgcccttccaggcgcgggctccggcctccctgccccggacccttgtgactatgaaggccggttttcccggctgcatggtcgtcccccggggttcttgcattgcgcttccttcggggacccccatgtgcgcagcttccaccatcactttcacacatgccgtgtccaaggagcttggcctctactggataatgacttcctctttgtccaagccaccagctcccccatggcgttgggggccaacgctaccgccacccggaagctcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacaccatcctctgttgcctatgttgaatctctttacagatgcttgaaatggagtaaatgcaatgtgttcactccactgaaagagggctcggaagtatcagatactgttgctatctcagggagtttacaggctattggagagacaaaaccaattcacatgaaagagtgatgagtgtgtaattattcactaaatcctacagtatggtacattcagatgggaagatggtagatttgaactaaagtaataagaataataaaaggtaacagagaagatgggatttgaagtgagctttgaagactgggtaagattcaaattgttaacgatcttccaggcaatgaaaaccatctggagttatgcatggattcatgattcagcaaggaaatgagcaaaactcaaatgcagtagacaaggagtaatgggacagaaggttagatgggcagaggccagattatgaagcaccttaaaaagggggtaaggggtttaaatttgattaatatctaacacttattgaaacttaaaatctgccaggcaatgttttaaacacttttaaaacattgacttaattctcatagctctctaaggaaggtggtattcttatctctat

SEQ ID NO: 463059 - DNA, 2016 bp, Homo sapiens
ccttctctggttccctgacctcagtgagacagcagccggcctggggacctgggggagacacggaggaccccctggctggagctgacccacagagtagggaatcatggctggagaattggatagcagagtaatgtttgacctctggaaacactcattctcaatgcaagatcctccgctgcaatgctgactcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacaccatcctctgttgcctatgttgaatctctttacagatgcttgaaatggagtaaatgcaatgtgttcactccactgaaagagggctcggaagtatcagatactgttgctatctcagggagtttacaggctattggagagacaaaaccaattcacatgaaagagtgatgagtgtgtaattattcactaaatcctacagtatggtacattcagatgggaagatggtagatttgaactaaagtaataagaataataaaaggtaacagagaagatgggatttgaagtgagctttgaagactgggtaagattcaaattgttaacgatcttccaggcaatgaaaaccatctggagttatgcatggattcatgattcagcaaggaaatgagcaaaactcaaatgcagtagacaaggagtaatgggacagaaggttagatgggcagaggccagattatgaagcaccttaaaaagggggtaaggggtttaaatttgattaatatctaacacttattgaaacttaaaatctgccaggcaatgttttaaacacttttaaaacattgacttaattctcatagctctctaaggaaggtggtattcttatctctat

SEQ ID NO: 463060 - DNA, 5469 bp, Homo sapiens
agggcagtgaagctattccatatgataccacaatggcggatacacgtcagtatacatttgcccaaacccatagaatgtacaccaagagtgaactcaaacttaaactatgggctttggacgataaagatgctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaagaaatctcttccataattcagatttctacactttatacttgcctccctcct

SEQ ID NO: 463061 - DNA, 5422 bp, Homo sapiens
agggcagtgaagctattccatatgataccacaatggcggatacacgtcagtatacatttgcccaaacccatagaatgtacaccaagagtgaactcaaacttaaactatgggctttggacgataaagatgctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaagaaa

SEQ ID NO: 463062 - DNA, 5315 bp, Homo sapiens
agggcagtgaagctattccatatgataccacaatggcggatacacgtcagtatacatttgcccaaacccatagaatgtacaccaagagtgaactcaaacttaaactatgggctttggacgataaagatgctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccatcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaagaaa

SEQ ID NO: 463063 - DNA, 5371 bp, Homo sapiens
agggcagtgaagctattccatatgataccacaatggcggatacacgtcagtatacatttgcccaaacccatagaatgtacaccaagagtgaactcaaacttaaactatgggctttggacgataaagatgctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaagaaa

SEQ ID NO: 463064 - DNA, 5561 bp, Homo sapiens
  misc_feature (5443)..(5443): n is a, c, g, or t
  misc_feature (5458)..(5459): n is a, c, g, or t
  misc_feature (5556)..(5556): n is a, c, g, or t
agggcagtgaagctattccatatgataccacaatggcggatacacgtcagtatacatttgcccaaacccatagaatgtacaccaagagtgaactcaaacttaaactatgggctttggacgataaagatgctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaagaaaaactgagttttacccatctttataaatgatgctacactactaaactgtgatgcatttgacatctgtcattcntctgtggctgaccanncatgcaacattctttatattttgggcacttcattactgtgagaagcttaagaccttctttccacccgtgaacataagggggccacatacttggtttnccaat

SEQ ID NO: 463065 - DNA, 1584 bp, Homo sapiens
agtgcaagaagatgttatacttcacagtaagggctagtttctaaacatgaaagaacacatagcttatgtaacatgacatttgttggagaatatgccctagaaaatcatgatatcacagatatatactaaatatctgaaggagattacggagaaaacatttccagcggaggagttctttaatatagacagagcttgtttcagaattggtatcttcctgaatatttggctgcttggaaaaagttacattggtgccgggattcagcccttgcctggacagaggtggccgctagagtcatcagcatggacactggcaccagtgactacataggtcccaggatcgtagccagccacctcgggtgcctccggagaccacttgagaagtgcagagactgtgggccagcccctcattcttgtctgagacagtgatgccctccccactcagtaattatgcacagctagcagagctctgaaatgaatggcttcatttaatcacaaaagaaggaataccagcaagaccacccaggccccagctccggtttttcctgaagaatttggccgcatctccctttttgaaggcagagtttcatcttgctccagggagaagcaacttcctgggcatgcgtgttaagagacaaaaaatgatgacgtttgatgaccactccaccagaaaagggaagaaagcctgaggggcctgcgtggacctccctaaacacactgcgcatgctccattccaaacggtatggcgagcactgcgcatgcgggaaacccaccctcgctcccgccacatctgtgccccaataccacttgttacttagcatccatgctggctggctgccgtggccacacttacaggtggtgtgggtgggcactgttctcggtccacacatcctccccaagaaccctgttgaatggagatgtgacagggccaggggtcacttaaagattgttcacaggctgctaacaggctgggggaacagtgggtccaactgttctggaagagaaagcagatgtgtgaatggaagaaagagatgcattcgaggttacagaatgaaggtcagcgggaaagatgagaattcaggattctcactgatagttagaggaaagtgtggtagagacataatcaaagattcagacaaagatataactacagaatgcacatgacggttttgttaatacaccaaaaggaaaaaaattaaataacggactctcccaataaattgtgaccatctatagtttggaataacatgaagattgttaaaaactatgtttacaagaatggcaataacagagaaacacttgctatataattttcacaataacaaggtgaagaaatattatatatatatataataaaattcaaatttttaagagaaattaaaatgtatagaaaacattggaaaaggatacacttaataatctttttttcagcatggtagaattgtgggtgatttttgttccctttatattttttaatactttgtactttttaatgacaaatgtatatactaccatttaatgataaaaatatatttttaaaatactggataagaattattcaaataaatgccttatttaaaagttaaa

SEQ ID NO: 463066 - DNA, 618 bp, Homo sapiens
ttgctactttttatggagggtttttgaaggcgtctctcataagatggcatttgagcagagacctgaggaagtgaaagatggagggctgaagcttccagttagaggaacaagcaaagaccccgagcaggatcaggaaagtgtggtagagacataatcaaagattcagacaaagatataactacagaatgcacatgacggttttgttaatacaccaaaaggaaaaaaattaaataacggactctcccaataaattgtgaccatctatagtttggaataacatgaagattgttaaaaactatgtttacaagaatggcaataacagagaaacacttgctatataattttcacaataacaaggtgaagaaatattatatatatatataataaaattcaaatttttaagagaaattaaaatgtatagaaaacattggaaaaggatacacttaataatctttttttcagcatggtagaattgtgggtgatttttgttccctttatattttttaatactttgtactttttaatgacaaatgtatatactaccatttaatgataaaaatatatttttaaaatactggataagaattattcaaataaatgccttatttaaaagttaaa

SEQ ID NO: 463067 - DNA, 900 bp, Homo sapiens
agtgcaagaagatgttatacttcacagtaagggctagtttctaaacatgaaagaacacatagcttatgtaacatgacatttgttggagaatatgccctagaaaatcatgatatcacagatatatactaaatatctgaaggagattacggagaaaacatttccagcggaggagttctttaatatagacagagcttgtttcagaattggtatcttcctgaatatttggctgcttggaaaaagttacattggtgccgggattcagcccttgcctggacagaggtggccgctagagtcatcagcatggacactggcaccagtgactacataggtcccaggatcgtagccagccacctcgggtgcctccggagaccacttgagaagtgcagagactgtgggccagcccctcattcttgtctgagacagtgatgccctccccactcagtaattatgcacagctagcagagctctgaaatgaatggcttcatttaatcacaaaagaaggaataccagcaagaccacccaggccccagctccggtttttcctgaagaatttggccgcatctccctttttgaaggcagagtttcatcttggtttttgaaggcgtctctcataagatggcatttgagcagagacctgaggaagtgaaagatggagggctgaagcttccagttagaggaacaagcaaagaccccgagcaggatcaggtttgatgtcttcaagtaatatccaggatgggatgaagctgcaggggagtgagcaaggtgtagacaggtagaaggtgaggttggaggagtgggtggacggggaggaatcatcccacagggccttgtacgcactgcaaaaactttagtcttttgctctaagaaattaagtccgttaattaaaaacaaatgaacaga

SEQ ID NO: 463068 - DNA, 1614 bp, Homo sapiens
tgccgcagccagcagcctgcagccgccgccgggttgtgcctcagactgtcagataaatcggcgggccgggccggcgggtcggtgagcgcggcccgggccggacatggcggcgctctacgcctgcaccaagtgccaccagcgcttccccttcgaggcgctgtctcaggggcagcagctgtgcaaggaatgtcggattgcacaccctgttgtgaagtgcacctactgcaggactgagtaccagcaggagagtaaaaccaatacaatatgcaagaaatgtgctcagaacgtgcagttgtatggaacgcccaaaccttgtcagtattgcaacataattgcagcatttattgggaataaatgccagcgctgcacaaattcagaaaagaagtatggaccaccctattcttgtgaacagtgcaagcagcagtgtgcatttgacaggaaagatgatagaaagaaggtagatgggaaattgctgtgctggctgtgcacactttcatacaaacgggtccttcagaagaccaaagagcagaggaaacacctgagtagctcttctcgtgctggccaccaggagaaggagcagtatagtcgcctgagtggtggtggccattataacagccagaaaacactttctacatcttcaattcaaaatgaaatcccaaagaaaaagtccaagtttgagtcaatcacaactaatggagacagcttctccccagacctggctctggactcaccaggcactgaccactttgtcatcattgcccaactgaaggaagaagtggctaccctgaagaagatgttgcatcaaaaggatcaaatgattttagagaaagagaagaagattacagagttgaaggctgattttcagtaccaggaatcgcagatgagagccaaaatgaaccagatggagaaaacccacaaagaagtcacagaacaactgcagagatgggctctcgctatattgcctgggctagtcttgaactcctggcttcaagcaatcctcccacctcaacctcacaaagtgctaggattacaggcgtgagccaccatgcccagcctgtagatactttgtattgtttcactcttggatgtgttctgatcttttcccctcaaaaacagtagaattattaagtatgttctttgatttttgaataaaccagatgtgattccagatgtctgaattatagattctgtttatccagctcatgaagtcacttcacagtttgtattgcataaagcatccctttgtaacagtgggtcccaagagattgagcgtatgtgtttgagattcatccgtgtttttgcatgtctcagtaatttattccatgtctcagtagtttctttttatagctgaatagttttccactgtatggatgtaccacagtttatctcttcagcagttgatggacacttgagctgcttccagtttttggttattacgaataaagctgccgtaaacatttgcatacaggtcttttaatagaaatgtgtttttattattcttgggtaaatatatagcagtggagctgctgaattgctgggttgtatggtaaatttattcttaactgtatacgagactgtaaaactattttccaaagtgactgtaccattttgcat

SEQ ID NO: 463069 - DNA, 1040 bp, Homo sapiens
tgccgcagccagcagcctgcagccgccgccgggttgtgcctcagactgtcagataaatcggcgggccgggccggcgggtcggtgagcgcggcccgggccggacatggcggcgctctacgcctgcaccaagtgccaccagcgcttccccttcgaggcgctgtctcaggggcagcagctgtgcaaggaatgtcggattgcacaccctgttgtgaagtgcacctactgcaggactgagtaccagcaggagaggctagagtgcaatggcacgatctcggctcactgcaacctccacctcccaggttcaagcgattctcctgcctcatcctcccgagtagctgggattacaggctaaaaccaatacaatatgcaagaaatgtgctcagaacgtgcagttgtatggaacgcccaaaccttgtcagtattgcaacataattgcagcatttattgggaataaatgccagcgctgcacaaattcagaaaagaagtatggaccaccctattcttgtgaacagtgcaagcagcagtgtgcatttgacaggaaagatgatagaaagaaggtagatgggaaattgctgtgctggctgtgcacactttcatacaaacgggtccttcagaagaccaaagagcagaggaaacacctgagtagctcttctcgtgctggccaccaggagaaggagcagtatagtcgcctgagtggtggtggccattataacagcttctccccagacctggctctggactcaccaggcactgaccactttgtcatcattgcccaactgaaggaagaagtggctaccctgaagaagatgttgcatcaaaaggatcaaatgattttagagaaagagaagaagattacagagttgaaggctgattttcagtaccaggaatcgcagatgagagccaaaatgaaccagatggagaaaacccacaaagaagtcacagaacaactgcaggccaaaaaccgagagctcctgaagcaggcagctgctttgtccaagagcaagaagtcagagaagtcaggagctataacctctccatga

SEQ ID NO: 463070 - DNA, 1223 bp, Homo sapiens
tgccgcagccagcagcctgcagccgccgccgggttgtgcctcagactgtcagataaatcggcgggccgggccggcgggtcggtgagcgcggcccgggccggacatggcggcgctctacgcctgcaccaagtgccaccagcgcttccccttcgaggcgctgtctcaggggcagcagctgtgcaaggaatgtcggattgcacaccctgttgtgaagtgcacctactgcaggactgagtaccagcaggagaggctagagtgcaatggcacgatctcggctcactgcaacctccacctcccaggttcaagcgattctcctgcctcatcctcccgagtagctgggattacaggctaaaaccaatacaatatgcaagaaatgtgctcagaacgtgcagttgtatggaacgcccaaaccttgtcagtattgcaacataattgcagcatttattgggaataaatgccagcgctgcacaaattcagaaaagaagtatggaccaccctattcttgtgaacagtgcaagcagcagtgtgcatttgacaggaaagatgatagaaagaaggtagatgggaaattgctgtgctggctgtgcacactttcatacaaacgggtccttcagaagaccaaagagcagaggaaacacctgagtagctcttctcgtgctggccaccaggagaaggagcagtatagtcgcctgagtggtggtggccattataacaggtaacctcaagacacatgagatgggactagaagtgctggtaggtcagatgtaatgctcacataaccatcatggtacatactaccatctcatatacattttctatattctctgtaggtactagtctgtaggaggaagctcatttgtcatattttatagttcatatatcttccaaggaccagagagatttccataaagtgtcaggatttcctgactttgtattgtgtctgaaatgtttgtggaacttcgtttgtagtgttctcacccttagagtggattctctctccagaaaattggacatttcactttctgagagatacagctttttcaatgcatatttagccaggaggctgatagatgtcctaggtttgtcctggtggcacctagtcaaaaagatgtcttttcattgttgttttaagcgtcctttcagagtatctagtattgttaacggttctggctctggatggaatgctggctctgccaggttctctgcggggatcttgggcaagt

SEQ ID NO: 463071 - DNA, 139 bp, Homo sapiens
aggagagccctggatttcattaatttgggtgaccatttagctctctgaaagcaatttttttttattgcacagaaatttcttctggttattctgccttgtttccctcagattacagagttgaaggctgattttcagtacc

SEQ ID NO: 463072 - DNA, 1127 bp, Homo sapiens
tgccgcagccagcagcctgcagccgccgccgggttgtgcctcagactgtcagataaatcggcgggccgggccggcgggtcggtgagcgcggcccgggccggacatggcggcgctctacgcctgcaccaagtgccaccagcgcttccccttcgaggcgctgtctcaggggcagcagctgtgcaaggaatgtcggattgcacaccctgttgtgaagtgcacctactgcaggactgagtaccagcaggagaggctagagtgcaatggcacgatctcggctcactgcaacctccacctcccaggttcaagcgattctcctgcctcatcctcccgagtagctgggattacaggctaaaaccaatacaatatgcaagaaatgtgctcagaacgtgcagttgtatggaacgcccaaaccttgtcagtattgcaacataattgcagcatttattgggaataaatgccagcgctgcacaaattcagaaaagaagtatggaccaccctattcttgtgaacagtgcaagcagcagtgtgcatttgacaggaaagatgatagaaagaaggtagatgggaaattgctgtgctggctgtgcacactttcatacaaacgggtccttcagaagaccaaagagcagaggaaacacctgagtagctcttctcgtgctggccaccaggagaaggagcagtatagtcgcctgagtggtggtggccattataacagccagaaaacactttctacatcttcaattcaaaatgaaatcccaaagaaaaagtccaagtttgagtcaatcacaactaatggagacagcttctccccagacctggctctggactcaccaggcactgaccactttgtcatcattgcccaactgaaggaagaagtggctaccctgaagaagatgttgcatcaaaaggatcaaatgattttagagaaagagaagaagattacagagttgaaggctgattttcagtaccaggaatcgcagatgagagccaaaatgaaccagatggagaaaacccacaaagaagtcacagaacaactgcaggccaaaaaccgagagctcctgaagcaggcagctgctttgtccaagagcaagaagtcagagaagtcaggagctataacctctccatga

SEQ ID NO: 463073 - DNA, 1208 bp, Homo sapiens
tgccgcagccagcagcctgcagccgccgccgggttgtgcctcagactgtcagataaatcggcgggccgggccggcgggtcggtgagcgcggcccgggccggacatggcggcgctctacgcctgcaccaagtgccaccagcgcttccccttcgaggcgctgtctcaggggcagcagctgtgcaaggaatgtcggattgcacaccctgttgtgaagtgcacctactgcaggactgagtaccagcaggagagtaaaaccaatacaatatgcaagaaatgtgctcagaacgtgcagttgtatggaacgcccaaaccttgtcagtattgcaacataattgcagcatttattgggaataaatgccagcgctgcacaaattcagaaaagaagtatggaccaccctattcttgtgaacagtgcaagcagcagtgtgcatttgacaggaaagatgatagaaagaaggtagatgggaaattgctgtgctggctgtgcacactttcatacaaacgggtccttcagaagaccaaagagcagaggaaacacctgagtagctcttctcgtgctggccaccaggagaaggagcagtatagtcgcctgagtggtggtggccattataacagccagaaaacactttctacatcttcaattcaaaatgaaatcccaaagaaaaagtccaagtttgagtcaatcacaactaatggagacagcttctccccagacctggctctggactcaccaggcactgaccactttgtcatcattgcccaactgaaggaagaagtggctaccctgaagaagatgttgcatcaaaaggatcaaatgattttagagaaagagaagaagattacagagttgaaggctgattttcagtaccaggaatcgcagatgagagccaaaatgaaccagatggagaaaacccacaaagaagtcacagaacaactgcagagatgggctctcgctatattgcctgggctagtcttgaactcctggcttcaagcaatcctcccacctcaacctcacaaagtgctaggattacaggcgtgagccaccatgcccagcctgtagatactttgtattgtttcactcttggatgtgttctgatcttttcccctcaaaaacagtagaattattaagtatgttctttgatttttgaataaaccagatgcgcccgaaacactactcttatcattcttctaatactcaaacacaataa

SEQ ID NO: 463074 - DNA, 991 bp, Homo sapiens
  misc_feature (831)..(831): n is a, c, g, or t
taggcctagtacgaggctgggggttgaatcggccgaggctgcaatccatgtaagatgtgacttgttcctccttgccttctgccatgattgtgaggcctccacagccatgcggaactgttgaaatacacactacctgaagctggataactcatgaactctgttgacaattatattctttgtctttttaattaactcatttggagttggtgtcctgaggacctaagcctaagaatcttcaagatggaagagtagagtgaacaatgaatgagccagagggctcttgtcctctgtgtgcagctctgggcagccagcaggtggatatgggacttggcctgctggaggggccctggcaagaggagctggcaggagcagatggcaaaggataaagcgctcccttgttggtgtccccacagtccaggctggtgctgatgccgtcctgccgtcctgcatcagagccactcatgcccgtgtgcgcactctttgtcggggtctgacaccgttgcatcgtatatcacctgtgttgtcatggtcagtgctcaacaaatgcccctactgattcaagtatatgagcaagtcaaataaaaaaataatatggccgggaaaaaaaaaaaaaaaaaaaaaaaaaaaaaaaaaaaaaaaaaaaaaaaaacgaaaaatccggggggggaaacacacctaaaagcgaggagaaaacgacccctcgtggacaccacagccaaggaaaagatgatgccgcgtagggagaagaaaacaccgggcgggtgtgtgatacaagcacaggggacacacccccgagaacgtgggtgggcgcggaacaccacccacggggangggcccacgcgaggtcattggtgggtgtcatgagcaaacacagttttgcctggccagaagagtatccgaaaagagacatctgtcagggagacaagcaacaaaccggtaacgcacgacgtgcgacagggcagcgaaaagggtcaaccccgcacggcgagct

SEQ ID NO: 463075 - DNA, 1566 bp, Homo sapiens
  misc_feature (1406)..(1406): n is a, c, g, or t
cagacaggccaggccagtgtgctggacctttcttgggaagtagaacatgaactcgagtgaactttcctcattactatgccaaagtctccaccctgggaggagctatacctgcattaccatgacatgcaacccatatgctggcatgatgactcatcatgtctgtgcaactgggacccctcctctacctgccatgatgcacccttctccattgccgcataaaaccctcctgtccccttctctccgggagacactgctttggagaacactcccagtatcctccttacttgcaccaagtaataaaactcttattgatcaaaacctgtgttctcgtggagttactcaccagctgaacaaatcctgttttattgagggtaacagaggtcctgaagaggtaggaattggatataaccagaggcatcacagacgatgccacagagtatgtgaatttagggctaagctttagtaagatctggcagcaaaaggcagagggcatttcagggagagaaacacccaaaggcacagggtaagtatggagaatgagggcatgggtgaagggactggcgaaaatcagattaaaaggactggctaaacactttatatacaaaattttatctcatttaatccttacaacagtccagaaaaaggcattgtaatccttgttatacagatgaggagattaaggtttagagaggttgaaatacacactacctgaagctggataactcatgaactctgttgacaattatattctttgtctttttaattaactcatttggagttggtgtcctgaggacctaagcctaagaatcttcaagatggaagagtagagtgaacaatgaatgagccagagggctcttgtcctctgtgtgcagctctgggcagccagcaggtggatatgggacttggcctgctggaggggccctggcaagaggagctggcaggagcagatggcaaaggataaagcgctcccttgttggtgtccccacagtccaggctggtgctgatgccgtcctgccgtcctgcatcagagccactcatgcccgtgtgcgcactctttgtcggggtctgacaccgttgcatcgtatatcacctgtgttgtcatggtcagtgctcaacaaatgcccctactgattcaagtatatgagcaagtcaaataaaaaaataatatggccgggaaaaaaaaaaaaaaaaaaaaaaaaaaaaaaaaaaaaaaaaaaaaaaaaacgaaaaatccggggggggaaacacacctaaaagcgaggagaaaacgacccctcgtggacaccacagccaaggaaaagatgatgccgcgtagggagaagaaaacaccgggcgggtgtgtgatacaagcacaggggacacacccccgagaacgtgggtgggcgcggaacaccacccacggggangggcccacgcgaggtcattggtgggtgtcatgagcaaacacagttttgcctggccagaagagtatccgaaaagagacatctgtcagggagacaagcaacaaaccggtaacgcacgacgtgcgacagggcagcgaaaagggtcaaccccgcacggcgagct

SEQ ID NO: 463076 - DNA, 935 bp, Homo sapiens
ctgctgatatagtttgtgtataagaaaatggctgagatctgtccccagactcagagagcttggattgcaacacccctccggagcagctcattgggcttggccaagtaccctctgagggccagctgtagtgctttagcaaataagcatccagagagatgtctggcctctcatgggctccagcccggatggccaagaggagctaaatttagcatagctattgttcatcggataagcccagagacacacagcctgcatgtggcacagctgaattcccatgtgggcttcttggaccttgtcgtttctgttcttactgtcatgatacagtccgtgacctgccagggctctggttcaacccactatgagctactgggaatcccaggatgtaacattcatctttatatccctatggccttgcactcacaagataacaggtgttcagtgccccaaaaggtgtttcttgctttgtcctgtgactgtggaccacctcttccctgggcaatccagagagctcttccaccatccaacagctgcaaccacactggctccaaaaaagtctgaacccaacttttgaagagggatgcaccttccatgtctgcctctccttgggagagaagatgaaatatttccatcttcactgacaaggacttctggcaatttggatgaatgatgccaagagaagaaagcaaccagcttataaacttcctaaggaagcaaatttcaaaagaaaccccaaacatcacgaatcacaagctgctttgttttcttattcatgaccttcatctaccttccctttcatcaagtaaatggaaatgtgtcattctgattaacggtgattgcttccttgtcatacatcaactaaaatgagatgtttcaccatcagatttaaggggacatgggcatatatttaagaggtatttttttaaaaggcattcttg

SEQ ID NO: 463077 - DNA, 967 bp, Homo sapiens
agcaaacttttgtaaaatgtactcagggatttctttgaagtatcctaaaggactgcctttaaaaagatgcatgtgtgtctctgatcgccctgcctttcaggccccaggcccctccaagctgcatggctgggggttcctggagtgctctacagcccaggatctatgcacagtctttgtacttacgcggaaaaaaagaaaaagaattgagacccactgtcttatgagctggcgaggcaatgagaacaccctggcagggcagctgagctgggtggatccttgttctgtcaccaagcctttaagtcatatgctgacatgttacagtcctgcctgggaccctgcccacaaatacttaagatacacgactttgggaatcacccaactgatggaaagaaccaggaaaggggtcaggatctgcaccttggcaaactttgaagaacacccaatttgatgaatgaaaactcctcacttgtgctctggtggtgttttaggacaatgggcccctcctggatgctccagtgaagccccatatcacctttttccttcctgtttgccatagctccaggtgtagggacagatcagaagattctggaaaaggcagatcaccaaagaactcaagatgtactgatattttgccagtttccttcatcaacaacttgtcttctttaccaactaagggcaaacaaagagaacaaactaaaaaaaaaaaaaaaagaaaagaaaagaattaaataattaaacaaagaacttaaataagaaggtaagaccccccccccaaatctcccaagatagtgagaaatgtatttgcgtcatgtctgcctaacaatgagctattattaggatggtagaaaatagcagcaagtaaggactacagatttcacccagaggcagagcagacaaaagagacaacagtttcctgggaaaggaagatgattccagtttaattcatccaacaaaactcttccaagaa

SEQ ID NO: 463078 - DNA, 1196 bp, Homo sapiens
aggcacagctgcagccatccagccatgactgcaaacccgggcatctctgcactctcagaggcccagcaagcccccctgccccgcaggctcagttttacctggtcctgccacctggcgtctctctgcttccagagcccactccaaattcagatccaagttgaggccaaacctgggcacagtcacaacccggcccggtttgtgcaagctcagggcagtgctgacatgccagccccctgccacatcggccccctccagactttgggcactggcaagaacaggagggaggctgaggtgtggctaagagtggctcagcagcaagaagaagagaagagagaaggagagaagagctgtgtcccttcagggaacacagacctaggagctcctccaaccagggctgtgacaccttctttgggtctcggcaggtcctgcatctccaagcctctgggtgccactgcattccctgatacccacagtggaagctgtttgcagtcggcctggtccagctgcaggctcacagggagctggcacctgtgcctggagctgcccaccccactgcagctggcatgcttggctgtgtgcagtggccagatcccatgctcaattgctcacacacccctcactgctctgtactcagctcgcccttggcaggtgtgggatccagaccactagcatgagctgagtggacagaactaacccagtgggcccgagcaaaacacagaaataaccaaatttccttatcaattgtctttaactataactatttaaagtcatttccacagttaattgcttaatggtgatgcagtttctaaaaacttcacaagcatgcaaaattctagaatagaagattcatgaaagaatgaaaaggaccatgaaaaacactcgggaacccagaggacagccaaccccttcacaatctagaatctaatgactggatcttctgagaacatcagaggactgcccttgccattcacatgacagcaaaactttaaaaccttaaactttgggttcatagtcttacaactcagaagggtccctccacactcggaaccatacaccccttggaactcttaaggatgttccagcataagaagacaccttctactcaagtcctttttccaccttttcaaatctcactgttctatttcccagtgggtttctaaaccaaataagtacacttgcaacggtaatagtgacac

SEQ ID NO: 463079 - DNA, 796 bp, Homo sapiens
tttgtcagactcttacattgacagggtgaagacactacccaggagaaaacagtgagggcagggttcaaggccaactcccacacagtcaggagaaatgtggatgcaattgtgctgtcgattttaaaggtctgcatctcctcatccctatccgattttaaaggtctgcatctcctcatccctatccgaatgcgtttccttctttaagaacgtgattctaaacggaagcgctctacatggtgtgagcctgttaccaagaatacatctcccgagagattcccgttcactatcctcggctcctctccagtgagactttgctcaccatcatgggctgtcgagagagctgccctcaagctaatgggccacttccctggggcgcctcgcccgctgtaagtgaggaccagaacctctcggttcttcacagcagccactggaggcagctcagggctgattttcagagccataaaaagcagccccagttagaggaactccagccccagctgtggatattttcattctgtcctggtggtagggtaggaaccaagcctccaggcccagtcaaaactgaaggagaggccaggacactacgtgaaagaagccagacacaaaaggccacatctgggccacacgagtccattcccacgatatcctggataaacgcaaaaccaggacaacaatcagatccgtggttgccaggggctagaggtcaggggaagggacaaacggcaagagggaactttagccttatgctctattttgataatggtggtggctacatgactgtatagattggccaaaa

SEQ ID NO: 463080 - DNA, 1433 bp, Homo sapiens
tctacccttggtctttgatgatggcgacctacagatggggttttggggtggatgtcttttttgttgatgttgatgctattcctttctgtgtgttagttttccttctaacaatcaggtccctcagcttcaggaatctgcaggagtctgaagaggaggaagtcccccaggagtcctgggatgaaggttattcgactctctcaattcctcctgaaatgttggcctcgtaccagtcttacagcggcacatttcactcattagaggaacagcaagtctgcatggctgttgacataggcggtgagtactccattgtgaaggtgataaagctccagttcatggcccaggccatgcccgtgccaacctggactgactgtcacgacattgaactcaaggcaggacatcggtgggatcaagtgaaaaaggaggaccaagaggcaacaggtcccaggctcagcagggagctgctggatgagaaagggcctgaagtcttgcaggactcactggatagatgttattcaactccttcaggttatcttgaactgactgactcatgccagccctacagaagtgccttttacatattggagcaacagcgtgttggctgggctcttgacatggatgaaattgaaaagtaccaagaagtggaagaagaccaagacccatcatgccccaggctcagcggcatgctgatggaagtggaagagcctgaagtcttgcaggactcactggatagatgttattcgactccgtcaatgtactttgaactacctgactcattccagcactacagaagtgtgttttactcatttgaggaacagcacatcagcttcgcccttgacgtggacaataggtttcttactttgatgggaacaagtctccacctggtcttccagatgggagtcatattcccacagactctgccggtgcagaatatgaacaacgccatgttcttgcagaaaacgcttagcctgagtttcataggagaatcacatttggccgaatgtcccggcaccctggtgctcagtcacagtgacacgtgcaagtaactatcacacttgtcctttgtcacatttgtcatttcccctgtttttctcccaatctgcagcttatatttgttctcttaatactgtctcgtgttgagcaaaaacttttactttttataaagttgaatttatcaatgttttctttaatggtttgtgtttcttgataacaaagaacactttgcctaactgtgtcgtgaagattttgtcttatatttcctgctatactttttctacttttatagtttatatttagttgcataatccattttgagttagtttttgagtcagtattgaggttcaggtgaatctttttcctttggggatatgcatgtccagttgtttctacacaatttgttgacaagagaatgccttctccactgaatcatatttgga

SEQ ID NO: 463081 - DNA, 686 bp, Homo sapiens
cggttttggatgataccagaatatcacacaaaaatttctgtaaacaatgccaaatatttttcagtccactggtcactgagtgcttcccatgaggccatgggtggacagttcatctctgataaactcatgcagataagaaatgtcttctgggaaggcttgactggggctggagaacgtacttccaagatagcttgctcaaatgactggcaagtgcttcttatagttgacttggaactcatccagggttatccactggataccttggatcctctccacatggacctcttcatagggatgcttgggcttcctgaaaacatggcagctagtttccaagaacaaggattccaaaaggcatggatgaaagttgtggagaccaaagctgccaatccaaggaccacactttgagtagcaggccccagaggatgcattttgcaaaaaaaaatgttaaaagtgcccaaagcatctatgaacccccaggacttttgtcaacatggatttcaaaggcaatagccctgtttcaaaaagaagtttttttttcaagccggagcagccttgtggattttgtgcaggggatgaattaaagtaaaaagccccagccatgtttcctggagcaattaaagccccctgtcctcaaatggacttacatttattggcaaaaggtggagttaataaaaccctcccaaaga

SEQ ID NO: 463082 - DNA, 1368 bp, Homo sapiens
agctccaagaaggccccctttgcactatgagcaaccaggtgctctgctgtgtggtcctttgtctcctgggagcaaacaccgtggatggtggaatcactcagtccccaaagtacctgttcagaaaggaaggacagaatgtgaccctgagttgtgaacagaatttgaaccacgatgccatgtactggtcttgcagtacgctggaagaaatatctagaacggcagatgatgtgattttggcaagcgtgtcacatgttgatttctgttttgccggtgaatgcatcaggcctgaggtgggagaagcaccacagccaaggacagcagctcctggagatgcttttacttatcaagagcaatgtagatgtatgcaaaaatacagacacccactcacagttacatttgtggataatcagaaatatctttctgctttcccagcagagcccaaactctcctcctatcatccaggtgggaagacaggtaaaggaaactgttcggtccgactttgttcctttcatgcctgccagggcttctggtttcacggagacctcaggctaggagcaaccctgagcagggagactgagttacagagaatccccaccaagttgcaggcagagggacagccgaggccctcaggaagtacacgagagcagaaccactatggcaagttcactgagaaatctggaaagttagaatcccagcccgagtccatcaaatcgagcatcataaaattaagttttccttactgtgaaatggcaatttgtaatgatttctgagaagtgggacccatggtggtgtcgatgtctgagccaggtgagggtgagatccctggcgccatgggctggcccccaggatgccctggaaaacgcattctgttcacagctgtgtgattcttttctttctgtgttggtgaagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtccttgcccatcaacccggcccagagcagcagccccaaccacgtggattccgcctacttccctggctcttctacatcgtcatcttccgacaacgacgagggcagcggaggggcgacaaagtgagtggtgcgtgggtcgctgggtgcttcctggcgggtagtgacctggggaagctgccttctgacctgcc

SEQ ID NO: 463083 - DNA, 801 bp, Homo sapiens
agcggagggttcggagctcagaggcccgggccgccggccgcctcccctccgtggctctagggcggaggcggaggcggggaccggggtatctcgctcgcgcagcctggagcccatgctgggctcagcccgaccctgctttggccgctgcccgccgggtctccagcgccgccggaccctcacgccgccaccttctctccagcccagcgccgctgcggccgcagcctcctgccgagcatcttccagatcccaatccctgagaatcagttctgggatgtaacagagcaagcggacattattctgggaccagcaagcctcggtcactgcagccaccacactacgtggcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtccttgcccatcaacccggcccagagcagcagccccaaccacgtggattccgcctacttccctggctcttctacatcgtcatcttccgacaacgacgagggcagcggaggggcgacaaatatacaatctattggggattccgtgccactgaacaccatgtacaacgaaggattcccaggcaacggggacg

SEQ ID NO: 463084 - DNA, 1520 bp, Homo sapiens
gaggcctgtgggggacatcttgatgttgactgggggcacacgttggcagggctacccccatgtggaaaatcttggctggggtggcgggcttttggttttaacaacaagtgactcaattgttgtcccttcttcctgcagcctccccaagtcactgcccacagatggccctgggcagaaagtggtcaaagagagtgaagcccgggggaggaaagctcgggtgcccatggcgcccactggatggctggcctggttgggacccactctggcggggccagctcctggtggttccctgcacatccatccactgtttcccatctacactctgccagaaagtccttcctctcctgaccccgccatccaaaccctatgtgtttcaggaaatcatttttcagatgctacctggggactcctgcagctgctgtgcattttcttggaatctctcatggaaccatgcatgatgactgtttctacatctctgcatgggaaggaactcagggatagagggcaccccgttccatccccatcccagcccctagtgcaggggaagagagccgtggatgttaactattcaccttcagatgccctttcatggggtaggaactgggaagggcagaggtagtaacatctgaacaaagctgggtgaattcccacggaagacggagcatcgagtcgtcaatgccttttggtaaacaagtcgcagctcttccgtcttggctcatcctcatgggcacatcccagtggtgttccctgcccacctctgcacccacattttaagtgcctggaatgtgtgagacggatcctgccctttccttcaccaagccacctagcagaacccatgccatccagggcatctgcgagagaaacacctctcccagcctcccctgagcagcccactagcgctgtggattccagatcctgaaactgcatcttgcactcggtgtcctgagcccagctgaagtggcaggagcaccactgactccagaacagacttgtaaagaaagaaggtatctcccaagtcagccacagaggctcatggtttcctgctccatctagtcctgggtgtttgcttaaatgggcactggctgacatgactgaaacctcatgcatccatcacacattcaccctcaacaaagacacagcccctcctttaaggcctgtgctccctgtacatacacagtgccctgcagcacagagaaaccacatgaatggccttcttggctcaaggagtcagggagtaggggcctgctgagcatgaccatgtccagagagtggggaccccaagaactgtaacagcccattggacagatgtgggcaggaatggggacaaaatcacccacagtctcagaccccaaatgaggtgtgaatatgaaatccatgaaaacctcatgtggaggccaaaagactaactagattcccatctcatctctccaggccagaagcctattatccaatccttcctctcattgcaagccccagaagtaacagcaattacaaaataaagaaaaataagaacttgtcag

SEQ ID NO: 463085 - DNA, 3900 bp, Homo sapiens
ggcaccttgggaggccaaggcaggcggctgggaggtggaggttttcttcctgaggtctgagcaccctccaaactgagtccagatctgagtttttcctcggagatttgtcagaatgagcctccaggccccatccagactgctggagctggcagggcagagcctgctgaggaaccagttcttgaccatcttcaccctggatgagctgcccagggaggtcttccctctgatgttcatggaggccttcagcatgagacgttttgaggccctgaagctgatggtgcaggcctggcccttcctcagcctccctctgggatccctgatgaagacacttcatctggagaccttgcaagctgtcctgaggggacttgatacactggtggcccagaaggttcgccccaggaggtggaaacttcaagtgctggatttgcgggatgttgatgagaatttctggaccatatggtctggagccagggtcctctcctgctccccagaggccatgagtaagaggcagacagtggaggactgtccaaggatgggagagcaccagcccttgaaggtgttcatagacctctgcctaaaggaaagtacactggatgaatgcctgagctacctttttgggtggatccactacagaagaggcctagtgcacctgtgttgtagtaaggtgcagaattactcaatgcccacttcaagtttcagaaatctattggaaaggatatacccagacagtatccaggagttggaagtctggaaaaagtgctctctcaataaaacgggaaagtttgccccttacctgagccagatgagcaatcttcgtgaactctttttagccttcggttatgagcgtgagttgtacgtgagcgtccagtggccgtgcattcctgacttggactctccattcctctgcctgtactacccccagatgctttatataaaaaagatcagtaatatcaaagagcacctggagcacctgctcaggtacctcaagaaccccttgggggcctttatattcagtgatgcttacctaactgatcgggacatggagtgtctgtctcagtacccaagcctcagtcagctaaaggagctgcgtctgattcatatcctaatgtggaccacccatcttgagccccttggagttctgctggagaaagttgctgctactctcaagaccctcgtcttaaaggactgtcggatccaggacccccaactcagggtcctcctgcctgccctgagccactgttcccagctcaccaccttcaactttcatggaaatgagacctccatgaatgctctgaaagacctgctgcgtcacacaggcgggctgagcaagttaggcctggagttgtatcctgcccctctggagagtcttgactacaagggtcatgtcaattgggagatcctcaccccaattcgggctgagctgatgcgtacactcagggaagtcaggcagcccaagaggatcttctttggtcccgacccacaggagagacccaaagtcttcaagcctggagttcctgcttggttcttcctgagatctgagcaccttctagactacatccagatctgttttccctgcagattcatgaagatgagcatctggactccacccagactcctggagcttgcagggcggagcctgctaagggaccaagctttggccatgtccaccctggaggagctgcccacagaacttttccccccactgttcatggaggccttcagcaggagacgctgtgaggccctgaagctgatggtgcagtcctggcccttccgccgcctccctctgaggcctctgataaagatgccttgtctggaggccttccaagctgtgctcgatgggctggatgcactgcttaacctaggggttcgtcccaggaggtggaaacttcaagtgctggatttacaggatgtctgtgagaacttctggatggtttggtctgaagctatggcccatgggtgcttcctcaatgccaagaggaacaaaaaaccagtggaggactgtccaaggatgagaggacggcagcccttgactgtgttcgtagaactttggctcaagaacaggactctggatgaatacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaaactcattctctcccacatggatgtctctcgctacgtttccccagagcagaagaaggagattgttacccagttcaccactcagttcctcaagctgcgctgcctccaaaagctttatatgaactctgtttctttcctcgaaggccacctggaccagctgctcagctgtctgaagacctcgttaaagttcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcttgcctgccctgagccgctgctttgagctcaacaccttcagcttctgtggaaatcccatctgcatggccaccctggagaacctgctgagccacacaatcatactcaaaaacttatgcgtggagctgtatcctgccccccgggagagttatggtgctgatggtactctctgctggagcagatttgctcaaattagggctgagctgatgaacagagtgagggacttaaggcaccccaagaggatcttgttctgtactgactactgccctgactgtggcaacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcatttcacacataggctctgaaagtgggaaaggaaagctgatcaagcaggggccggacttgggggaaatgttgccatggattcgatgggactttggggacctgtgtcctgtagagtcgaaaatgggaatctgaatgtctagagtggaattcaggcttgagaatacatgagggagttactcttgcatggatggttgtaaagaaacaatcagaaataaaggaaaactgagcagaatctgtctggatcagcacccacaccagcacagagcattcatcacaaccaatgagccacagggacacatcattatcacccaatgtccatagttcacatgagggatcattgctggttttgtacattctatggattttaacaaagggataatgacatgtatccaccattagagcatcatggagagtagttttctttccctaaaattcctctgtcctcttcccattcatcccattgtgctcccaaccccttgcatccactgggctttctactgtctccttagaaaaatgcaaaagctttttctggaatgtctaacaggatgagtcttttcagattgccttctttcacttgtacaataacgtgcatttaggaatttttcatgtctttttacagctttataatagttcactgactggatggatcagtttgcttatccagtcactgaccgaagggcaacttgctagcttccaagttttggcgattatgagtaagttgctgtaaacatccaggtgtgggtttactcacttcattaaatatccaggagcatgattac

SEQ ID NO: 463086 - DNA, 2063 bp, Homo sapiens
acgaccccgcggaacgttccgtggggaagcttctctaggccaccagagggcgccaggcgggccgcagcgactccagagtcgcgttatggccgaggtgcgggtgcagctgctcctgtcccggcgtccggagtcggtgagcttcgcacggagtgtgtgtggcctcctgggagccggaccagggctcgggacgtggcccattcactgcagcttgaagcgaggacggcttgtcctctcgagcaggcccttcccaggcgcctccgctaggcttccgctccaggtcggcagaagggggccccagagcgggggcagtgaagggccaaagatggggactgaaatcgggtgggaactggcggcgaggaccccgcccccaacgcgcggtgtagccccatttttggaagtcacgcccacccagtgccgcccttctgaagccttaacccagctggcttccttctgccagcgaccccctttctgcccttttgcggccctggaggagcggcccagggtccctggggctgagctgcccacagatcgaggtgtggacctgggtgtggccgtcattctgcagtccagcgacaagactgtcttgctaacccgaagggcacgcaccctgagcgtttcccccaacctctgggtacccccgggaatcacagcagcagttgcaggtagggctggcagtgagggaaggaaacagggctcaggggagcccaagcaacctggttctgactgtgattaggagctgggcgggggtggcgggggtagtcagagataacgaagaatatgcaatgccctttccccttgctcctgcctttctccatgaaacctgcgggtaggttttgatcacgaacaggcagcccagggagaggcaatgactgaggggtcaccatgtctgaccccaggcccggatccaaccaaacccaaatgaggtgagcgcccttatgtggctgacaccagatgtagctgctgcagtggctgccgcagaggatgggacagagacacccggacttctcccccaggacctaccaccctctgtccttgcagtggaactagaggaggatggaagagcccgacctctggtcctgcacatgtccaccctcctgcggatgatcccaaccatggcagaggacaaagagagagtcagcactggaaccaagtttgccctcaagctctggctgcaacatctgggcagaacacccccaccgtgtaaaagtgcagcttacctggacccagggccagcaaaggaagaatggaacatggaccctcttcccccaaaccaggggtctggaaagtgaagtgtaaaatcccctccctagcccatctccatgacactcacagaacattcacaacctttattatgggtgagagcttcactacaactttagaaataaaaagtaaaattacaacataggtcctaggccttggcgagcctgaaaaagaagattgggaaggagggcacagggtccttccacctccctggaaaggtgcagaatgagccaggcctaactacagggccatgagcctctagaagcttaggggggaataagaaacactgtgaacttagatatataaatagagagagacccaagcaataggccgggcctgactcccagacccctgcagatcatggctaaggccttacatcctcctctgtcatactggagtaggaggcaggggaagtcatctttggagtattttggtttttcttatttatgtacaaaaaagtccacatccacaatccaaaataaagttctctgtccatctctgaaactgcctgtctcagtttttccacctgtctgtttggccgaagggaatggaatagacatgaagagacaatggatgtgaagaagaaatagagccatgggtttgggtaataagaagagagagcatttggggttcaagagaggtgccccttccccaagaggctctagacatagtcaaggctgagggttcagcccttctcctagctcacataccatcccatttgcctcccactgcctaggttaacatacccaaaggaatgtgccaccatctaaagaacatttccagaaacagaccccagtgtcctt

SEQ ID NO: 463087 - DNA, 1864 bp, Homo sapiens
acgaccccgcggaacgttccgtggggaagcttctctaggccaccagagggcgccaggcgggccgcagcgactccagagtcgcgttatggccgaggtgcgggtgcagctgctcctgtcccggcgtccggagtcggtgagcttcgcacggagtgtgtgtggcctcctgggagccggaccagggctcgggacgtggcccattcactgcagcttgaagcgaggacggcttgtcctctcgagcaggcccttcccaggcgcctccgctaggcttccgctccaggtcggcagaagggggccccagagcgggggcagtgaagggccaaagatggggactgaaatcgggtgggaactggcggcgaggaccccgcccccaacgcgcggtgtagccccatttttggaagtcacgcccacccagtgccgcccttctgaagccttaacccagctggcttccttctgccagcgaccccctttctgcccttttgcggccctggaggagcggcccagggtccctggggctgagctgcccacagatcgaggtgtggacctgggtgtggccgtcattctgcagtccagcgacaagactgtcttgctaacccgaagggcacgcaccctgagcgtttcccccaacctctgggtacccccgggtgggcacgtggaacttgaggaggaggtaaccagtcagctgatccaacctgagccaagagacccatgcctgggaccatcttgggtgtgggctgagggagaggcaagcaaaaggacttggaagagtcaggcactggcccctctgatgtgtcttctctgactcccagctgctggacggagggcttcgagaactttgggaggagagtggactacacctgccccagggccagttctcttgggtccctctgggtttatgggagtctgcctaccctcctaggctgagctggggtttacccaaataccatcacattgttctgtatctactcgtgatctcccaggaatcacagcagcagttgcaggcccggatccaaccaaacccaaatgaggtgagcgcccttatgtggctgacaccagatgtagctgctgcagtggctgccgcagaggatgggacagagacacccggacttctcccccaggacctaccaccctctgtccttgcagtggaactagaggaggatggaagagcccgacctctggtcctgcacatgtccaccctcctgcggatgatcccaaccatggcagaggacaaagagagagtcagcactggaaccaagtttgccctcaagctctggctgcaacatctgggcagaacacccccaccgtgtaaaagtgcagcttacctggacccagggccagcaaaggaagaatggaacatggaccctcttcccccaaaccaggggtctggaaagtgaagtgtaaaatcccctccctagcccatctccatgacactcacagaacattcacaacctttattatgggtgagagcttcactacaactttagaaataaaaagtaaaattacaacataggtcctaggccttggcgagcctgaaaaagaagattgggaaggagggcacagggtccttccacctccctggaaaggtgcagaatgagccaggcctaactacagggccatgagcctctagaagcttaggggggaataagaaacactgtgaacttagatatataaatagagagagacccaagcaataggccgggcctgactcccagacccctgcagatcatggctaaggccttacatcctcctctgtcatactggagtaggaggcaggggaagtcatctttggagtattttggtttttcttatttatgtacaaaaaagtccacatccacaatccaaaataaagttctctgtccatctctga

SEQ ID NO: 463088 - DNA, 1693 bp, Homo sapiens
acgaccccgcggaacgttccgtggggaagcttctctaggccaccagagggcgccaggcgggccgcagcgactccagagtcgcgttatggccgaggtgcgggtgcagctgctcctgtcccggcgtccggagtcggtgagcttcgcacggagtgtgtgtggcctcctgggagccggaccagggctcgggacgtggcccattcactgcagcttgaagcgaggacggcttgtcctctcgagcaggcccttcccaggcgcctccgctaggcttccgctccaggtcggcagaagggggccccagagcgggggcagtgaagggccaaagatggggactgaaatcgggtgggaactggcggcgaggaccccgcccccaacgcgcggtgtagccccatttttggaagtcacgcccacccagtgccgcccttctgaagccttaacccagctggcttccttctgccagcgaccccctttctgcccttttgcggccctggaggagcggcccagggtccctggggctgagctgcccacagatcgaggtgtggacctgggtgtggccgtcattctgcagtccagcgacaagactgtcttgctaacccgaagggcacgcaccctgagcgtttcccccaacctctgggtacccccgggacggagggcttcgagaactttgggaggagagtggactacacctgccccagggccagttctcttgggtccctctgggtttatgggagtctgcctaccctcctaggctgagctggggtttacccaaataccatcacattgttctgtatctactcgtgatctcccaggaatcacagcagcagttgcaggcccggatccaaccaaacccaaatgaggtgagcgcccttatgtggctgacaccagatgtagctgctgcagtggctgccgcagaggatgggacagagacacccggacttctcccccaggacctaccaccctctgtccttgcagtggaactagaggaggatggaagagcccgacctctggtcctgcacatgtccaccctcctgcggatgatcccaaccatggcagaggacaaagagagagtcagcactggaaccaagtttgccctcaagctctggctgcaacatctgggcagaacacccccaccgtgtaaaagtgcagcttacctggacccagggccagcaaaggaagaatggaacatggaccctcttcccccaaaccaggggtctggaaagtgaagtgtaaaatcccctccctagcccatctccatgacactcacagaacattcacaacctttattatgggtgagagcttcactacaactttagaaataaaaagtaaaattacaacataggtcctaggccttggcgagcctgaaaaagaagattgggaaggagggcacagggtccttccacctccctggaaaggtgcagaatgagccaggcctaactacagggccatgagcctctagaagcttaggggggaataagaaacactgtgaacttagatatataaatagagagagacccaagcaataggccgggcctgactcccagacccctgcagatcatggctaaggccttacatcctcctctgtcatactggagtaggaggcaggggaagtcatctttggagtattttggtttttcttatttatgtacaaaaaagtccacatccacaatccaaaataaagttctctgtccatctctga

SEQ ID NO: 463089 - DNA, 1500 bp, Homo sapiens
acgaccccgcggaacgttccgtggggaagcttctctaggccaccagagggcgccaggcgggccgcagcgactccagagtcgcgttatggccgaggtgcgggtgcagctgctcctgtcccggcgtccggagtcggtgagcttcgcacggagtgtgtgtggcctcctgggagccggaccagggctcgggacgtggcccattcactgcagcttgaagcgaggacggcttgtcctctcgagcaggcccttcccaggcgcctccgctaggcttccgctccaggtgggcacgtggaacttgaggaggaggtaaccagtcagctgatccaacctgagccaagagacccatgcctgggaccatcttgggtgtgggctgagggagaggcaagcaaaaggacttggaagagtcaggcactggcccctctgatgtgtcttctctgactcccagctgctggacggagggcttcgagaactttgggaggagagtggactacacctgccccagggccagttctcttgggtccctctgggtttatgggagtctgcctaccctcctaggctgagctggggtttacccaaataccatcacattgttctgtatctactcgtgatctcccaggaatcacagcagcagttgcaggcccggatccaaccaaacccaaatgaggtgagcgcccttatgtggctgacaccagatgtagctgctgcagtggctgccgcagaggatgggacagagacacccggacttctcccccaggacctaccaccctctgtccttgcagtggaactagaggaggatggaagagcccgacctctggtcctgcacatgtccaccctcctgcggatgatcccaaccatggcagaggacaaagagagagtcagcactggaaccaagtttgccctcaagctctggctgcaacatctgggcagaacacccccaccgtgtaaaagtgcagcttacctggacccagggccagcaaaggaagaatggaacatggaccctcttcccccaaaccaggggtctggaaagtgaagtgtaaaatcccctccctagcccatctccatgacactcacagaacattcacaacctttattatgggtgagagcttcactacaactttagaaataaaaagtaaaattacaacataggtcctaggccttggcgagcctgaaaaagaagattgggaaggagggcacagggtccttccacctccctggaaaggtgcagaatgagccaggcctaactacagggccatgagcctctagaagcttaggggggaataagaaacactgtgaacttagatatataaatagagagagacccaagcaataggccgggcctgactcccagacccctgcagatcatggctaaggccttacatcctcctctgtcatactggagtaggaggcaggggaagtcatctttggagtattttggtttttcttatttatgtacaaaaaagtccacatccacaatccaaaataaagttctctgtccatctctga

SEQ ID NO: 463090 - DNA, 360 bp, Homo sapiens
tgccctttccccttgctcctgcctttctccatgaaacctgcgggtaggttttgatcacgaacaggcagcccagggagaggcaatgactgaggggtcaccatgtctgaccccaggcccggatccaaccaaacccaaatgaggtgagcgcccttatgtggctgacaccagatgtagctgctgcagtggctgccgcagaggatgggacagagacacccggacttctcccccaggacctaccaccctctgtcctgtcctgtaagtaagagcttctccctcagcctctaatacaccaacatattcatgttgagaagttcagcgtctatcctgtcctcaggatggaattttgtgttgtgggggaga

SEQ ID NO: 463091 - DNA, 1762 bp, Homo sapiens
acgaccccgcggaacgttccgtggggaagcttctctaggccaccagagggcgccaggcgggccgcagcgactccagagtcgcgttatggccgaggtgcgggtgcagctgctcctgtcccggcgtccggagtcggtgagcttcgcacggagtgtgtgtggcctcctgggagccggaccagggctcgggacgtggcccattcactgcagcttgaagcgaggacggcttgtcctctcgagcaggcccttcccaggcgcctccgctaggcttccgctccaggtcggcagaagggggccccagagcgggggcagtgaagggccaaagatggggactgaaatcgggtgggaactggcggcgaggaccccgcccccaacgcgcggtgtagccccatttttggaagtcacgcccacccagtgccgcccttctgaagccttaacccagctggcttccttctgccagcgaccccctttctgcccttttgcggccctggaggagcggcccagggtccctggggctgagctgcccacagatcgaggtgtggacctgggtgtggccgtcattctgcagtccagcgacaagactgtcttgctaacccgaagggcacgcaccctgagcgtttcccccaacctctgggtacccccgggaatcacagcagcagttgcaggtagggctggcagtgagggaaggaaacagggctcaggggagcccaagcaacctggttctgactgtgattaggagctgggcgggggtggcgggggtagtcagagataacgaagaatatgcaatgccctttccccttgctcctgcctttctccatgaaacctgcgggtaggttttgatcacgaacaggcagcccagggagaggcaatgactgaggggtcaccatgtctgaccccaggcccggatccaaccaaacccaaatgaggtgagcgcccttatgtggctgacaccagatgtagctgctgcagtggctgccgcagaggatgggacagagacacccggacttctcccccaggacctaccaccctctgtccttgcagtggaactagaggaggatggaagagcccgacctctggtcctgcacatgtccaccctcctgcggatgatcccaaccatggcagaggacaaagagagagtcagcactggaaccaagtttgccctcaagctctggctgcaacatctgggcagaacacccccaccgtgtaaaagtgcagcttacctggacccagggccagcaaaggaagaatggaacatggaccctcttcccccaaaccaggggtctggaaagtgaagtgtaaaatcccctccctagcccatctccatgacactcacagaacattcacaacctttattatgggtgagagcttcactacaactttagaaataaaaagtaaaattacaacataggtcctaggccttggcgagcctgaaaaagaagattgggaaggagggcacagggtccttccacctccctggaaaggtgcagaatgagccaggcctaactacagggccatgagcctctagaagcttaggggggaataagaaacactgtgaacttagatatataaatagagagagacccaagcaataggccgggcctgactcccagacccctgcagatcatggctaaggccttacatcctcctctgtcatactggagtaggaggcaggggaagtcatctttggagtattttggtttttcttatttatgtacaaaaaagtccacatccacaatccaaaataaagttctctgtccatctctga

SEQ ID NO: 463092 - DNA, 1684 bp, Homo sapiens
acgaccccgcggaacgttccgtggggaagcttctctaggccaccagagggcgccaggcgggccgcagcgactccagagtcgcgttatggccgaggtgcgggtgcagctgctcctgtcccggcgtccggagtcggtgagcttcgcacggagtgtgtgtggcctcctgggagccggaccagggctcgggacgtggcccattcactgcagcttgaagcgaggacggcttgtcctctcgagcaggcccttcccaggcgcctccgctaggcttccgctccagcgaccccctttctgcccttttgcggccctggaggagcggcccagggtccctggggctgagctgcccacagatcgaggtgtggacctgggtgtggccgtcattctgcagtccagcgacaagactgtcttgctaacccgaagggcacgcaccctgagcgtttcccccaacctctgggtacccccgggtgggcacgtggaacttgaggaggaggtaaccagtcagctgatccaacctgagccaagagacccatgcctgggaccatcttgggtgtgggctgagggagaggcaagcaaaaggacttggaagagtcaggcactggcccctctgatgtgtcttctctgactcccagctgctggacggagggcttcgagaactttgggaggagagtggactacacctgccccagggccagttctcttgggtccctctgggtttatgggagtctgcctaccctcctaggctgagctggggtttacccaaataccatcacattgttctgtatctactcgtgatctcccaggaatcacagcagcagttgcaggcccggatccaaccaaacccaaatgaggtgagcgcccttatgtggctgacaccagatgtagctgctgcagtggctgccgcagaggatgggacagagacacccggacttctcccccaggacctaccaccctctgtccttgcagtggaactagaggaggatggaagagcccgacctctggtcctgcacatgtccaccctcctgcggatgatcccaaccatggcagaggacaaagagagagtcagcactggaaccaagtttgccctcaagctctggctgcaacatctgggcagaacacccccaccgtgtaaaagtgcagcttacctggacccagggccagcaaaggaagaatggaacatggaccctcttcccccaaaccaggggtctggaaagtgaagtgtaaaatcccctccctagcccatctccatgacactcacagaacattcacaacctttattatgggtgagagcttcactacaactttagaaataaaaagtaaaattacaacataggtcctaggccttggcgagcctgaaaaagaagattgggaaggagggcacagggtccttccacctccctggaaaggtgcagaatgagccaggcctaactacagggccatgagcctctagaagcttaggggggaataagaaacactgtgaacttagatatataaatagagagagacccaagcaataggccgggcctgactcccagacccctgcagatcatggctaaggccttacatcctcctctgtcatactggagtaggaggcaggggaagtcatctttggagtattttggtttttcttatttatgtacaaaaaagtccacatccacaatccaaaataaagttctctgtccatctctga

SEQ ID NO: 463093 - DNA, 1539 bp, Homo sapiens
acgaccccgcggaacgttccgtggggaagcttctctaggccaccagagggcgccaggcgggccgcagcgactccagagtcgcgttatggccgaggtgcgggtgcagctgctcctgtcccggcgtccggagtcggtgagcttcgcacggagtgtgtgtggcctcctgggagccggaccagggctcgggacgtggcccattcactgcagcttgaagcgaggacggcttgtcctctcgagcaggcccttcccaggcgcctccgctaggcttccgctccagcgaccccctttctgcccttttgcggccctggaggagcggcccagggtccctggggctgagctgcccacagatcgaggtgtggacctgggtgtggccgtcattctgcagtccagcgacaagactgtcttgctaacccgaagggcacgcaccctgagcgtttcccccaacctctgggtacccccgggtgggcacgtggaacttgaggaggaggacggagggcttcgagaactttgggaggagagtggactacacctgccccagggccagttctcttgggtccctctgggtttatgggagtctgcctaccctcctaggctgagctggggtttacccaaataccatcacattgttctgtatctactcgtgatctcccaggaatcacagcagcagttgcaggcccggatccaaccaaacccaaatgaggtgagcgcccttatgtggctgacaccagatgtagctgctgcagtggctgccgcagaggatgggacagagacacccggacttctcccccaggacctaccaccctctgtccttgcagtggaactagaggaggatggaagagcccgacctctggtcctgcacatgtccaccctcctgcggatgatcccaaccatggcagaggacaaagagagagtcagcactggaaccaagtttgccctcaagctctggctgcaacatctgggcagaacacccccaccgtgtaaaagtgcagcttacctggacccagggccagcaaaggaagaatggaacatggaccctcttcccccaaaccaggggtctggaaagtgaagtgtaaaatcccctccctagcccatctccatgacactcacagaacattcacaacctttattatgggtgagagcttcactacaactttagaaataaaaagtaaaattacaacataggtcctaggccttggcgagcctgaaaaagaagattgggaaggagggcacagggtccttccacctccctggaaaggtgcagaatgagccaggcctaactacagggccatgagcctctagaagcttaggggggaataagaaacactgtgaacttagatatataaatagagagagacccaagcaataggccgggcctgactcccagacccctgcagatcatggctaaggccttacatcctcctctgtcatactggagtaggaggcaggggaagtcatctttggagtattttggtttttcttatttatgtacaaaaaagtccacatccacaatccaaaataaagttctctgtccatctctga

SEQ ID NO: 463094 - DNA, 1718 bp, Homo sapiens
acgaccccgcggaacgttccgtggggaagcttctctaggccaccagagggcgccaggcgggccgcagcgactccagagtcgcgttatggccgaggtgcgggtgcagctgctcctgtcccggcgtccggagtcggtgagcttcgcacggagtgtgtgtggcctcctgggagccggaccagggctcgggacgtggcccattcactgcagcttgaagcgaggacggcttgtcctctcgagcaggcccttcccaggcgcctccgctaggcttccgctccaggtcggcagaagggggccccagagcgggggcagtgaagggccaaagatggggactgaaatcgggtgggaactggcggcgaggaccccgcccccaacgcgcggtgtagccccatttttggaagtcacgcccacccagtgccgcccttctgaagccttaacccagctggcttccttctgccagcgaccccctttctgcccttttgcggccctggaggagcggcccagggtccctggggctgagctgcccacagatcgaggtgtggacctgggtgtggccgtcattctgcagtccagcgacaagactgtcttgctaacccgaagggcacgcaccctgagcgtttcccccaacctctgggtacccccgggaatcacagcagcagttgcaggtagggctggcagtgagggaaggaaacagggctcaggggagcccaagcaacctggttctgactgtgattaggagctgggcgggggtggcgggggtagtcagagataacgaagaatatgcaatgccctttccccttgctcctgcctttctccatgaaacctgcgggtaggttttgatcacgaacaggcagcccagggagaggcaatgactgaggggtcaccatgtctgaccccaggcccggatccaaccaaacccaaatgaggtgagcgcccttatgtggctgacaccagatgtagctgctgcagtggctgccgcagaggatgggacagagacacccggacttctcccccaggacctaccaccctctgtccttgcagtggaactagaggaggatggaagagcccgacctctggtcctgcacatgtccaccctcctgcggatgatcccaaccatggcagaggacaaagagagagtcagcactggaaccaagtttgccctcaagctctggctgcaacatctgggcagaacacccccaccgtgtaaaagtgcagcttacctggacccagggccagcaaaggaagaatggaacatggaccctcttccccctgcagatcatggctaaggccttacatcctcctctgtcatactggagtaggaggcaggggaagtcatctttggagtattttggtttttcttatttatgtacaaaaaagtccacatccacaatccaaaataaagttctctgtccatctctgaaactgcctgtctcagtttttccacctgtctgtttggccgaagggaatggaatagacatgaagagacaatggatgtgaagaagaaatagagccatgggtttgggtaataagaagagagagcatttggggttcaagagaggtgccccttccccaagaggctctagacatagtcaaggctgagggttcagcccttctcctagctcacataccatcccatttgcctcccactgcctaggttaacatacccaaaggaatgtgccaccatctaaagaacatttccagaaacagaccccagtgtcctt

SEQ ID NO: 463095 - DNA, 4300 bp, Homo sapiens
ctccccttggctgagtgctgtgctccaatggaggcaaccatggctttgatcatggcatccccttctgggtccccaagccctgctctgtaccccacagctggcagaagtggacttcctctccatgctaacaggaataccaccaaagccaaagaggctcttctgaagcctcccttccccgcagcatctaggcaacatctgccccagtgggcccccagtttattgcccttgcttgtagctgggaaggtgatggtgtcacaggaggaaaaaggaaacagaagcctggtgggcaccttaggaggagccctcagatggcggctgtatcctggacaaatccaacaagatctgggattttcagcctacacagcccagcggtacctgcctcctggaatctctgggcctcatacagatatattcatgttggaagctgaccctgagaaacagatctccatctccataaaaatctacggtaaaagtagaagaccgagctgaaagtagacaccagattagtaagagttttgttgacccaaccaagagccttgggcctcatcttaaattcaatagtaaaattaagcttttgttttataaaattcacttcggcaatgctgtgggggttgaattagtgggtcctcttctaaccctaatctaggcaagccgggctttgacatttatctcttcttccagcctctcgtggaggcccagcagcctaagaagcctgttctgtgtttcgtctcagtagtagttccttccagccagcgaaggaagtcacttagccaccaaaccctaagtgaaaggttcatttgaggtttaattgaatatggcattatttatccttgtgaataaaccccatatgaggtttctccatcttcaactcatgatcttctattcaataaacacttgttaaactgaaatgaactgaaggcctcaggtctccccagtggcccaagggccaaagccatatttccaataaccacccaagagggttgactctaactaaactcttctcagacttaaacccatattcttttagcacaaatctgttcccctgtttcctcagctctcattaaaagtaatactaacaccccaaaacctggtgaaacattgtcccaaagagttaaacaaacgagtgactaatacaaattcttgagtttacatgatagtagattttaaaaaaagaacaacttgctgaaatgctgaaactctctccatttgtaagataacaaaattggctgaagtcattggagccaatctggcagactggagtctgcacagaaaaagcgtgctgatgtcacagccaaatttccactgcatgtttcatactgaccctccccgaaactgcacatgtgacccatgaggtagcatgaagagataacttcccatgcccgaggactttttccagccctcccttttccttccaccagtcacctactaataccagaatctaatccctaacctttcccaataaaatgactgccttaaagccagcacagggagacagattcaagctaaactcttgtctctttgatggtctagttgcagtaaaaagcttttcttttctcaaaaacctggtgtcatcatctgggcagaggaaccaaagggaaaagccaccttcccaggcacagccataacatccacctcactcaactgcttgtcaagttcaccaccaacacagagggggctcagataatcaagaaacaatgtcgagtgatgataaaagtaaatcaaatgaccccaagactgagcccaagaactgcgatcccaagtgtgaacaaaagtgtgagtccaaatgccagcccagctgtttaaagaagctgctgcaacgctgtttcgaaaagtgcccatgggaaaagtgtccagcaccacccaagtgcctgccctgcccctcgcagtctccttcatcctgccctccccagccctgcaccaagccctgtcctcctaaatgcccttcatcctgcccacatgcttgcccacctccctgccctcccccagagtgaggcactgtgggcactacccaaccccaccaccactgccacctccaccatgtacaacgctgtggggctggagactgaaaccatgaactgacaagtaaacgtgttcctctgctgtgcaagacttctcctggtgtttctggtgggttttgatttgttttgtttgttgttttacagcactaaaccaccaacaagcaatccctgagaagtgaggctagaaccctgcactctcaacaacctttgagaactgactttccctctgaccccacctgctgcttagaggcaggtgcccacttctgaagggtgtacccaggtaatgccaggctgtgttagagcaaagcctgagagatccataaatatggttgcagctgtgaaagcgtctaacgccaggaagcaggaaagagatggtatgagggagaaagaggagtagaatattggtgaaaggtccaggaaggctcaggaaaaggcattgtactacttttctgttagtcctgttgcataatgcttatgcagaagggctctcagtacaggctgcatgggtttaatgcaactctatctctgctccctaacaccttgtaaccttaggcaagttgcttaacttctttgtgtctcagttttcctctctttgcaaaaggaatgatgatgctaacagtactgctgttatgaagttgttgtgtgacatgaggagaccttgaggtctcagggtcttctgaggcactgaggttcccatactctagatccctgcagagaggcactcactggatgccaggagcctctgaaagtctagtttagagcattggggactgtggtaacaggtggaaaccccttcagctgtgggcaacaggtggaaaacccttctacctcacaggaagtcaaaaaggaggaaggacagaagaaagggagagagagagagagataatagaacaataacatggcgtcttcatccatggtcaacagaccatcctctattaaatggtcacttttaaataataaatcctgaacccagtgctaaagagtgtactacagttggtgggaatataaatagacaaaaatccttttagaaaacaattcaaggaatgtgggaatatgtatcatcagaagcattagatgcttcaactctttggcccaatgggtccacttcatagaacctattcaaaaaaaaaattgcaaaatggtgggtaggggagctatataaataaaggtgattatcacagcataacttagaaacaatttaaatatctaacaaggtttgattaagtaaacttgaacctattatatgatgaaacattgttttaagacattaaatttaataatacattaataaattcattacattaaatttaataattttaaaacattaaaataaattttaatttatttaattttaatgtattaacctattcaatgtattaaattaatttaatacattaaaatgaattaaagaaagtaaggcctcaattgaaaatataacgtaaagccattatctttaaccaaaaccttccttgataataatggtaataataataacaaaaggaaatgtgtagatattctcattattttaagacaatggggatataggtaactagtagtttatttctattttaatctggattttcacatgtttttgtttcatgatgggttaaaaaagaagtaatcatgaaataatcaacaatttatgaaataatcatgactacttcagagacccccaaagtcctttattttactcaatgtacaaacacagggaaggaagaatgtcttaggaagaccaagattgcagctcagcacacgagcacaggcaaattctagaaggctttattagtgataagtcataactgcttccatgtcacagcggttgatgctcagcaaagagatcagtaaaaacactcagccgtttgccaaacacataaagattttaaaatacaaactgatggtaaaatgcataccaggatattttcagctgtacctgtcttccaagtgcaggaaatctcatatgtctcatctccagagctatatgctccctcccaggctcaaaggaaactcttctcagactaaggagtcatggctttttcccagaaatgtgctcatcatctctcacctacaccattcaaccctcctaactggctttcgaagttcaccttcctccagttcttactccagtggaagccagccaaggcagtcttgctaaaattcaaatttatacatgatgtccttgcttaaaatccttgagtctcccctttgcctagagggcagctcaaataacattctgtcatgcaaaagccttcagaatcaagcccctgactccttctctagccata

SEQ ID NO: 463096 - DNA, 1577 bp, Homo sapiens
tttcaaagaaaaggttaggaagatgatgagcttcagaaaaatatggtctttgttcattgttaacaatagtaatgaggaaggcagaaatcagtggaagcacagacatgcatggaggaatggaactgagttcaatgacgatctgttcaggaaagagggcataaactgggcagagaatgcagtggaagtggtggggagtaatactgggcacgtaagatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacagcctgtttacttaaaggtaggaacccaaagtgtcctggtggcaatcttaactaccagtttaatggaattgttgttgtgtcttctgatggcagcgttcctccctctggaactaagacctctaggccagcagaacttaatgttgcgggaacaggaagcaaacattttgctagtggatcactaggggtgatggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagaaacagtgagaagaggaacagagctctgggaaagagacagggaagtctggaatggaaaagaacacgatgagaattagacactggaaaatatcaacatggccaatctttcctaagctgctcagcttacaagaaaaggaatcatactgctaagaattcaaacttcagcagtcatagggagccttgggaggaccccgaatcactgatggaattgcgcagtgcatggagatggctcagcaggatgagggtaaatgcaggggcaagtccaggccatactgagagacaatgagtggcgctgatgaggacaaagataaaatcaaaagtttgtgcttcatcttcaaaaactcaagctgataacaaacttggcctgatgagaaataataagtatttttctatttacatgagaatttaatctcaaaacagaaatcagaaaaatatgaagtccagggcataaaacctaaaactattgctcatatttattctttctaaatagagcaaagtgtaaaatcttctccataagacatacattgtggttataaaaaggcaaaagtcttagtgagaatcattggtattccatagaagag

SEQ ID NO: 463097 - DNA, 880 bp, Homo sapiens
agagatttccccttatgtagctattctcagtgcactctggtcaaattttacttggcaataaatccttgcaaacgtcagtcatgtaagtgactaacaagactgaaataccacattgagtcacataccaaatacagtttcagaaaatgtaaacctttcccctgaaactctccaatcatgaatagtttatgctgtacagcataaactattcctgtatgtgccctgtgcaccctcgccttgtgtcaatggaggcacctgtcggcagactggtgacttcacttttgagtgcaactgccttccagaaacagtgagaagaggaacagagctctgggaaagagacagggaagtctggaatggaaaagaacacgatgagaattagacactggaaaatatcaacatggccaatctttcctaagctgctcagcttacaagaaaaggaatcatactgctaagaattcaaacttcagcagtcatagggagccttgggaggaccccgaatcactgatggaattgcgcagtgcatggagatggctcagcaggatgagggtaaatgcaggggcaagtccaggccatactgagagacaatgagtggcgctgatgaggacaaagataaaatcaaaagtttgtgcttcatcttcaaaaactcaagctgataacaaacttggcctgatgagaaataataagtatttttctatttacatgagaatttaatctcaaaacagaaatcagaaaaatatgaagtccagggcataaaacctaaaactattgctcatatttattctttctaaatagagcaaagtgtaaaatcttctccataagacatacattgtggttataaaaaggcaaaagtcttagtgagaatcattggtattccatagaagag

SEQ ID NO: 463098 - DNA, 1324 bp, Homo sapiens
gtggccccctctcccctctttctcccacctctgctctctcctcctctccctcctcccgtctcttctcccactcgcccgccccccccggtcgtcgtttctctccccttcctctgtctgctcctctgctcgtcctcgttggtgctgtgggtgctttgctgtcctgtcgctcttggctcttccgtcgtctccccccctcgctttttttttttttttttttttttttttttcttttttttttttttttttttttttttttttttttctctttttttttttttttctttttgttttcttttggcttctattcctttttaatggactttggcgccttggcccactttccttctttgacagcactggtcctactccagagcattcctctagctagcaaagcagtgtgtggatgtgtgggtgtaggtggcgatacagacctcactggatgaggaccgcctctccctgcaagttcacgatcccggcaaactccagtgcttgaagttcagagtcctaccccacccccctcacccccacgccccttctgcactggtcaagccagcgagccgctgcagccctgatcgagttaaggcgcggcggcccccggggccgctggagaaggatgcggacggggccagtgactcgtagtagatcccctccgcgcggagctcgggccggcgcttcttcctgcgggaaacccctgggtgcccaaggcggcggggccgaggccgcggcgacagtggggcggggcttgcggtgggaggaggcggctgaggcggaaggacacacgaggctgcttcgctgcacacccgagaaagtttcagccaaacttcgggcggcggctgaggcggcggccgaggagcggcggactcggggcgcggggagtcgaggcatttgcgctgggcttcggagcgtagcgccagggcctgagcctttgaagcaggaggaggggaggagagagtggggctcctctatcgggaccccctccccatgtggatctgcccaggcggcggcggcggcggcggcggaggaggcgaccgagaagatacccgccctgcgccccgctctgctgtgggcgctgctggcgctctggctgtgctgcgcgacccccgcgcatggtgagtatcgggctgaggggcgctgtccgcggcgcccggggctgccacctggggcgacccttctccccctcggtccttctctgtgtgggaaggccaggctcggccgccggcgcggagcgaggccactcgctgggttcccgagagtttggacatcgccgggggcccctcccgtggtgccccgccaaccgccggggttccccgccaaccgccggggt

SEQ ID NO: 463099 - DNA, 1913 bp, Homo sapiens
gtggccccctctcccctctttctcccacctctgctctctcctcctctccctcctcccgtctcttctcccactcgcccgccccccccggtcgtcgtttctctccccttcctctgtctgctcctctgctcgtcctcgttggtgctgtgggtgctttgctgtcctgtcgctcttggctcttccgtcgtctccccccctcgctttttttttttttttttttttttttttttcttttttttttttttttttttttttttttttttttctctttttttttttttttctttttgttttcttttggcttctattcctttttaatggactttggcgccttggcccactttccttctttgacagcactggtcctactccagagcattcctctagctagcaaagcagtgtgtggatgtgtgggtgtaggtggcgatacagacctcactggatgaggaccgcctctccctgcaagttcacgatcccggcaaactccagtgcttgaagttcagagtcctaccccacccccctcacccccacgccccttctgcactggtcaagccagcgagccgctgcagccctgatcgagttaaggcgcggcggcccccggggccgctggagaaggatgcggacggggccagtgactcgtagtagatcccctccgcgcggagctcgggccggcgcttcttcctgcgggaaacccctgggtgcccaaggcggcggggccgaggccgcggcgacagtggggcggggcttgcggtgggaggaggcggctgaggcggaaggacacacgaggctgcttcgctgcacacccgagaaagtttcagccaaacttcgggcggcggctgaggcggcggccgaggagcggcggactcggggcgcggggagtcgaggcatttgcgctgggcttcggagcgtagcgccagggcctgagcctttgaagcaggaggaggggaggagagagtggggctcctctatcgggaccccctccccatgtggatctgcccaggcggcggcggcggcggcggcggaggaggcgaccgagaagatacccgccctgcgccccgctctgctgtgggcgctgctggcgctctggctgtgctgcgcgacccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagaaacagtgagaagaggaacagagctctgggaaagagacagggaagtctggaatggaaaagaacacgatgagaattagacactggaaaatatgtatgtgtggttaataaagtgctttaaactgaattg

SEQ ID NO: 463100 - DNA, 930 bp, Homo sapiens
  misc_feature (897)..(897): n is a, c, g, or t
  misc_feature (909)..(909): n is a, c, g, or t
ccagccccagccccggccccggccccggctcgcgggcgctgcgtctccgcgtacaggaggcggcggcggctcccagtcaccggcccccgccggcgagcgcacgatgcactgcctgggcgccgagtacctggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaaggtacgcagctcaaccgcatggccctctgtgtatccaactgccctgaagagcagcttgactccctggaagaggtccagttctttgcaaacaccagtgggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacgggcatgcttgttcgtcntgatttttgttncccaggaagggggattaaaat

SEQ ID NO: 463101 - DNA, 2394 bp, Homo sapiens
ccagccccagccccggccccggccccggctcgcgggcgctgcgtctccgcgtacaggaggcggcggcggctcccagtcaccggcccccgccggcgagcgcacgatgcactgcctgggcgccgagtacctggtttctgcagaaggagcccctaggcaaagggagtggcgaccccagatttataggaaatgcacagatacggcatggttattcctgttctttctcttttggactggtttggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaaggtacgcagctcaaccgcatggccctctgtgtatccaactgccctgaagagcagcttgactccctggaagaggtccagttctttgcaaacaccagtgggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtagcagctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccattgtgaaagggtcatttttaatctctgtggtgaggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctcattgtctttgtcattattgtttgaccaggtaacaatactggaactatattagtttacctttttttgtacaaattaggacagaaaaactcttctaaaaccatgtttatatgcatcaacttacaaagtacactatgtaagaactgaggtaagtttgtaagtgcacaactaataaataaacctttttaagataaggatttt

SEQ ID NO: 463102 - DNA, 1504 bp, Homo sapiens
ccagccccagccccggccccggccccggctcgcgggcgctgcgtctccgcgtacaggaggcggcggcggctcccagtcaccggcccccgccggcgagcgcacgatgcactgcctgggcgccgagtacctggtttctgcagaaggagcccctaggcaaagggagtggcgaccccagatttataggaaatgcacagatacggcatggttattcctgttctttctcttttggactggtttggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaaggtacgcagctcaaccgcatggccctctgtgtatccaactgccctgaagagcagcttgactccctggaagaggtccagttctttgcaaacaccagtgggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtagcagctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccattgtgaaagggtcatttttaatctctgtggtgaggacggccgtgtaatcgtcattcaacattactagacgcttcctgagtgtagacgc

SEQ ID NO: 463103 - DNA, 119 bp, Homo sapiens
acctgtttatcttctttttctcaactctccctttttctggaaggtttctgcagaaggagcccctaggcaaagggagtggcgaccccagatttataggaaatgcacagatacggcatggt

SEQ ID NO: 463104 - DNA, 455 bp, Homo sapiens
tctccctttcccaaaaacagaattatctgtaccccatttagacactcactgtgattctcccctgtgctactttatatgccatttctcctgttaatctgccttttgtaagttaattcttcagcaaaccgtcagagggcaaaggagaagttttccctcggcccctacgttatcaacagtacagacacataatactattctaacttgttcttttgtttttcagagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctc

SEQ ID NO: 463105 - DNA, 1889 bp, Homo sapiens
ccagccccagccccggccccggccccggctcgcgggcgctgcgtctccgcgtacaggaggcggcggcggctcccagtcaccggcccccgccggcgagcgcacgatgcactgcctgggcgccgagtacctggtttctgcagaaggagcccctaggcaaagggagtggcgaccccagatttataggaaatgcacagatacggcatggttattcctgttctttctcttttggactggtttggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaaggtacgcagctcaaccgcatggccctctgtgtatccaactgccctgaagagcagcttgactccctggaagaggtccagttctttgcaaacaccagtgggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtagcagctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccattgtgaaagggtcatttttaatctctgtggtgaggattccgagaatcattgtcatgtacatgcaaaacgcactgaaagaacagtttttatttccatgcacatttggttatgaatgccagtggaaaccagaacaccaggaaaacagctgttctcatggtatttctggcctgccaaacaagagaagattggacttttcccaagtcttctgttctcacacaatgttaatctcttcccccgtcaccaccttagagttggtgacttgcagcatggtgcattgtccaggtacctgttccgatgctgctactgctgtttctggtgtcttgacaaatacctgctccatctcaaccaggggtatttagaatacttttcattattcagggaaaaatgtagccttcttatagtaaggtctatttttaggctcttaaacttggagaacattttagagtatatttagttttcatttggattgctat

SEQ ID NO: 463106 - DNA, 2424 bp, Homo sapiens
ccagccccagccccggccccggccccggctcgcgggcgctgcgtctccgcgtacaggaggcggcggcggctcccagtcaccggcccccgccggcgagcgcacgatgcactgcctgggcgccgagtacctggtttctgcagaaggagcccctaggcaaagggagtggcgaccccagatttataggaaatgcacagatacggcatggttattcctgttctttctcttttggactggtttggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaaggtacgcagctcaaccgcatggccctctgtgtatccaactgccctgaagagcagcttgactccctggaagaggtccagttctttgcaaacaccagtgggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtagcagctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccattgtgaaagggtcatttttaatctctgtggtgaggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattgtttctacacaaataaaccaaaatggcctgactgacctcaacggcggcacactattgcccataacctctaccgaggggccgttactcattcctcactatctttcctcaacacacatcgacactaccccctccccccacccgattacttctttcctcatccccccccccactatccccctcgccacctcgccaacccctccacaccccctccttatttcccgccctctacctcgcc

SEQ ID NO: 463107 - DNA, 1038 bp, Homo sapiens
  misc_feature (1005)..(1005): n is a, c, g, or t
  misc_feature (1017)..(1017): n is a, c, g, or t
ccagccccagccccggccccggccccggctcgcgggcgctgcgtctccgcgtacaggaggcggcggcggctcccagtcaccggcccccgccggcgagcgcacgatgcactgcctgggcgccgagtacctggtttctgcagaaggagcccctaggcaaagggagtggcgaccccagatttataggaaatgcacagatacggcatggttattcctgttctttctcttttggactggtttggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaaggtacgcagctcaaccgcatggccctctgtgtatccaactgccctgaagagcagcttgactccctggaagaggtccagttctttgcaaacaccagtgggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacgggcatgcttgttcgtcntgatttttgttncccaggaagggggattaaaat

SEQ ID NO: 463108 - DNA, 956 bp, Homo sapiens
cattctggaatgcttgcatacctgcctttccagtgggtccttcctatgctctcatcctgcggaaggctctgtgagctcttgtctccactggttggcatgaaggtcatgttcctgagaagtaccctggctggggtggggcgtatcaaaatctccaacgggtggctggtgagggacaaggaaatattctctttaaagtcctcctaccccaagtctgatctggtgctggagaaagttgcagtgaagaccaggagtggagaggcagcgaaggtcatcatcaggaggggcatccccttcctgaaccaagtcagcagcagctgccagagccacagcgagggcggagatgaggagccccccgcaggcctggctgcagatccttgcagcctctgtgtcaggaacatggccaaccttacgaattcccaggagcctcgattctggaccaaatccccaagatcgtcaccagatgcggaccgccggccctttctaggccccatccccagccacggccctctgcctctcccttttgctgagaatgccttgcactggtttatgctgtatgtctttatcagcagcatgaaaacggactaatataaggggcaactctgggacctgggaagaaaccagaaggcttggcatttcctttctcgtggcattgtcaaagggaacattctgttgacatcagaggatgaattctgcttcaaggagtgagaaagtacagagggtttagtcatcacccctctcagacgcttgcccgtgctgtgaaccactgtcggaggaaggaggaaaatctgtgggttcagcccacagggagctcagctggtacccacagcagtctgtagagctcttctcagctcgttatcaagcctaatattccaatggcccacattttattctttatattctcagatataatttcctattaaaaatacaaatccccacaaaatctcactttttaaaaa

SEQ ID NO: 463109 - DNA, 1209 bp, Homo sapiens
  misc_feature (1)..(1): n is a, c, g, or t
  misc_feature (8)..(8): n is a, c, g, or t
  misc_feature (11)..(11): n is a, c, g, or t
ncttctgnccnagaaaggtccataaatgccatctaaaatgcaaggcttggaatcatggactccaggagcccagttggtgcactacctcactgtggctgcactggcgcccaagctgcaagacaaagtcccctttactcttccctctccttttctcaagcagaaggagtctctccctatggccaccacagtgatggttgagaagatttgtagtggaaagaaaaaggctttcaggatttgcagttccagcactgaaactctttccccacatttagatgtcttcgatatttcttttgtcagcaaaacaaatggcctgggctctgaaggagggggagctgctcagggtccacactggagccagaagccagtcacctgcttaaagggtgcagtggctactctcatattcagagtaaaaggtgttatacaatcctacaccaatatgactgtggagctgctgaaggttaagaagctgtctccaccgtatgttcttaagtggagtctcgcactgtcatcctggctggaatgcagtggtgcaagccgactcactgcaacctctgcctcttgggttcaagtgattctcctgcttcagcctcctgatttgctgggattgcagagcaaaccagtgaaaaaatggccttcgcactcctgagagacctttcaccgggctttctacttttgaattctctccatagctggtttcctcttaggcctcgatagagcagtccctgaatcacacaggtatgctgactacgtcttttcctggtacaaaccatcatgggggaaacacacagcaagaagcatcttcaggtcacaagataggccttctaagactgaattacatcaccagctttcctgggtctccagcttgcagatggcacactgtgggacttcttagcctgcagaatcattgaagcacccattgattgccccttactctagggatttacagctttgtgcttgtcgtggccactgctcccaaagtgactataatccggaggatccccacgacccttcagagcaggcaagacaccagcaccagaaactctgaaaacctaaaagtcaagaacaatgcttttgcattttcctgtcccttctaaaatttcatttttaagtggtgagatctctttaagaagaggtttcaaaaataatgtaaaaagtattgcttgcaagatttgaaaataagccaattcaacaaatccaaaataaaaagct

SEQ ID NO: 463110 - DNA, 948 bp, Homo sapiens
  misc_feature (1)..(1): n is a, c, g, or t
  misc_feature (8)..(8): n is a, c, g, or t
  misc_feature (11)..(11): n is a, c, g, or t
ncttctgnccnagaaaggtccataaatgccatctaaaatgcaaggcttggaatcatggactccaggagcccagttggtgcactacctcactgtggctgcactggcgcccaagctgcaagacaaagtcccctttactcttccctctccttttctcaagcagaaggagtctctccctatggccaccacagtgatggttgagaagatttgtagtggaaagaaaaaggctttcaggatttgcagttccagcactgaaactctttccccacatttagatgtcttcgatatttcttttgtcagcaaaacaaatggcctgggctctgaaggagggggagctgctcagggtccacactggagccagaagccagtcacctgcttaaagggtgcagtggctactctcatattcagagtaaaaggtgttatacaatcctacaccaatatgactgtggagctgctgaaggttaagaagctgtctccaccgtatgttcttaagtggagtctcgcactgtcatcctggctggaatgcagtggtgcaagccgactcactgcaacctctgcctcttgggttcaagtgattctcctgcttcagcctcctgatttgctgggattgcagagcaaaccagtgaaaaaatggccttcgcactcctgagagacctttcaccgggctttctacttttgaattctctccatagctggtttcctcttaggcctcgatagagcagtccctgaatcacacaggtatgctgactacgtcttttcctggtacaaaccatcatgggggaaacacacagcaagaagcatcttcaggtcacaagataggtaataccatctacctgaattttttcaaaagcagcagaatatttagttttctatttcagtggcttctaacagagatcattgtttgcacaagattaaatgtctgcagtggtcgtcttatctcagtgtgtgata

SEQ ID NO: 463111 - DNA, 1164 bp, Homo sapiens
tcggcacgaggctgagctacaactacaaccagaggtctaaactacaaccagatctgaattcttgttgggagccattttgtgaagagacgaagactgagctggtttggctgcatttctggcctcgagccgcagtcagtttctccccgtagaacccggcagtaggagacttagaatcgaatctcttctccctcccgcctcctgtttttggctttttgagaaaccttatcatccaacacaatggccagcaacgttaccaacaagatggatcctcactccatgaactcccgtgtgttcattgggaatctcaacactcttgttgtcaagaaatcggatgtggaggcgatcttttccaagtatggcaaaattgcgggctgctctgttcataagggctttgccttcgttcaatatgataaggagaaaaatgcccgggctgctgtagcaggagaggatggcagaatgattgctagccaggttgtagatattaacctggctgcagagccaaaagtgaaccgaggaaacgcaggtgtgaaacgatcagcagcggagatgtacggctcctcttttgacttggactatggctttcaacgggattattatgatggaatgtacagtttcccagcacgtgtacctcctcctcctcccattgctctggctgtagtgccctcgaaacgtcaacgtctatcaggaaacacctcacgaaggggcaaaagtggcttcaattctaagagtggaaagcggggatcttccaagtctggaaagttgaaaggtgatgaccttcaggccattaagcaggagttgacccagataaaacagaaagtggattctctcctggaaaacctggaaaaaattgaaaaggaacagagcaaacaagaggtagaggtgaaaaatgctaagtcagaagaggagcagagcagtagctccatgaagaaagatgagactcatgtgaagatggagtctgaggggggtgcagaagactctgctgaggagggggacccactggatgatgatgttaatgaagatcagggggatgaccagctggagttgatcaaggatgatgaaaaagaggctgaggaaggagaggatgacagagacagcaccaatggccaggatgactcttaagcacatagtggggttgagaaatcttatcccattgtttctttacct

SEQ ID NO: 463112 - DNA, 1172 bp, Homo sapiens
ggctgggcctcctgtctttctgcaggtttgtgacttacctttgcttccatgggaagaaaggaggcgggaaatgaggtacaaagagaaaattggattactgactggagctggcagagaggtgtggccaagttcctggagaaatgcttcctgctcctcccgccctccccaccaccatcctgctgtatttaaagctgctttggtgatgctttgctcatctcagtgaattttcagttcagaccttttcactaaggatcattatggaagaaagaggggtaagaagtgtggctgagtagcctaggattaattcatcagtccccaaataagcaaacacgatgtctcaggatggacggtgaaattctggacctcacaggaccctgctttctcggctgtgattcacgacaaactccaggtccccaacaccatccggaaggcatggaacgaccgggacaaccgctgtgacatttgcgccactcacctgaaccagttgaagcaggaggccatccagatggtgctgacgttggagcaggcagccggcagtgagcactacgacgcctcgccctgctccccgccaccgctctccaacatccccaccctggtggggtcccggcacgtgggtgggctccagcagcccagagactgggcctttgtgcccgccccctgtgccacctccaactacacaggcttcgccaacaagcacggcagcaaacccagcagccttggggtcagcaatggggcggaaaagaagagcgggtccccaacccaccaggccaaggtcagcctccagatggccaccagtccaagcaatgggaacatcctcaattcggtggccatccaggctcaccagtacctggatggcacctggtccctgtcgagaaccaacggggtcaccctgtacccataccaggtccttgctggtccaggtgatgccagcgacttcccagccagcagatttaccacatggcagagccatgaagaggtaggccacacagatacttggactggggtccaagccccgacttgtccacttattagcagcgtgacttggcacaaggggtttgccctgtcttaggctcaagtccctcatttataaatggatttatttaaattagaacatgcccccaagtttctccatagaaataaaacacaggtcttaaatctcccagggaatcttt

SEQ ID NO: 463113 - DNA, 844 bp, Homo sapiens
gggtctggttccttggtttcagcgcctaacacagcaccatggacttagtgaacgtgaagtatgttagccaccatcattatcaagggcttactgaagaaatttgaaaatctggcttcaaaacgatggtcctgctgcaaggtacaggctgtgatacatgaggtgatcaatcttcttagatatgcggtatcttctgagcagccagcacagaatcctcattctcctcatccacgtgaccttctctggcatccgggcattggttgtaccctttcgcttacctatgcccatgtgcctgcccttccggtaggccaaggtgttttcctggcatcgagcctgggaatggacagtcattggcttgcggatcatcagcccatctttgatcagcttccagatctgctgacaggagttggcattggagatttcattggtttcattggggtccaaccagaccttcttcttgccacaggggaggaccctagaggcaagcctcttctgaagcctgagcatactcatggctgtgaccatagcagtgaaaggtgagtgatctaatattgacttgattcctcccattaagtggcctctgagtgggcaaagccagtgaatggggacacctgagcactgcctgctgtcgggactgggcactgcctaagacaatgattacttttgagcttttctgaagtgaaaataagtcaatgtgaacatggcaaagagggacagaggaagagacttatggtatctagaaggaagttggcaggtaacagggtgccaggaaattaagacctaaagaaatagagtggaggagaaggagggtgggggcacaacagtggattgtggttttgcatttgaa

SEQ ID NO: 463114 - DNA, 2405 bp, Homo sapiens
caccttgaatgaagaaccatcgggctttcctgttggtatatgcctttccagacttttaaaaattactgctatttttatcccttccaggtctcccggcccctgcccctgtggagggacaatagacagactccatggctgctgtcccttcgaggggagctggtggcttctcttgaagacgccagcctgatgggactgtatgtggacatgaatgccaccactgtcaccgtccaaagcccgagacaaggccttcttcagaggtgggaggtgctgaacacctctgctgagctcctgccactatggctgccagagtcggaggtcttagttcacatccccaagcagagactgggtctagtcaaaagaggttcctacattgaggaaaccctgagcctcagattcctccgagtccaccagtccaacatctttatggtgactgagaacaaggactttgtggtggtcagcattccggcggccggggtgctccaggtccagcgatgccaagaagtcggaggaaccccgggaacacaagctttctatagggtagacctgagcctggaatttgccgagatggctgccccggtcctctggacagtggagagcttcttccagtgtgtgggaccatctgtcaccctgactgaaggtctaggaactgtgaggcctgaacaggaccccgccaagtctccaggaagtcccctcctgctgagaggcttgtcaagcggggatgtggctgcacctgagcccatcatgggggagcccggccaagccagtgaggagttccagccattggcgaggccctggcgggccacactggctgcagaggagctggtttctcaccgttctcccggagagccccaggaaacgtgctctggaacggaggtggagaggccacgccagacagggcctggtctccccagggagggggccagggggcacatggacctttcatcctcagaaccaagccaggacatagaggggccgggactctccatcctgccagcgagggatgccacattctccaccccaagtgtgaggcagccagaccccagtgcctggctgagttcaggacctgaactcaccgggatgcccagggtgaggctggcagcgcccctggcagttcttcctatggaacctctgccaccagaacctgttcgcccagcagctcttctgacacccgaagcctcatctgtgggagggccagaccaggcccgatacctggagtcagcccctggctggcctgtgggccaggaggagtggggggttgcacacacgtccagccctccatccacgcaaaccctgagcctgtgggctcccacaggagtgttgctacccagcctggtggagcttgaataccccttccaggctggccggggggcctcactccagcaggagctgacagagcccaccttggccctcagtgctgaaagccacaggcctcctgagcttcaagacagtgtggaggggctttctgagaggccctcacgctgagcctccatggagactccaggcagccggtaccccgctggcttggacagccccagtgaccctcagtgacccagctgtccccaggctccctggcttagatgcccagctgtggctgggtacagtgttctgggccggaagagcactcactcagtgcttccctggaaaggtggacccccagacgcccacctccaggcagacccatcactggaagtgggatttgaaatgcagccaagaagaggagaccgtcggcaacgcccgcccggaacaagaaataaataaataaataatcagggttgtcttggctgataaacggtccccacctcgaagaagacttctcccccctctgcgctccctcctcctccctctccgggcagatccgtcccgggcaaaagcttaatagccccatttaaggcttttccttttcaccacgagactgagctgctcctgccattacgaggttttcagcttctctctgaaatcaaattactgactccatttaattttttaaaagctcagatgatttcccttctcgaatccgagccatgactccaagaccagcccccaccagccctaccaggcggttcccctgcgggcagccgctgccctgggacggcggcccccacgcctggggaagcctgacacctagagggaaagccagcaggaggaggcctgagtctctggctgccaccctggacactgggctgggtggcctgagctggaggaggcccacaggagcccatggctagaggccggatgatcttcaaaggctggtgggcccttccaaccccttgtcccttcatggcaaggagagtttgtcaaccttaccctggtggcagcctctgcccggatccagatgaccatgggggtgggagcctcagtcctggttccaggagcaccccagaggggcccgactcctggctgtgtgc

SEQ ID NO: 463115 - DNA, 1184 bp, Homo sapiens
tggagggtcaatttggagatagtcatggacatgatgggctgatgaaccacagaaggatcatttggactccatttggcagagacgtcagaaactcactgctcttgggaacatccttttccaataacatttatagttctagatggaagcgaaaagcaccatatgttaagagtttcctgcaaagcttcctggtaagagaggaaataaattcaacttgtcacatctgctcgtgggccagtcaagtaggattttatcacagccttaagtggtttacaaaactgtcctatgtgtccagagtttcttccttctgcgggttcgtggtcttgctgacttcaggagtgaagctgcagaccttcccagtgagtgttacagctcataaagaccttagagatcgtctactcaaccactcttgctttgcatttgagaatttaagtcacttgaccaaagtcagacaacagtgattatattactacagtgattctggagtgttctcaacaaataataacctcagaaacaagtaggcacttggagacattgggctgtggattcaggttgcctaggtttgaatcctagtcccaacatttactaaggctctctgatagtgggcacattatttaacttcctcagacctgtttccccatctacaaaattggattacctatgctccaaggtttgtgatctagaattcaactaataaattcaggcaaattattccaattatattaagcactagtactcaaagctgacatttgaggctcaaatggagtgtcttcttagcttttgtctcctgtcatttcagccctaagccgaaatccaaaaataatgggaaaattctatgccctgatataacacagaattataaaggaagctacaatatcccatactccttgcttcatactctagaatccatttaaatgaggtttaaaattgttccggttgagtcattccttccagtcaaggcatattctatctgaaggactcaaattaattagctacagttaacagattattaagtcaactggcttctacggagatggtgagagaggccatgtgggtacaccatgagaagtctgtcatctacaggaaaggaagagagccctcccaggaaactgactttgccagactttgacctggaacgtctattctccagaactggctccttcttcataggctgggggtgtatacaa

SEQ ID NO: 463116 - DNA, 2040 bp, Homo sapiens
tggagggtcaatttggagatagtcatggacatgatgggctgatgaaccacagaaggatcatttggactccatttggcagagacgtcagaaactcactgctcttgggaacatccttttccaataacatttatagttctagatggaagcgaaaagcaccatatgttaagagtttcctgcaaagcttcctggtaagagaggaaataaattcaacttgtcacatctgctcgtgggccagtcaagtaggattttatcacagccttaagtggtttacaaaactgtcctatgtgtccagagtttcttccttctgcgggttcgtggtcttgctgacttcaggagtgaagctgcagaccttcccagtgagtgttacagctcataaagaccttagagatcgtctactcaaccactcttgctttgcatttgagaatttaagtcacttgaccaaagtcagacaacagtgattatattactacagtgattctggagtgttctcaacaaataataacctcagaaacaagtaggcacttggagacattgggctgtggattcaggttgcctaggtttgaatcctagtcccaacatttactaaggctctctgatagtgggcacattatttaacttcctcagacctgtttccccatctacaaaattggattacctatgctccaaggtttgtgatctagaattcaactaataaattcaggcaaattattccaattatattaagcactagtactcaaagctgacatttgaggctcaaatggagtgtcttcttagcttttgtctcctgtcatttcagccctaagccgaaatccaaaaataatgggaaaattctatgccctgatataacacagaattataaaggaagctacaatatcccatactccttgcttcatactctagaatccatttaaatgaggtttaaaattgttccggttgagtcattccttccagtcaaggcatattctatctgaaggactcaaattaattagctacagttaacagattattaagtcaactggcttctacggagatggtgagagaggccatgtgggtacaccatgagaagtctgtcatctacaggaaaggaagagagccctcccaggaaactgactttgccagactttgacctggaacgtctattctccagaactgtgagaaaatacatttctattgtttaagacaaccagtctatgacattttgttatgacaatggtgcagattaagaatcttatcttctactatacccgcttgctcactctaatcagaagcattggcctctttcacattccttaaggatagtatgttttaggggctttgcactgtttctactgcctagacttcttttccaccatgtattctacatgatcaatttatttgatcaccatcttcaaatctctgatcatgtcactttcacaatgaggtcttataagaacaccctgcttattactataacctgccacctctccagcctgggtcctcctgaacccctttatactgtctcatgtttaatatttctatttcttttctctctttctttctcctccctcactttttccttatttttaaaattgacatataataattgtacacatttatggggtacagtgtcatttcaatatatgcatgcaaggtgtaatgatcaatttatggtaattagcatattcatgacctcaaacatttcatttctttgtcttgagaacattcaaaaacctctcttctagatgtttgtgaataaaataaattaatattaactatggtcaccctacagtgctatagaacactagaatttattcctcctgtctagctgtaataagtataattgacttcaaaatcagcagaaaaagcaatggttgaatgcctttttcttcctttttttctttttccccttttctttctaaagaagtcaacataagcttataaagtgaatgatcctattctcagaatattttactttcaggatttttattaattttgatacttatagccagtggaagaaagcacactagtctttgaactccagagctgtcagttgtcttccat

SEQ ID NO: 463117 - DNA, 1263 bp, Homo sapiens
cgctggctctggggtctgggggcattgctcagcggtgctaggctggcgcggcttgagccgccgccggactgacagctcggtctgcggaccatggagacctgcgccggtccacacccgctgcgcctcttcctctgccggatgcagctctgtctcgcgctgcttttgggaccctggcggcctgggaccgccgaggaagttatcctcctggattccaaagcctcccaggccgagctgggctggactgcactgccaagtaatgggtgggaggagatcagcggcgtggatgaacacgaccgtcccatccgcacgtaccaagtgtgcaatgtgctggagcccaaccaggacaactggctgcagactggctggataagccgtggccgcgggcagcgcatcttcgtggaactgcagttcacactccgtgactgcagcagcatccctggcgccgcgggtacctgcaaggagaccttcaacgtctactacctggaaactgaggccgacctgggccgtgggcgtccccgcctaggcggcagccggccccgcaaaatcgacacgatcgcggcggacgagagcttcacgcagggcgacctgggtgagcgcaagatgaagctgaacacagaggtgcgcgagatcggaccgctcagccggcggggtttccacctggcctttcaggacgtgggcgcatgcgtggcgcttgtctcggtgcgcgtctactacaagcagtgccgcgccaccgtgcggggcctggccacgttcccagccaccgcagccgagagcgccttctccacactggtggaagtggccggaacgtgcgtggcgcactcggaaggggagcctggcagccccccacgcatgcactgcggcgccgacggcgagtggctggtgcctgtgggccgctgcagctgcagcgcgggattccaggagcgtggtgacttctgcgaaggtatccagttggctgggggccgtggggtgggagtgtagagcgtaggtggcaattgagagagagtgtgccctagaggaaagaggcgggtgtggggtcggggggcggtggagaagccttggactctggagcccaaggagagccctgaagtcttgtggagtttccaatgaagaaacagagcctcagagagattagtacctcacttgcaaatttaggaaatggggagctaggatttgaattcaggcttgcccaactcacattctatgacatcatgaggtctcctcagtgcataaggaagaactctacagcagcccaatcttcaggct

SEQ ID NO: 463118 - DNA, 3576 bp, Homo sapiens
gggaacctgtggcccggctctctgcgcgtccccatcccccgtggccccgaccccggccatgaagcgtatcttctcctgctccagcacacaggtggcggtggagagatggaaccgccatgatcagaagctgctggaggcagtgcacaggggggatgtgggacgcgtggctgccctggcctccaggaaatctgcccgacccaccaagcttgactcgaatggccagtccccgtttcatctggcagcctccaaaggcctgacagaatgtctgactatcctgcttgcaaatggggctgacatcaacagcaagaatgaggatggaagcactgccctacacttggccaccatctcctgccagccacagtgtgttaaggttctgcttcaggatgttaacaccaagctccatgctgcttccctttgtggccatttgcagcatggtgctaatgaagatgctgtggatgcagaaaaccgtagtccattgcactgggcagcctcctctggctgtgcctcaagtgtgctcctgctgtgtgaccacgaagccttcctggacgtgttggataatgatggacgtacacccctgatgatcgcatcgctgggtgggcacgcagctatctgctcacagctgctgcagcgaggcgcccgagttaatgttacagacaagaatgacaaatcggctttgatcctggcctgtgagaaaggcagtgccgaggtggctgaactgctcctgagccacggagctgacgcgggggctgtggacagcacagggcatgatgctctgcactatgctctgcacacacaagacaaggcactgtggaggcacctacagcaggccctgagccggcggcggcggggcggtcagaggctagtccagcacccagatctcgcatcccaggcctctccatctgagccccaggcaggttctcctcctaagagctcatggagagcagagcctgaagaggagcaagaggagaaggaggatgaagacccgtgctcggaggagtggaggtggaagtatgaagaggagcggaggaaagttgttcggctggagcaggagctggtgcaaaagacagaagagtgtaagactcaagctgcagcctatctggaccttgagaaccagattcgagagcaggcgcaggagctaggggtcctcctatcctgggagcccagagcttcaggaaagcaaggctctagtctccggcctggaggggatggcatggagcagggttgtcctaaggacctgctggctgagagtacacaagagctaaagaagcagcagcaggcagcagccacagtaaatccagtattagctccaaagaaggctgaggactcagccccaggaaagatccagtatgaagtccatggaaggtcccaaccagaagaacaggggccaccccagagcccagcgtctgagaccatcaggaaagccacaggacagcaactgactaccaatggggcacagacctttggccctgatcatgctgaccagctgcctgctggtcagaaggagagttcccaggttctaggagttgaaccaggaggcacagtggctgaaccagtgggcccagcagccatgaaccagcttctgcttcaactaagggaggagcttgctgcagtgtggcgagaaaaggatgctgcccggggggctttgtcaagaccggtcatggagggagccctggggactccccgtgctgaggcagcagcagctgcctgggagaagatggaagcccgactggagcgggtgctggcaaggctggaatgggcaaaggcaggactacaggtgaaacctgaggttccttcccaggagtccagagagggagccctaaaggcagccccagggagcatcaaacaggatgaagagaaggagaaaagggttcctggggctcgaggagagcctctaggggcccttggaggggaaaaggccctaggaggcctggcaaagggacagctggagaaggagatgtcagtactgagactgagcaacagtaacttgctggaggagttaggggagttggggcgggagcggcagaggttgcagagggagctacagtccctgagccagcggctgcagcgggagtttgtgcccaagccagaggcgcaggtccagctacagcagttgcgacagagtgtggggctgctgacaaatgaactggccatggagaaggaggccacagagaagctgcggaagctcctggcctcccagagcagcggtctccgagggctgtgggactgcctgcccgcagacctagtgggcgagaggagtgcacaaagcaaagcagcggagtccctggaggagctgcgggcctgcatcagcaccctggtggatcggcaccgggaggcccagcaggtgctggctcggctgcaagaagaaaaccagcagttgcgggggtccttgtccccgtgtagggagccaggcacctccttaaaggccccagcatccccccaagtggccgctctggagcaagacctggggaagctggaggaagagctgcgggcagttcaggccacgatgagcgggaagagccaggagatcggaaagctgaagcagctgctctaccaagccacagaggaagtggctgagctaagggcccgggaggcagccagcctacggcaacacgagaaaactcggggttcgctggtggcccaggctcaggcttggggccaggagctaaaggctctgttggaaaagtataatacggcctgccgggaagtgggtcggctgcgggaggcggtggccgaggagcgccgccggagcggggacctggccgctcaggcagccgaacaagagcgccaggccagcgagatgcgggggcgctccgagcagtttgagaaaacggcagagctgctgaaagagaagatggagcatctcattggggcttgccgagacaaggaagccaagatcaaggagttgttgaagaagctggagcagctttcagaagaggttctagcaattcggggagaaaatgctcgccttgccctgcagctgcaggattcccagaagaaccatgaagagatcatctccacctacaggaatcatctactgaatgctgctcggggttacatggaacatgaagtgtacaatatcctgctgcaaatccttagcatggaagaggagtgaggcagcctcactgtgtgccctcagggatacgagattctctgttggaataagaaaccctggttgacagaggcttcatcaggctgtggtgggcgggggtgttggccactaggcaatggtatgggcagggcttcacctgacattatggacctcagacctgagaacctggaccctggaatcagcatggatgagaccagaggaggtatggatggaaacaagctctatggaaaataaagcatgaggcaggacggggctgagtgtaattttttttttttctaaaggggagtggggaaaggaatatctttcatccctttattcttttctttttttctggaaacaaatattaacattcaactggcaccttcaatctttggcctgggtagggtcttatgaggaggattatactgaaggcttaagctaaataaaaggatttttcctatttattaaagcccttttttggtgtgctg

SEQ ID NO: 463119 - DNA, 3916 bp, Homo sapiens
  misc_feature (3)..(3): n is a, c, g, or t
  misc_feature (6)..(7): n is a, c, g, or t
  misc_feature (9)..(14): n is a, c, g, or t
gcncanngnnnnnnagctgcaggacaagttcgagcatcttaaaatgattcaacaggaggagataaggaagctcgaggaagagaaaaaaaaactggaaggagaaatcatagatttttataaaatgaaagctgcctctgaagcactgcagactcagctgagcaccgatacaaagaaagacaaacatcgacctcctgaagctgcgtcacaggcactaatcaaagaacacaaccaaggaaccagatgggaagcaggtttgcataagccagttcccagcttggcttttccctttggcttatctcgctctctctcccagtctggagtgcagtggcgtgatcttggctcactgccagctccacctcccaggttcacgccattctcctgcttcagcctcccaagtagctggggctacaggcacctgccaccaaacccggctaatttttttgtatttttagtagagacggggtttcaccgtgttagccaggatcgtcttgatctcctgaccttgtgatccacccgcctcggcctcccaaattgctgggattacagatgtgagccaccgcacctggtccaagaacccaagttttagatctagagtgatgtcagcatgacattgatttcctgaggcccaggggcgaaggagctgaggacagcagaggggtgaaggaactcagctacagacagcagcagctgatgcacaggcctcccagcgcctgaagtcacccggaattgggaagtgctcagaagcttacaaagctgcctcgaggtgggaacatgacataaatccaagagcagatccctgatcctataaaaatgtactagatgcagtgggggcattttaaatgagcagagaaggacagacagataaacagaaggacaaacagtattgggattgggataaatgctcagcttttgcccaaatcttagtgacttaagcatcacttatttgctcacgattctgtggctggaccatttggtttggctcacagggcagggactgtgctggtcttacctgagcagacctgcatgtctgcggtcaactgggttggcagagacagagtgactgtcttcctccaggaagcagcaggttaactggttggcagagacagagggacagagggactgtcttcctccaggaagcagcaggttaactggttggcagagacagagggacagagggactgtcttcctccaggaagcagcaggttggctctgtttccttcgtggggcagctggtctccagggcagcaagagagaccaagccccagtgcacattctacagcctctgtgcacatcagacttgttaatatcccattggccagtgtaagtcacttggccaagcccagattaaggagtggaaagatggaggctatctcctcctgggagaggaggcaaaggaggtgggagtattatgtggccacttatgtttgcaatctaccatacttagcactttgagaaaagaattaactgagaaacttgcttcaaatagggccagtaaaatgaagccccaattgaagtaaaatgcatatataaaaaatgaaactgtgaccgattttaaggacagtattggcaaatatttctgtgctcttggaggagaagacccttattggcatgacatgtcagaaaccacaatgaaagaattattttaacttgcattcataaaaattaaaattattcattaaaaacatcgtgaatgaaattaaaagtcaaaatgtaagccagaaaattatttacaacgtatgtgtcaggaaaagacaatacccttcaaactttgagagtttacatcagaaagaaaacagcaaatgacatgatccaaacttgataaaggacatgaaaaagagccagcacttagtatgttttctgaatgaataagtagccaacagcacatgaaaatgcgtgtaatccatttgtaagcagagaaatgcaaactaaaacagtaaagtgtcattttcacttcctggattggcaaagggttttatgtattttactgatagtgctcaatattagcagtaaacaacaaatggtgagtaaatatgagcttcggaacctcagggaaatgatctccttatttcaacctgtagattccttcctacaaccagtgtctactgagcacctactatgtgccaggcacagcctaagtcctgaaggtgtagtctccactgagaaggtgatatttgcacaaagacctgaaagacaggagtgaactgtgtggataactgtgggtacccctacaggcagaggagtagcaatgtgggtcccaaggtgggaccacatcagacatgttcgaggactagctgagggagagaggtgggaggtcagaggagatgggggccggctctgctggccgtcacgagcactctgggtgcagagggcgagaggtgggaggtcagaggagatgggggccggctttgctggccaacacgagcactctgggtgctgagggcgagaggtgggaggtcagaggagatggaggctggctctgctggccgtcacgagcactctgggtgctgagggcaagaggtggggaggaggtcagaggagatgggggccggctctgccggccaacacgagcactctgggttttcctccaaatgctatgagagcagaggagtaacctggtctgacttgggtgtgagcagatctctctggttgttgttctggaaaaaactgaggtgcccacgtgaaagcagagatcggttaggaggctgctgcagcaattcaggcaaaaatgggtggcgggcctcgggtgtagtggaggagaagcgatcggattttggatatttgtagctccctcaatacgatttcctggagaaggagatgacttcaatcttctggcctgagtagctgaaaggatgaagctgtccttcgcggaggtggggaatccacagagaagcgggtagggagagagtatcaggagctcagttttagccatggatgttcgaggggaggtattgagcagcagatagagacacaggcctgtggtcccaggagaaggtctgggggtcactagcccatggatggagtcacaggctgcatagattgcaggaaagcgaaggtggagagagaagagcagagtaccaggacgggccattgagcaccctggtgttgagagcaagtggcctctagtcagagttgggtcagggccactgtgagtgggctgcccccaacatgagtcggctgtctaggactagtttatctctgcttctcactttactggtattatggggcagctcctgctgtcttccaatttggtgtttgtaaaatgagacataaaaagcaggtgacaaggataccagaaagtgcacaggtctgagtggagtatggggctgtctccaggggagaggtggctgtttggagggaagggtgacaatggataatcagggtccatgggcatccctgcttgttttggagccatgggcactcaaataatgtgattttatgaggctattgaagaaaaaattggccacagggccaagagggctgggaggaccccagctctccgactggtgtttgcttctctgccatcagggtcgggaggccatgccaagcattgcgatttgcagagtccatgaaacaggaacactcccaccacagtgacctgcctctgcacacagccagaatgtagctgactcctttcttctcccacttgcatgcttccaagccttcaaaacatactcatctccatgttctgtaaattagcaattttttaaaaaataaaaaaataaacaaactcatctctgaaggtccaggtgatttttatgttttacagaaagttttgtgaagagatgacagaaagggttatatcacatccacacagcaataactcctcaaaagcaacttttggccgggcgggaggatcgcttgtgcttaggagtttgagactagcctgggcaacatagcaagtccccgtctctactta

SEQ ID NO: 463120 - DNA, 2500 bp, Homo sapiens
ttcctgtttcgtgtccgctgcgtttgggttccggtctccgcttctccagtggccccggtggctccaccgcagcgtctggcgcgctgggacctgcacaggccggagagagccgtaggcaggaccccgggacaccctggaagccaggaaatgggtagagattttgtcgtaatggataactgttctgtatcctttcatctggactttggtgattaatgctaaatcctatcagatgggactttgaaatattaaatattagtgaattaaatattagtaaagaagttgtcatggaagtaacaataataaatcatatggaagagggactcagtgaaagtaaagaatatgatcaatgtggagaagccttcagtcagattctcaatcttaatctgaacaagaaaattcctactatagtaagaccatgtgaatgtagtttgtgtgggaaagtcttcatgcatcattcatcccttagtaggcacatcagatctcaccttggacacaaaccatatgactatcaggaatatggagagaaaccatataaatgtaagcagtgtgggaaagccttcagttcttgtcaatcctttcgaagacatgaaagaactcacactggtgagaaaccctatgcatgtccggaatgtgggaaagccttcatttctctcccaagtgttcgaagacacatgattaagcacactggagatggaccatataaatgtcaggaatgtgggaaagcctttgatcgcccaagtttatttcagatacatgaaagaactcacactggagagaaaccctatgaatgtcaggaatgtgcaaaagctttcatttctcttccaagttttcaaagacacatgattaggcacactggagatggaccttataaatgtcaggaatgtggaaaagcctttgaccgccccagtttatttcgaatacatgaaagaactcatactggagagaaaccccatgaatgtaaacagtgtgggaaggccttcatttctttcacaaattttcaaagtcatatgattaggcacactggggatggaccttataaatgtaaagtatgtgggagagcctttatttttcccagttatgttcgaaagcatgaaagaactcatactggggagaaaccctatgaatgtaataaatgtggtaaaaccttcagttcttccagtaatgttcgaacacatgaaaggactcacactggagagaagccctatgaatgtaaggaatgcgggaaagccttcatttctctcccaagtgtccgaagacacatgataaagcacactggagatggaccttataaatgtcaggtatgtggtagagcctttgactgtcccagttcatttcaaatacacgaaagaactcacactggagagaaaccctatgaatgtcaggtatgtgggaaagccttcatttctcttaaaaggattagaaaacatatgatactgcacactggagatggaccttataaatgtcaggtatgtggtaaagcctttgactgtcctagttctgtccgaacacatgaaagaactcatactggagaaaaaccctatgaatgtaaagaatgtgggaaagcattcaattatgccagttccattagaatacatgaaagaactcataccggagaaaaaccctatgaatgtaagcaatgtggaaaaacgttcagttattccagttcctttcaaagacatgaaagagctcataatggagataaaccttacgtaaagaatgtgggaaagctttcatttatcacacaaccttcgaatacctgtgaaaatgaatagtggaggacaggtctacaagtatctacatatctaaagaatatggaaagtcttcagtttgctttctgggtttcagacttgtttgggagctcacccctttctcctgtttctcacttttggaataggaatctctatcctgtgcctgtctcatattttggaaatacatgactagtttggttttcaccggttcggagctgaagaagaattttgcctcagcatgaattgagtctcatccatatctgagtgatgtgatattgagatgacactttggagtttgagtttaaacattaggcttcatgctggaattaactgagacttttgaggcctttgggatgagatgaatatattttacatgtgatgacatggattttgggggccagaggtgtaatgttttggctgagtgtatgccacctcagattcatatgttgaaaccttacccccgtgccccccctctcccccacaatgtgatggtatttggaggccctgtctctggtggtttttaggattggaggacatcatgaagatggaggccttgtaattgggattagtttcctgataggaatccctagagagctagctttgcccttcaccatgagagggtgcagtgagaagatagctatctttgaaccgggaagcaggcccttaccagacatggactatgccagtgccttgatattggacttcccagcctcccaaaccatgagaaataaatgtttgttgattaattaaac

SEQ ID NO: 463121 - DNA, 2537 bp, Homo sapiens
ttcctgtttcgtgtccgctgcgtttgggttccggtctccgcttctccagtggccccggtggctccaccgcagcgtctggcgcgctgggacctgcacaggccggagagagccgtaggcaggaccccgggacaccctggaagccaggaaatggactcagtggcctctgaggatgtggctgtgaacttcacacttgaggagtgggctttgctggatccttcccagaagaaactctacagagatgtgatgcgggaaacctttagaaacctggcctgtgtaggaaaaaaatgggaagaccagagcattgaagattggtacaaaaatcaggggagaattttaagaaatcatatggaagagggactcagtgaaagtaaagaatatgatcaatgtggagaagccttcagtcagattctcaatcttaatctgaacaagaaaattcctactatagtaagaccatgtgaatgtagtttgtgtgggaaagtcttcatgcatcattcatcccttagtaggcacatcagatctcaccttggacacaaaccatatgactatcaggaatatggagagaaaccatataaatgtaagcagtgtgggaaagccttcagttcttgtcaatcctttcgaagacatgaaagaactcacactggtgagaaaccctatgcatgtccggaatgtgggaaagccttcatttctctcccaagtgttcgaagacacatgattaagcacactggagatggaccatataaatgtcaggaatgtgggaaagcctttgatcgcccaagtttatttcagatacatgaaagaactcacactggagagaaaccctatgaatgtcaggaatgtgcaaaagctttcatttctcttccaagttttcaaagacacatgattaggcacactggagatggaccttataaatgtcaggaatgtggaaaagcctttgaccgccccagtttatttcgaatacatgaaagaactcatactggagagaaaccccatgaatgtaaacagtgtgggaaggccttcatttctttcacaaattttcaaagtcatatgattaggcacactggggatggaccttataaatgtaaagtatgtgggagagcctttatttttcccagttatgttcgaaagcatgaaagaactcatactggggagaaaccctatgaatgtaataaatgtggtaaaaccttcagttcttccagtaatgttcgaacacatgaaaggactcacactggagagaagccctatgaatgtaaggaatgcgggaaagccttcatttctctcccaagtgtccgaagacacatgataaagcacactggagatggaccttataaatgtcaggtatgtggtagagcctttgactgtcccagttcatttcaaatacacgaaagaactcacactggagagaaaccctatgaatgtcaggtatgtgggaaagccttcatttctcttaaaaggattagaaaacatatgatactgcacactggagatggaccttataaatgtcaggtatgtggtaaagcctttgactgtcctagttctgtccgaacacatgaaagaactcatactggagaaaaaccctatgaatgtaaagaatgtgggaaagcattcaattatgccagttccattagaatacatgaaagaactcataccggagaaaaaccctatgaatgtaagcaatgtggaaaaacgttcagttattccagttcctttcaaagacatgaaagagctcataatggagataaaccttacgtaaagaatgtgggaaagctttcatttatcacacaaccttcgaatacctgtgaaaatgaatagtggaggacaggtctacaagtatctacatatctaaagaatatggaaagtcttcagtttgctttctgggtttcagacttgtttgggagctcacccctttctcctgtttctcacttttggaataggaatctctatcctgtgcctgtctcatattttggaaatacatgactagtttggttttcaccggttcggagctgaagaagaattttgcctcagcatgaattgagtctcatccatatctgagtgatgtgatattgagatgacactttggagtttgagtttaaacattaggcttcatgctggaattaactgagacttttgaggcctttgggatgagatgaatatattttacatgtgatgacatggattttgggggccagaggtgtaatgttttggctgagtgtatgccacctcagattcatatgttgaaaccttacccccgtgccccccctctcccccacaatgtgatggtatttggaggccctgtctctggtggtttttaggattggaggacatcatgaagatggaggccttgtaattgggattagtttcctgataggaatccctagagagctagctttgcccttcaccatgagagggtgcagtgagaagatagctatctttgaaccgggaagcaggcccttaccagacatggactatgccagtgccttgatattggacttcccagcctcccaaaccatgagaaataaatgtttgttgattaattaaac

SEQ ID NO: 463122 - DNA, 2580 bp, Homo sapiens
cagacagagtttcgctctgtcgcccaggctggagtgcagtgggaagatctcagctcactgcaaccttcgccttccgggttcaagcaattctcctgcctcagcctcctgagtaactgggattacaggcatgcgccgccacgaccggctactttttgtatttttggtagaaactgggtttctccatgttggccaggactcagtggcctctgaggatgtggctgtgaacttcacacttgaggagtgggctttgctggatccttcccagaagaaactctacagagatgtgatgcgggaaacctttagaaacctggcctgtgtaggaaaaaaatgggaagaccagagcattgaagattggtacaaaaatcaggggagaattttaagaaatcatatggaagagggactcagtgaaagtaaagaatatgatcaatgtggagaagccttcagtcagattctcaatcttaatctgaacaagaaaattcctactatagtaagaccatgtgaatgtagtttgtgtgggaaagtcttcatgcatcattcatcccttagtaggcacatcagatctcaccttggacacaaaccatatgactatcaggaatatggagagaaaccatataaatgtaagcagtgtgggaaagccttcagttcttgtcaatcctttcgaagacatgaaagaactcacactggtgagaaaccctatgcatgtccggaatgtgggaaagccttcatttctctcccaagtgttcgaagacacatgattaagcacactggagatggaccatataaatgtcaggaatgtgggaaagcctttgatcgcccaagtttatttcagatacatgaaagaactcacactggagagaaaccctatgaatgtcaggaatgtgcaaaagctttcatttctcttccaagttttcaaagacacatgattaggcacactggagatggaccttataaatgtcaggaatgtggaaaagcctttgaccgccccagtttatttcgaatacatgaaagaactcatactggagagaaaccccatgaatgtaaacagtgtgggaaggccttcatttctttcacaaattttcaaagtcatatgattaggcacactggggatggaccttataaatgtaaagtatgtgggagagcctttatttttcccagttatgttcgaaagcatgaaagaactcatactggggagaaaccctatgaatgtaataaatgtggtaaaaccttcagttcttccagtaatgttcgaacacatgaaaggactcacactggagagaagccctatgaatgtaaggaatgcgggaaagccttcatttctctcccaagtgtccgaagacacatgataaagcacactggagatggaccttataaatgtcaggtatgtggtagagcctttgactgtcccagttcatttcaaatacacgaaagaactcacactggagagaaaccctatgaatgtcaggtatgtgggaaagccttcatttctcttaaaaggattagaaaacatatgatactgcacactggagatggaccttataaatgtcaggtatgtggtaaagcctttgactgtcctagttctgtccgaacacatgaaagaactcatactggagaaaaaccctatgaatgtaaagaatgtgggaaagcattcaattatgccagttccattagaatacatgaaagaactcataccggagaaaaaccctatgaatgtaagcaatgtggaaaaacgttcagttattccagttcctttcaaagacatgaaagagctcataatggagataaaccttacgtaaagaatgtgggaaagctttcatttatcacacaaccttcgaatacctgtgaaaatgaatagtggaggacaggtctacaagtatctacatatctaaagaatatggaaagtcttcagtttgctttctgggtttcagacttgtttgggagctcacccctttctcctgtttctcacttttggaataggaatctctatcctgtgcctgtctcatattttggaaatacatgactagtttggttttcaccggttcggagctgaagaagaattttgcctcagcatgaattgagtctcatccatatctgagtgatgtgatattgagatgacactttggagtttgagtttaaacattaggcttcatgctggaattaactgagacttttgaggcctttgggatgagatgaatatattttacatgtgatgacatggattttgggggccagaggtgtaatgttttggctgagtgtatgccacctcagattcatatgttgaaaccttacccccgtgccccccctctcccccacaatgtgatggtatttggaggccctgtctctggtggtttttaggattggaggacatcatgaagatggaggccttgtaattgggattagtttcctgataggaatccctagagagctagctttgcccttcaccatgagagggtgcagtgagaagatagctatctttgaaccgggaagcaggcccttaccagacatggactatgccagtgccttgatattggacttcccagcctcccaaaccatgagaaataaatgtttgttgattaattaaac

SEQ ID NO: 463123 - DNA, 596 bp, Homo sapiens
ttcctgtttcgtgtccgctgcgtttgggttccggtctccgcttctccagtggccccggtggctccaccgcagcgtctggcgcgctgggacctgcacaggccggagagagccgtaggcaggaccccgggacaccctggaagccaggaaatggtgcgtgtgcggggccgggcgcctggagactgggggaggggcttgtgggaaccggccggaaccggctgtggaagcaccctggcctccctgcagcgactccagggtctgggacccgagttccctggcgcagctcggccctctgtcccctcggccgcagggtgggttgggccgtagccagtaccccaggcgtcctgtcccgtccctgcgcggcgactgcggcctcggcctcggagccctgtctgggcagctccgcgcccgcagccccgcctctctccagattgtttgtactgggacacgggagggtcataaggcggaatcccgtctcgggtgtgcggttcgtgcatgggaagagctgtgggctgtggccttcccagtacatcgtctttttttccgggggactggtcttcctccgagtcttccaaacgtactggaaaaagaatctcaaa

SEQ ID NO: 463124 - DNA, 2483 bp, Homo sapiens
ttcctgtttcgtgtccgctgcgtttgggttccggtctccgcttctccagtggccccggtggctccaccgcagcgtctggcgcgctgggacctgcacaggccggagagagccgtaggcaggaccccgggacaccctggaagccaggaaatggactcagtggcctctgaggatgtggctgtgaacttcacacttgaggagtgggctttgctggatccttcccagaagaaactctacagagatgtgatgcgggaaacctttagaaacctggcctgtgtaggaaaaaaatgggaagaccagagcattgaagattggtacaaaaatcaggggagaattttaagaaatcatatggaagagggactcagtgaaagtaaagaatatgatcaatgtggagaagccttcagtcagattctcaatcttaatctgaacaagaaaattcctactatagtaagaccatgtgaatgtagtttgtgtgggaaagtcttcatgcatcattcatcccttagtaggcacatcagatctcaccttggacacaaaccatatgactatcaggaatatggagagaaaccatataaatgtaagcagtgtgggaaagccttcagttcttgtcaatcctttcgaagacatgaaagaactcacactggtgagaaaccctatgcatgtccggaatgtgggaaagccttcatttctctcccaagtgttcgaagacacatgattaagcacactggagatggaccatataaatgtcaggaatgtgggaaagcctttgatcgcccaagtttatttcagatacatgaaagaactcacactggagagaaaccctatgaatgtcaggaatgtgcaaaagctttcatttctcttccaagttttcaaagacacatgattaggcacactggagatggaccttataaatgtcaggaatgtggaaaagcctttgaccgccccagtttatttcgaatacatgaaagaactcatactggagagaaaccccatgaatgtaaacagtgtgggaaggccttcatttctttcacaaattttcaaagtcatatgattaggcacactggggatggaccttataaatgtaaagtatgtgggagagcctttatttttcccagttatgttcgaaagcatgaaagaactcatactggggagaaaccctatgaatgtaataaatgtggtaaaaccttcagttcttccagtaatgttcgaacacatgaaaggactcacactggagagaagccctatgaatgtaaggaatgcgggaaagccttcatttctctcccaagtgtccgaagacacatgataaagcacactggagatggaccttataaatgtcaggtatgtggtagagcctttgactgtcccagttcatttcaaatacacgaaagaactcacactggagagaaaccctatgaatgtcaggtatgtgggaaagccttcatttctcttaaaaggattagaaaacatatgatactgcacactggagatggaccttataaatgtcaggtatgtggtaaagcctttgactgtcctagttctgtccgaacacatgaaagaactcatactggagaaaaaccctatgaatgtaaagaatgtgggaaagcattcaattatgccagttccattagaatacatgaaagaactcataccggagaaaaaccctatgaatgtaagcaatgtggaaaaacgttcagttattccagttcctttcaaagacatgaaagagctcataatggagataaaccttacgtaaagaatgtgggaaagctttcatttatcacacaaccttcgaatacctgtgaaaatcttcagtttgctttctgggtttcagacttgtttgggagctcacccctttctcctgtttctcacttttggaataggaatctctatcctgtgcctgtctcatattttggaaatacatgactagtttggttttcaccggttcggagctgaagaagaattttgcctcagcatgaattgagtctcatccatatctgagtgatgtgatattgagatgacactttggagtttgagtttaaacattaggcttcatgctggaattaactgagacttttgaggcctttgggatgagatgaatatattttacatgtgatgacatggattttgggggccagaggtgtaatgttttggctgagtgtatgccacctcagattcatatgttgaaaccttacccccgtgccccccctctcccccacaatgtgatggtatttggaggccctgtctctggtggtttttaggattggaggacatcatgaagatggaggccttgtaattgggattagtttcctgataggaatccctagagagctagctttgcccttcaccatgagagggtgcagtgagaagatagctatctttgaaccgggaagcaggcccttaccagacatggactatgccagtgccttgatattggacttcccagcctcccaaaccatgagaaataaatgtttgttgattaattaaac

SEQ ID NO: 463125 - DNA, 782 bp, Homo sapiens
tcctgtaatctgtatgattgaaggattgagaggagtattctgcatctttttaaatggcaaaataaactgttcaggtatccactgttaaggtagaggggaatgtggtgttgcaagaagaaaattgccctgctagcacagatatgagaagacaacaactcccagagcatgcagtcagcaccattactttcccttaactccccaaggtgccctccttgcatttatctttctctcctacattgatcttcactggagaataaaaattagagacagtgaggaattgcatgtgatttgtactgggttcctggatccacgccctccttcctagccctgttcctccaggctggctccactgtggccttaataaacagagggtggggggctgatgaagacatgcagagaagacttgactgcagtctgtggtgtgggctggcctgggtacaagtcagcagaggcacattccatcagttggcaatgttatgagcataataacttccttaagtgatacaggttgtagtcttgtagcctaagttctacagagcttctttaaaatgttttctaagcatgttcagcaatggcagtttactattagtaatataaatcatagaccagtcacaatgttgtttctttttaatattcccaattttcttacactaagtctctgaccaatatcaaaaaaaaagattcttcaattcatatcatcctaatctaaatgaataagtctatgaaaaatggctgtttccatattagcttctttggactactttggagcagttttggttttc

SEQ ID NO: 463126 - DNA, 1781 bp, Homo sapiens
cagaaagacaaataagatatggttttgactattgtaaagtctggattttctgattcaaaattcagtatcccagccaggcatggcgtctcatgactgctcctcattaggccacagatgcaccgcggacctgttcttccttttgggttggcaggcgcaaagccccattagcagtaatgtgcaccagtgggactccagggagaggaagaaagctgaaagggctggagttcctgctcctcaactccagccctgtgtgcaccagcaaggttcacccccaagccaccagtgccaaatggaaaaactttattgtcatgtctttgaacacttggcaggaagtaccacgggtgttccaattattaaactaataagcactcgaccttggtcagcccactttctggtgcacgtactcctaagagttggatgcagggaaaattcccgatcatgcatgaggtgcccctttgattgctatattcacgatatggggcagaatgaggatagcagtaatgactttggcagtggctctccaagattcttccgaagggctgtgcgtgcagtgacagacgtagagagagtagtactgcctttgttgcatcattccgcttgttacttaacctgtgaggacacctgccctgagcagagcattacagatgacgcacagaaaaatgccaaccctggttccactggcacaagcttcaccttcattcactggagcctcagcccatagccacccagggaggcaggcagggtggtgttaaccttcccatctcacaaatgagaaaactgaattggcatataaatgatttgtacatggttaagagttaagacttgaacccaggacttctgaccaactccagtacttttttttgcaagaatttatgttctgaaaagatctcaagctaacccacatggcctggacagcagccttttccacttgcctcctccgacctgcagtctgaattccattaccaggacagggcttgccccagggaggggacctccttctagagcattcaatgaagctgcaagattgagaggagtattctgcatctttttaaatggcaaaataaactgttcaggtatccactgttaaggtagaggggaatgtggtgttgcaagaagaaaattgccctgctagcacagatatgagaagacaacaactcccagagcatgcagtcagcaccattactttcccttaactccccaaggtgccctccttgcatttatctttctctcctacattgatcttcactggagaataaaaattagagacagtgaggaattgcatgtgatttgtactgggttcctggatccacgccctccttcctagccctgttcctccaggctggctccactgtggccttaataaacagagggtggggggctgatgaagacatgcagagaagacttgactgcagtctgtggtgtgggctggcctgggtacaagtcagcagaggcacattccatcagttggcaatgttatgagcataataacttccttaagtgatacaggttgtagtcttgtagcctaagttctacagagcttctttaaaatgttttctaagcatgttcagcaatggcagtttactattagtaatataaatcatagaccagtcacaatgttgtttctttttaatattcccaattttcttacactaagtctctgaccaatatcaaaaaaaaagattcttcaattcatatcatcctaatctaaatgaataagtctatgaaaaatggctgtttccatattagcttctttggactactttggagcagttttggttttc

SEQ ID NO: 463127 - DNA, 505 bp, Homo sapiens
atgacgcacagaaaaatgccaaccctggttccactggcacaagcttcaccttcattcactggagcctcagcccatagccacccagggaggcaggcagggtggtgttaaccttcccatctcacaaatgagaaaactgaattggcatataaatgatttgtacatggttaagagttaagacttgaacccaggacttctgaccaactccagtacttttttttgcaagaatttatgttctgaaaagatctcaagctaacccacatggtgaggattgggaagggacatcaaatttgagactacgattaactctcagtttgaagacagctttcatgacatctgggattcccaaagaaccaccagttaccaggctttctgtaagaggcctaagctgagactctcatctccagggataggctaatactaacatcatcaaaacagatatgctgtgtccttcagtttagaaaactgacttcccctgcacagtttcacattgtgctctctacctgga

SEQ ID NO: 463128 - DNA, 455 bp, Homo sapiens
cctcttagatctgtcaaataggaatggtactgtggagctgcaccagctggcgtgtagcctcaacagcctagggtgctgcctagggaatagaggggcttagaaaaagaggtgattcctctacagtgacacaccagaggcaaaaccgaggctcatttctacttgtattaatctctttttttttttcctgtaatctgtatgattgaaggattgagaggagtattctgcatctttttaaatggcaaaataaactgttcaggtatccactgttaaggtagaggggaatgtggtgttgcaagaagaaaattgccctgctagcacagatatgagaagacaacaactcccagagcatgcagtcagcaccattactttcccttaactccccaaggtgccctccttgcatttatctttctctcctacattgatcttcactggagaataaaaattagagacagtga

SEQ ID NO: 463129 - DNA, 4055 bp, Homo sapiens
cgggggcctggacaaaaagacaaatctagggctaggaaaagagggtgagggtgtcagggctgcctagaggagagtgcggtgagcgcaggctctggaggaaagcgtggacttgggagagatcatgttctccctttgctacctgcccactgcaggcaggctcaccctcacagtgattaagtgtcggaacctcaaggcgatggacatcacaggctattcagatccctatgtgaaagtgtccttgctctgtgatgggcggaggctgaagaagaagaaaacaaccataaagaaaaacactctcaatcctgtctacaatgaggccatcatctttgacattcccccggaaaacatggatcaagtcagcctgctcatctcagtcatggactatgatcgagtgggccacaatgagatcataggagtctgtcgtgtggggatcactgctgaaggcctgggcagggaccactggaacgagatgctggcatacccccggaagcccatcgcacactggcactccttggtggaggtaaagaaatccttcaaagagggaaaccctcggttgtgatttcattcacgtggatgctgcaagcagagagactgccacctggagttaggatggcagggccgagctgctagcttcgacagtgagagctcgtgcccatctccgaaaccacctccaacaccatgagatgtgcagccaaataacacaaatgggactcagcaatgttctctttgcacttgttcaaccgtctaaacagtgttgtgcagtcgcagtggcggcagcagcggcagccgtccgtcactccagagtcttacctgctcctgtgtaggtcaaagctgagacacttgtcatgtggtcagatctgtcttagtcttttgtgtctcccaaggtgatgtttttgtggtttttcactttttatgggtctgctggtaagaaaagggaaaaaaaaaaagagtaggaaaagacaaagggtggaaagcccagaagttggttctagaaaatacaaggtacagttttttggaaagaggtggattgagtttctgaaatgctgcgtctccagcaagctccacaaccctggaaaaggaggaggcgtggtgggactgcggctgcattttcagtgccctgcaggaatggggtgaatccatggaagagcctttgtgaggtgaattactagtctttgaagctcttcgctggcaggacataaaccacgctgggaccctcagtcccgtgttgaaatcacaagacctctgaggcgcttgtgagccttcagctgatgtgcagggttcctcgctccccttcctcgctggctttccccatgaattgaaaacgtcttgattcctcatgggaacttagtcactttctttaggaatgattcagttcagccgaaactaaacacgccatatgttttctgatgcgccacagttaatgatcacatttgtttgaaaacaggatctttgtcctcagaaataatcttgattgtaaagtaagagagaaacatatgttctggaatgatttctgcattatacatagctttataattccatgaagtatcaagctgctgtttaaaatgcctaaacagattaaagaaaaacctagattaaatgttcttttccaaatggggagttttgaaatccaaatagcagtttgagtccatctttctatgaagagtatgtttttgattgaaaccgagtcagcgtaagcctatttcagcccctttggctctttgacaatattcatcttaaactttagttctataaattactaagtacttcagtgttgtttgtttcagtggttgtgagggtttcttgtttcctttagatctttaccttaggccaaactcagtttaggaaaaaaaaaattgtttgaactattctgtgttgtaatagcacatttctgttgagttaatagtggtcttcccaccaacccctaaaaccaggttgatttgctcaatctcagtttgtataaccccagtaagcgcatggaggtgagtttctacttcgacttgtggcgacacagtgccagtttcctgagctgtgtgtactacttgcaagaggcaagtctgctgaagaaccccttcttttaacagtggaaaatcaagaacagaaaatctgttcacacacctgtgtcttattctttatatatgctacatggtagaggagcagcgaccaataaagtatccctcattttaaaccaagttgtcagatttctctgctgatagaacgctgcatagtatcttctagccctaaaaatgaccaggttgggcatgagttaacaggatattgtggcaaaaggaattttctgcttagaaaagtaaatgtagataaacctaaactccaccctgtactgagccttaggctagggactcatgtgtaaagatgacttttctccccagatatcttgtcattgacaggccttcctagtctggtagtcctacatttgggtgttctcctgagagtgagaaaaaacccaaggtcatgacaagattcctggcaggtgacagacttcattatgattctgactctagactgaccccatcaagatagtcgtttccgtcagtgaacagatgctgaaggccttgccattacaaaggagacaactgagttccctgggtcataaggagtccagaaattagtgtgagaaggtccttctggaagtgaactcaaaattcatgtccagctgtcatcgttaaacccttaggcaggtgagtataacccattctaacctcttggagaagggagtgtgatcaatgtgaatcacaatagtattgctcatctgagacattcctcttatatccaagcagctatctcccatgagtgaacatcccagtggtttcagaaaatcatgtcctgaacagattctagccagccccacaccaccctggccaactgcaaccgctgctgctctagcagtctgggtcaattcctacaggcttgggagcccaccccagggaggcttttatctcctgcagcctcatccccagcaccctcaaggtagactactcctcagcctgaatcatgaatgaaacctgaacatctgccaacttcattatctagcccagtatctcttccctcacagagaagaagaaaatgaaatacaaagttgatccatttgttggctttctctggccggagaaacctctcgggttgttgctgtgagctttgatgaagttgtgataaccagggccatttgcacataggtttttttaaaaaacatgaaaagttcccttctcctttatttagcagtgtttccgggctgaaagacgccctcctccccctctgcgcttacccaggacgttaattaattgcactgtcatttaaaatattatgttgttaattactcgtttgtgtcttcccacccgtgtcacagcctggagtttttattcaattaaatctctgtctcttgcccatttctcttgtcattttatgttcctggggtttagcagtcaacacacgcacaggacatctcaaagcttttcttctcaatctttgcttcacatggataaccacttcccttctatcagaggtagagcagaacggcttgtttgttttttgttctgtccaaggaatacctgtgtacctcatcaggctggaatccacctgtgttttgtcaggcttgtggctcggagatcatttggcgcacagggctccgctgttccctcagctgttcagctcaacaagcaacccctgcagatgctgaagctcccctagggaagtgggccacacacatctgggaagtacgatgctgtcacccaccagtagagaatcctgctaaccatcgtaaaacacaatttggcaaagccatgggaaaatactattgcagcctcaacatttttttttaaaaaaagaacattctaatgtaatagaatatctctctgctcgcctgcagcttttaattaatttagagagcagtccgtagagaggggagtggaagggaccgtccattcctgcacatctgcatctgaatgaggggtgctccaccgtgagaggcccagtgagctgaactgctgagagcagcactctactgcctgaagaggcagcctccccttgccagtggcttccca

SEQ ID NO: 463130 - DNA, 4034 bp, Homo sapiens
cgggggcctggacaaaaagacaaatctagggctaggaaaagagggtgagggtgtcagggctgcctagaggagagtgcggtgagcgcaggctctggaggaaagcgtggacttgggagagatcatgttctccctttgctacctgcccactgcaggcaggctcaccctcacagtgattaagtgtcggaacctcaaggcgatggacatcacaggctattcagatccctatgtgaaagtgtccttgctctgtgatgggcggaggctgaagaagaagaaaacaaccataaagaaaaacactctcaatcctgtctacaatgaggccatcatctttgacattcccccggaaaacatggatcaagtcagcctgctcatctcagtcatggactatgatcgagtgggccacaatgagatcataggagtctgtcgtgtggggatcactgctgaaggcctgggcagggaccactggaacgagatgctggcatacccccggaagcccatcgcacactggcactccttggtggagggaaaccctcggttgtgatttcattcacgtggatgctgcaagcagagagactgccacctggagttaggatggcagggccgagctgctagcttcgacagtgagagctcgtgcccatctccgaaaccacctccaacaccatgagatgtgcagccaaataacacaaatgggactcagcaatgttctctttgcacttgttcaaccgtctaaacagtgttgtgcagtcgcagtggcggcagcagcggcagccgtccgtcactccagagtcttacctgctcctgtgtaggtcaaagctgagacacttgtcatgtggtcagatctgtcttagtcttttgtgtctcccaaggtgatgtttttgtggtttttcactttttatgggtctgctggtaagaaaagggaaaaaaaaaaagagtaggaaaagacaaagggtggaaagcccagaagttggttctagaaaatacaaggtacagttttttggaaagaggtggattgagtttctgaaatgctgcgtctccagcaagctccacaaccctggaaaaggaggaggcgtggtgggactgcggctgcattttcagtgccctgcaggaatggggtgaatccatggaagagcctttgtgaggtgaattactagtctttgaagctcttcgctggcaggacataaaccacgctgggaccctcagtcccgtgttgaaatcacaagacctctgaggcgcttgtgagccttcagctgatgtgcagggttcctcgctccccttcctcgctggctttccccatgaattgaaaacgtcttgattcctcatgggaacttagtcactttctttaggaatgattcagttcagccgaaactaaacacgccatatgttttctgatgcgccacagttaatgatcacatttgtttgaaaacaggatctttgtcctcagaaataatcttgattgtaaagtaagagagaaacatatgttctggaatgatttctgcattatacatagctttataattccatgaagtatcaagctgctgtttaaaatgcctaaacagattaaagaaaaacctagattaaatgttcttttccaaatggggagttttgaaatccaaatagcagtttgagtccatctttctatgaagagtatgtttttgattgaaaccgagtcagcgtaagcctatttcagcccctttggctctttgacaatattcatcttaaactttagttctataaattactaagtacttcagtgttgtttgtttcagtggttgtgagggtttcttgtttcctttagatctttaccttaggccaaactcagtttaggaaaaaaaaaattgtttgaactattctgtgttgtaatagcacatttctgttgagttaatagtggtcttcccaccaacccctaaaaccaggttgatttgctcaatctcagtttgtataaccccagtaagcgcatggaggtgagtttctacttcgacttgtggcgacacagtgccagtttcctgagctgtgtgtactacttgcaagaggcaagtctgctgaagaaccccttcttttaacagtggaaaatcaagaacagaaaatctgttcacacacctgtgtcttattctttatatatgctacatggtagaggagcagcgaccaataaagtatccctcattttaaaccaagttgtcagatttctctgctgatagaacgctgcatagtatcttctagccctaaaaatgaccaggttgggcatgagttaacaggatattgtggcaaaaggaattttctgcttagaaaagtaaatgtagataaacctaaactccaccctgtactgagccttaggctagggactcatgtgtaaagatgacttttctccccagatatcttgtcattgacaggccttcctagtctggtagtcctacatttgggtgttctcctgagagtgagaaaaaacccaaggtcatgacaagattcctggcaggtgacagacttcattatgattctgactctagactgaccccatcaagatagtcgtttccgtcagtgaacagatgctgaaggccttgccattacaaaggagacaactgagttccctgggtcataaggagtccagaaattagtgtgagaaggtccttctggaagtgaactcaaaattcatgtccagctgtcatcgttaaacccttaggcaggtgagtataacccattctaacctcttggagaagggagtgtgatcaatgtgaatcacaatagtattgctcatctgagacattcctcttatatccaagcagctatctcccatgagtgaacatcccagtggtttcagaaaatcatgtcctgaacagattctagccagccccacaccaccctggccaactgcaaccgctgctgctctagcagtctgggtcaattcctacaggcttgggagcccaccccagggaggcttttatctcctgcagcctcatccccagcaccctcaaggtagactactcctcagcctgaatcatgaatgaaacctgaacatctgccaacttcattatctagcccagtatctcttccctcacagagaagaagaaaatgaaatacaaagttgatccatttgttggctttctctggccggagaaacctctcgggttgttgctgtgagctttgatgaagttgtgataaccagggccatttgcacataggtttttttaaaaaacatgaaaagttcccttctcctttatttagcagtgtttccgggctgaaagacgccctcctccccctctgcgcttacccaggacgttaattaattgcactgtcatttaaaatattatgttgttaattactcgtttgtgtcttcccacccgtgtcacagcctggagtttttattcaattaaatctctgtctcttgcccatttctcttgtcattttatgttcctggggtttagcagtcaacacacgcacaggacatctcaaagcttttcttctcaatctttgcttcacatggataaccacttcccttctatcagaggtagagcagaacggcttgtttgttttttgttctgtccaaggaatacctgtgtacctcatcaggctggaatccacctgtgttttgtcaggcttgtggctcggagatcatttggcgcacagggctccgctgttccctcagctgttcagctcaacaagcaacccctgcagatgctgaagctcccctagggaagtgggccacacacatctgggaagtacgatgctgtcacccaccagtagagaatcctgctaaccatcgtaaaacacaatttggcaaagccatgggaaaatactattgcagcctcaacatttttttttaaaaaaagaacattctaatgtaatagaatatctctctgctcgcctgcagcttttaattaatttagagagcagtccgtagagaggggagtggaagggaccgtccattcctgcacatctgcatctgaatgaggggtgctccaccgtgagaggcccagtgagctgaactgctgagagcagcactctactgcctgaagaggcagcctccccttgccagtggcttccca

SEQ ID NO: 463131 - DNA, 4004 bp, Homo sapiens
cgggggcctggacaaaaagacaaatctagggctaggaaaagagggtgagggtgtcagggctgcctagaggagagtgcggtgagcgcaggctctggaggaaagcgtggacttgggagagatcatgttctccctttgctacctgcccactgcaggcaggctcaccctcacagtgattaagtgtcggaacctcaaggcgatggacatcacaggctattcagatccctatgtgaaagtgtccttgctctgtgatgggcggaggctgaagaagaagaaaacaaccataaagaaaaacactctcaatcctgtctacaatgaggccatcatctttgacattcccccagtgggccacaatgagatcataggagtctgtcgtgtggggatcactgctgaaggcctgggcagggaccactggaacgagatgctggcatacccccggaagcccatcgcacactggcactccttggtggaggtaaagaaatccttcaaagagggaaaccctcggttgtgatttcattcacgtggatgctgcaagcagagagactgccacctggagttaggatggcagggccgagctgctagcttcgacagtgagagctcgtgcccatctccgaaaccacctccaacaccatgagatgtgcagccaaataacacaaatgggactcagcaatgttctctttgcacttgttcaaccgtctaaacagtgttgtgcagtcgcagtggcggcagcagcggcagccgtccgtcactccagagtcttacctgctcctgtgtaggtcaaagctgagacacttgtcatgtggtcagatctgtcttagtcttttgtgtctcccaaggtgatgtttttgtggtttttcactttttatgggtctgctggtaagaaaagggaaaaaaaaaaagagtaggaaaagacaaagggtggaaagcccagaagttggttctagaaaatacaaggtacagttttttggaaagaggtggattgagtttctgaaatgctgcgtctccagcaagctccacaaccctggaaaaggaggaggcgtggtgggactgcggctgcattttcagtgccctgcaggaatggggtgaatccatggaagagcctttgtgaggtgaattactagtctttgaagctcttcgctggcaggacataaaccacgctgggaccctcagtcccgtgttgaaatcacaagacctctgaggcgcttgtgagccttcagctgatgtgcagggttcctcgctccccttcctcgctggctttccccatgaattgaaaacgtcttgattcctcatgggaacttagtcactttctttaggaatgattcagttcagccgaaactaaacacgccatatgttttctgatgcgccacagttaatgatcacatttgtttgaaaacaggatctttgtcctcagaaataatcttgattgtaaagtaagagagaaacatatgttctggaatgatttctgcattatacatagctttataattccatgaagtatcaagctgctgtttaaaatgcctaaacagattaaagaaaaacctagattaaatgttcttttccaaatggggagttttgaaatccaaatagcagtttgagtccatctttctatgaagagtatgtttttgattgaaaccgagtcagcgtaagcctatttcagcccctttggctctttgacaatattcatcttaaactttagttctataaattactaagtacttcagtgttgtttgtttcagtggttgtgagggtttcttgtttcctttagatctttaccttaggccaaactcagtttaggaaaaaaaaaattgtttgaactattctgtgttgtaatagcacatttctgttgagttaatagtggtcttcccaccaacccctaaaaccaggttgatttgctcaatctcagtttgtataaccccagtaagcgcatggaggtgagtttctacttcgacttgtggcgacacagtgccagtttcctgagctgtgtgtactacttgcaagaggcaagtctgctgaagaaccccttcttttaacagtggaaaatcaagaacagaaaatctgttcacacacctgtgtcttattctttatatatgctacatggtagaggagcagcgaccaataaagtatccctcattttaaaccaagttgtcagatttctctgctgatagaacgctgcatagtatcttctagccctaaaaatgaccaggttgggcatgagttaacaggatattgtggcaaaaggaattttctgcttagaaaagtaaatgtagataaacctaaactccaccctgtactgagccttaggctagggactcatgtgtaaagatgacttttctccccagatatcttgtcattgacaggccttcctagtctggtagtcctacatttgggtgttctcctgagagtgagaaaaaacccaaggtcatgacaagattcctggcaggtgacagacttcattatgattctgactctagactgaccccatcaagatagtcgtttccgtcagtgaacagatgctgaaggccttgccattacaaaggagacaactgagttccctgggtcataaggagtccagaaattagtgtgagaaggtccttctggaagtgaactcaaaattcatgtccagctgtcatcgttaaacccttaggcaggtgagtataacccattctaacctcttggagaagggagtgtgatcaatgtgaatcacaatagtattgctcatctgagacattcctcttatatccaagcagctatctcccatgagtgaacatcccagtggtttcagaaaatcatgtcctgaacagattctagccagccccacaccaccctggccaactgcaaccgctgctgctctagcagtctgggtcaattcctacaggcttgggagcccaccccagggaggcttttatctcctgcagcctcatccccagcaccctcaaggtagactactcctcagcctgaatcatgaatgaaacctgaacatctgccaacttcattatctagcccagtatctcttccctcacagagaagaagaaaatgaaatacaaagttgatccatttgttggctttctctggccggagaaacctctcgggttgttgctgtgagctttgatgaagttgtgataaccagggccatttgcacataggtttttttaaaaaacatgaaaagttcccttctcctttatttagcagtgtttccgggctgaaagacgccctcctccccctctgcgcttacccaggacgttaattaattgcactgtcatttaaaatattatgttgttaattactcgtttgtgtcttcccacccgtgtcacagcctggagtttttattcaattaaatctctgtctcttgcccatttctcttgtcattttatgttcctggggtttagcagtcaacacacgcacaggacatctcaaagcttttcttctcaatctttgcttcacatggataaccacttcccttctatcagaggtagagcagaacggcttgtttgttttttgttctgtccaaggaatacctgtgtacctcatcaggctggaatccacctgtgttttgtcaggcttgtggctcggagatcatttggcgcacagggctccgctgttccctcagctgttcagctcaacaagcaacccctgcagatgctgaagctcccctagggaagtgggccacacacatctgggaagtacgatgctgtcacccaccagtagagaatcctgctaaccatcgtaaaacacaatttggcaaagccatgggaaaatactattgcagcctcaacatttttttttaaaaaaagaacattctaatgtaatagaatatctctctgctcgcctgcagcttttaattaatttagagagcagtccgtagagaggggagtggaagggaccgtccattcctgcacatctgcatctgaatgaggggtgctccaccgtgagaggcccagtgagctgaactgctgagagcagcactctactgcctgaagaggcagcctccccttgccagtggcttccca

SEQ ID NO: 463132 - DNA, 925 bp, Homo sapiens
ggagggcacaacagctgctacctgaacagtttctgacccaacagttacccagcgccggactcgctgcgccccggcggctctagggacccccggcgcctacacttagctccgcgcccgagagaatgttggaccgacgacacaagacctcagacttgtgttattctagcagctgaacacaccccaggctcttctgcccggcagtggctctggaagcagtctggtgtatagagttatggattcactaccagattctactgtatgctcttgacaactatgaccacaatggtccacccacaaatgaattatcaggagtgaacccagaggcacgtatgaatgaaaggcacataaacaaatatatccatccatccatccatgcatccatccgtacacacttctctcaaacacatccactaacaaatccatgcatacagtggaaacatacaacaaggagacagacggccggacatttgtggagtttattctgggaagcctgcgtggccatagagagtggtttttaacaggatttccaattcttctcctagtagcctttggagaaggagataggagtggacaaagatcagagaaatcccagccaaaacaaagaacagagctaataaccctggaattatttcaccccctccagagctctaccgttattcctgatccgactgacctggcgggagtcatcattgagctcggccccaatgacagtccacagacaagtgaatttaaaggagcaaccgaggaggcacctgcgaaagaaagcccacacacaagtgaatttaaaggagcagcccgggtgtcacctatcagtgaaagctattacctcattgaattaaaaagagtaatgtgtggtagagtcatcaatgatgggtgaaatttcaaaatacggagagaaagaagagaggcatatattaagattggt

SEQ ID NO: 463133 - DNA, 842 bp, Homo sapiens
atctggtacctggctttggggtgattagggagaatctggtgttgggaaaactgctgccattaatcaaatgcttgaaaagctagagggtccaggagcatttgacataaaacatggttcaattttaggagacaccctattatatagtgaaataaaaaaatcaagtagcctaaaacagaatatcaccatcttgattcctgaaactcataagacagcaactggaagttcagataatcccactaaaaagccagaagttagaactaataaaaagttacttaaaaataatgatcataaaggagttgtagtctctacaataaattttagcaccaatgtaacagctgccaaaaccaaggagatgattcttaagaagttaataagaagaactaaagatactcttggagcaccaaaaaacaaccggattctaatatttattgatgatatgaatatgccagtatcagatatgtatggagcacagccacccctggaattgataagacaattgttagatttgggaggagtttatgatactgaaaaaaatacatggaagaatattcaagatctgtctatagttgcagcttgtgttccagttgtgaatgatatcagcccacgtcttctcaaacacttttccatgctggtattacctcatccttcacaagacatcttatgtactattttccagaggagctcaacagcagatttaacatggcagaaaagagaatccacaaacttaaaaatagatctataaaatttatctacactgaacaagagaaagaaaaaaaatgaagaaaaagaacatcaaagacctaaaagacactatcaagtgtatcaaaatatgcttaatgggg

SEQ ID NO: 463134 - DNA, 1925 bp, Homo sapiens
gcatgttgctggggtttggtgtacaaatgatttcatcacccagctagtgagcatagtccccagcaggagaaaaatgaggttttatgaatcaatcataacatttttacctcaacaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggtaatggccgggtgacagaattcaagtatggtgcaaaactcggcacagttattcgcaagaactggggagaaggttggggtttcgtaccttctgacagagcgcttgtctttgtggataaccatgacaatcaacgaggacatggggctggaggagcctctattcttaccttctgggatgctaggctgtacaaaatggcagttggatttatgcttgctcatccttacggatttacacgagtaatgtcaagctaccgttggccaagacagtttcaaaatggaaacgatgttaatgattgggttgggccaccaaataataatggagtaattaaagaagttactattaatccagacactacttgtggcaatgactgcgtctgtgaacatcgatggcgccaaataaggaacatggttattttccgcaatgtagtggatggccagccttttacaaattggtatgataatgggagcaaccaagtggcttttgggagaggaaacagaggattcattgttttcaacaatgatgactggtcatttactttaactgtgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaatagccaagtgtgtttcttttcttacatgtacagcagtacttatatttcattaatttttactaaaagctctaattagtaattagaggttcaaaaaagttgatagtgtgaaacacaattccaggttacacagaagttatttattttggcaaaaggatgtctcagaaattttaaaactaggcaacaacctttactcattaagagggaagacttagctttccaaacagtctgtctcctgtctactcttttctctccttggcagtctaccaacaaggcaaaccaaatatttcattattcttctctattacatgaaaaatctgtacaagggaaagaaaaccaaattttacccttacattggtttcaaaacattcctttttccataggcaacgtttacatttttatgcctttttataatcttttatgacaaacacattttactgtttttacacacattttacacactttgcatgtaaatttatttttagttgtcttatttacatgttttaatggtaaatcttaactttgccattttagttaaaatggtaactttaatgtaaaacctgaatccaaaacaataattaaaaacataatcatttggttttcaaaagctttttgcatctctagaaagttaatatagagtcttataaaacttttagctaattcaaaaacaaatcacacatatataattgaagcaaactttgtttggtagacttcttcgaaccacagaaatttcagttatggcatggtaggtcttttgaaatgtttcattttttatatttggagatgca

SEQ ID NO: 463135 - DNA, 1955 bp, Homo sapiens
gcatgttgctggggtttggtgtacaaatgatttcatcacccagctagtgagcatagtccccagcaggagaaaaatgaggttttatgaatcaatcataacatttttacctcaacaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcgtaccttctgacagagcgcttgtctttgtggataaccatgacaatcaacgaggacatggggctggaggagcctctattcttaccttctgggatgctaggctgtacaaaatggcagttggatttatgcttgctcatccttacggatttacacgagtaatgtcaagctaccgttggccaagacagtttcaaaatggaaacgatgttaatgattgggttgggccaccaaataataatggagtaattaaagaagttactattaatccagacactacttgtggcaatgactgcgtctgtgaacatcgatggcgccaaataaggaacatggttattttccgcaatgtagtggatggccagccttttacaaattggtatgataatgggagcaaccaagtggcttttgggagaggaaacagaggattcattgttttcaacaatgatgactggtcatttactttaactgtgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaatagccaagtgtgtttcttttcttacatgtacagcagtacttatatttcattaatttttactaaaagctctaattagtaattagaggttcaaaaaagttgatagtgtgaaacacaattccaggttacacagaagttatttattttggcaaaaggatgtctcagaaattttaaaactaggcaacaacctttactcattaagagggaagacttagctttccaaacagtctgtctcctgtctactcttttctctccttggcagtctaccaacaaggcaaaccaaatatttcattattcttctctattacatgaaaaatctgtacaagggaaagaaaaccaaattttacccttacattggtttcaaaacattcctttttccataggcaacgtttacatttttatgcctttttataatcttttatgacaaacacattttactgtttttacacacattttacacactttgcatgtaaatttatttttagttgtcttatttacatgttttaatggtaaatcttaactttgccattttagttaaaatggtaactttaatgtaaaacctgaatccaaaacaataattaaaaacataatcatttggttttcaaaagctttttgcatctctagaaagttaatatagagtcttataaaacttttagctaattcaaaaacaaatcacacatatataattgaagcaaactttgtttggtagacttcttcgaaccacagaaatttcagttatggcatggtaggtcttttgaaatgtttcattttttatatttggagatgca

SEQ ID NO: 463136 - DNA, 1780 bp, Homo sapiens
tggacaccaacaaggacgacccagagctgatgctgggccgcatgcgctgcctcgaggccttgggggaatgtgcattgacaaggccagggacctgctggatgctgaattaactgcaatggcaggagagagttacagtcgggcatatggggtaagtgtcaactattctgcacattgtcatttttgaggcttatttccatacttttttcagaatgggctattgagaacttacaggctgctggaaacatgcctgttttctctgatcggcagataccctgacaccagaaggaatgatttaaattaatcctgtcttttggattgttcgtgcagtaattagtttggaatgcgatttgcttccatcaggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaagatcgatgccttccagcacatgcagcattttgtccagaccatgcagcaacaggcccagcatgccatcgctactgaggaccagcagcataagcaggaactgcacaagctcatggcccgatgcttcctgaaacttggagagtggcagctgaatctacagggcatcaatgagagcacaatccccaaagtgctgcagtactacagcgccgccacagagcacgaccgcagctggtacaaggtgatcagaagcaggccacctgtgagacccagcaccctggctggctcgtgtcctcctgtgtgctcgtggttacagctgagcttctgcggagctaggctgatgctgtgaacttactccttgagtccctggagcctatctataagaggcccagggagcctgcatttccccctacaagtttaattaatacagaaagattattggagaaatacttgttacaccattattatgtgtatgtggtgttggggattgctgctgtcttacagactctgagctgcttgttttcctgggagcatctggacacatggttaatctctggagtgacatcttcccttaggtcatctgttcttgttcagcgtttttctgatttgcatccttgcctgctcctcagctaagaacttaactttctttgtttttattggaaagatccaagtaacatcctgttatgttacaggaaacttttgaaagagataaacagaattagaaaatatataaaagatgtgattgatggaggggtgatttttggaagtgtatatctttggtgagaatatactttcttatttctttttgagaggctttctggtaactacttggtgtggcagatgtcattgacatctttccagtatttccttggcttgccaatactttgtgaattaatctctctgaaatctaaacttgtatctgaggactgcagaagcacttataatacagatcttacctttgtttaggcatgcttcattctggtttgaaaaatgtccattttgtcataagagtaatactctctctaggacagcttgcatgtccaaagctggaaaatacatcc

SEQ ID NO: 463137 - DNA, 1198 bp, Homo sapiens
ctgtccgtcgctttatatcaggaaacggttttcactattatttcttattgactgatcgctcactctgactctgtatctaaattaaccaattgtcagtagtttaggctgtgcggtctaaccctaaccaataggggaacaacacagcagcagaggccacgtgcatcaggacctcttctccttggcacaacagtgcattgacaaggccagggacctgctggatgctgaattaactgcaatggcaggagagagttacagtcgggcatatggggtaagtgtcaactattctgcacattgtcatttttgaggcttatttccatacttttttcagaatgggctattgagaacttacaggctgctggaaacatgcctgttttctctgatcggcagataccctgacaccagaaggaatgatttaaattaatcctgtcttttggattgttcgtgcagtaattagtttggaatgcgatttgcttccatcaggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaaggtctgtatcccaatgcatccagaacagaccaccttctccagaatgctcgcctaatctgcttcgctctgcctctttaaggccagaaaagaaacagtgtttaaaccacctactcacaatgtcagggagtctcttcctgttacaaagctatttggcctgatttcatagagtgaatcatagttgaggagatggtgtgtataccattgatcaaaccaatgaatgtgatcacagttatatgtatttgtatctagaaagtgctgggacatagaaagggcacactttctacccctaagagaagatggactgtttggtacaaaaaagagcagatttgtaaatacacagactagaactttca

SEQ ID NO: 463138 - DNA, 986 bp, Homo sapiens
ctgtccgtcgctttatatcaggaaacggttttcactattatttcttattgactgatcgctcactctgactctgtatctaaattaaccaattgtcagtagtttaggctgtgcggtctaaccctaaccaataggggaacaacacagcagcagaggccacgtgcatcaggacctcttctccttggcacaacagtgcattgacaaggccagggacctgctggatgctgaattaactgcaatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaaggtctgtatcccaatgcatccagaacagaccaccttctccagaatgctcgcctaatctgcttcgctctgcctctttaaggccagaaaagaaacagtgtttaaaccacctactcacaatgtcagggagtctcttcctgttacaaagctatttggcctgatttcatagagtgaatcatagttgaggagatggtgtgtataccattgatcaaaccaatgaatgtgatcacagttatatgtatttgtatctagaaagtgctgggacatagaaagggcacactttctacccctaagagaagatggactgtttggtacaaaaaagagcagatttgtaaatacacagactagaactttca

SEQ ID NO: 463139 - DNA, 1619 bp, Homo sapiens
gcaattagaaagcaatgaagatgatacatgctgtgctgtcggtcattctggcactgccgcccacctgagatgtccatcctgtgtctgagcacctttgtagttattgtgtgtggcgtggccctggtggcagtttttctctttctcttttggaagctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccggctgcagcggcaaactacagagccagcgtcatccaccaggcacacgtccttcaagcgccacctgccaaggcagatgcatgtctccagtgtagactatggcaatgagcttccaccagcagcagagcagcccaccagcattggccgcatcaagcctgagctctacaagcagaagtcggtggatggggaggatgccaagtctgaggccaccaagagctgcgggaagatcaacttcagcctacgctacgattacgagaccgagaccctgattgtgcgtatcctgaaggcttttgacctccctgccaaggacttttgtgggaagctcttgacccttatgtcaagatctacctcctgcctggaccgcaaatgcaagctgcagacccgggttgcaccgcaaggaccctggaaccccacctttgatgagaacttccacttccctgtgccctatgaggagctggctgaccgcaagctgcatctcagtgtcttcgactttgaccgcttctcccgccatgacatgattggcgaggtcatcctggacaacctctttgaggcctctgacctgtctcgggaaacctccatctggaaggatatccaatatgccacaagtgtgcaggagtttcccaagctgcagagccccacccatgctcagacagcctgtcttaccgtctgtctgagctggatgttccttctcaagtgagtcccctgccaccctccaacccacagccccaccagcaggtagagttctcaggagcaggctcatcaccctgccagtccaggtcatctgttctgactggttgttggacattattattcattttttatttcttgtcttggctatgccatgtgttttctgtgtgaccttgaaaaagtgactttccatctctgggctgcattttcctcagtattaaaccatctctagaatcctgtaattctcagcttctcccatggagaagttcttggctctcatgctttcacagaacagagctacccattctccgggagtgtggtctccacagcagaggccgaaaccccacagtgataagccactgggcagaatttccagacatccccactctttccttaaatatcaaagagtcaggcctctcttcaagcccgtggggaatgtcctctaggaggtttctgccacaggggaggccccatcaacaacccttcctcctctttttcccatgagccacattcctatgctggcactcagctccctcccttccatctcctttctga

SEQ ID NO: 463140 - DNA, 783 bp, Homo sapiens
aggcatttggaagatgaaaagcttgtcagacttttcgaagaaagtggtctttgagccgagacgggtgattctggacaaggattaagaatgtggatcaagcaggttttaaatcaagatttaacattccaacacataaaaattatttatccaacagctcctcccagatcatatactcctatgaaaggaggaatctccaatgtatggtttgacagatttaaaataaccaatgactgcccagaacaccttgaatcaattgatgtcatgtgtcaagtgcttactgatttgattgatgaagaagtaaaaagtggcatcaagaagaacaggatattaataggaggattctctatgggaggatgcatggcaatgcatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaata

SEQ ID NO: 463141 - DNA, 676 bp, Homo sapiens
aggggcggaaccgcatgactggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggttttaaatcaagatttaacattccaacacataaaaattatttatccaacagctcctcccaggaggattctctatgggaggatgcatggcaatgcatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaata

SEQ ID NO: 463142 - DNA, 584 bp, Homo sapiens
catttttaagacgtcctctatagaataaatgtaagtgacacacagttacaaattgagtgatgccaggaaccagctaagtccccaggcctggcccaccaatgtatacctcagacagcactccctctgccttttttttcccattagttattgaagccttggtaaaattggaattttcctgttctctctgatttctaagaatgatcttaaatggaatttcttaaacttttctgtctttgtatcttcttctctaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaata

SEQ ID NO: 463143 - DNA, 440 bp, Homo sapiens
agtaggtaaagaggatatgaactggcattagtagattttaatggattagatacaagtatgggatagttaatacaatatacatgagagtagttttaatatgcatttaacttataaaacttagaagaaattgaaatcatttattcaaaacactattattttggtaattaaagcatccattttcatattcccttttcctttctttttttttgggggggggcggttgttaaacagatcatatactcctatgaaaggaggaatctccaatgtatggtttgacagatttaaaataaccaatgactgcccagaacaccttgaatcaattgatgtcatgtgtcaagtgcttactgatttgattgatgaagaagtaaaaagtggcatcaagaagaacaggatattaatagataaggactccactggcactcatagtctctgggtgaaga

SEQ ID NO: 463144 - DNA, 2137 bp, Homo sapiens
aggggcggaaccgcatgactggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggttttaaatcaagatttaacattccaacacataaaaattatttatccaacagctcctcccagatcatatactcctatgaaaggaggaatctccaatgtatggtttgacagatttaaaataaccaatgactgcccagaacaccttgaatcaattgatgtcatgtgtcaagtgcttactgatttgattgatgaagaagtaaaaagtggcatcaagaagaacaggatattaataggaggattctctatgggaggatgcatggcaatgcatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaataacactttcctgacttttttattattaaaatgcttatcactgtagacagtagctaatcttattaatgaaaaacaatagacaaacatctgtgcataatttttcagacacaattctgtaaatatttggaaaccttttaagtatttaaacttttaaatttttgaaataaagtattctaaactaatataaataaggacaatgaaaaaacatgaaaggacttagcataatgttattttatcttttctacaactttgtttaaattacctttccaaagatatttgtgtttatgtaattttccacggaataacattaatactctaggtttataaaccggtttcacattatttcatttgatcatcacaagagctttgtgaagtaagccgagaagttgttactggtatttaataatagcaatagaggagttaaagactttcccacagcttgcaggtcaagacaagaaattcaggtctcctaattctcagtggagctctatttctgttaacccaaattgctgctctgttttaggtctcaatttcatctgtaaaatgatactaatagtacttatcccattggatttttgttgagatttaaataaatagccaaaagccaatacataataaacactcaataaagattaaccataaggagagtcatgatctggttccaggaatacattgttagatgactgaaaaattgtattacttcaatgaaaatactataaataataacattttcatatattagttggttctcatgcatacataatctaattttatttgatcctcacaactgtttaagttttattaaatatacattatccctatttgtataaatagaatcatacaatacctgcctgctttcattcaacaaaattatcatgagatttttccatgttgtgtacatcaatagttcatctattttattgctcagtaatattccattgtgtggatgtatcactatttgtttacacattcaccactgatatataagttgcttccagtgtgaggctgttttaaataaagctgctatgaatattcatgtaagagtctctgcatcgacctatgttatttttctttggtaaataagtaggagtagaatggctgggttatattttaggcatacttataaccttccaagaaatagccaactctttgagaaaatagttgtgccattttacattctagcagcagtgtatgagagtagtattgctccagatccttgccaacactcattatgactcctttatccattcagtcattagctattgttagtgttagtgtattttttgtgtggcc

SEQ ID NO: 463145 - DNA, 3904 bp, Homo sapiens
aggggcggaaccgcatgactggcagtggcatcagcgatggcggctgcgtcggggtcggttctgcagcgctgtatcgtgtcgccggcagggaggcatagcgcctctctgatcttcctgcatggctcaggtggatttcaattttacgtcctggttttctacagctcgggaaacatcctcccctcggttaccccagtattgcccaagtggaggtgtcgccgggcccaaatagggcccagtgggtggctcccccgtcgccagccccggctgtagatgcacgggcagcgccacctgcccccagcctcccccgttagtcttcctctttctatcgggcggtcactggtccaccaccctcgctttggggccttgtgtcccgccgctcagccagccctccatccccacaacacacctccccattcctcgccccaagtttaaacagagcaagttagtaaggtgattctggacaaggattaagaatgtggatcaagcaggttttaaatcaagatttaacattccaacacataaaaattatttatccaacagctcctcccagatcatatactcctatgaaaggaggaatctccaatgtatggtttgacagatttaaaataaccaatgactgcccagaacaccttgaatcaattgatgtcatgtgtcaagtgcttactgatttgattgatgaagaagtaaaaagtggcatcaagaagaacaggatattaatagatgtatctacatctggagttattgggggtattttgaaagagcctttcaggtggctcttgtccatggtgggctactgctacgataagaacttattatttcttgctggtatgttgaaaatcacagataacttttattcattatttacatagtgtgccttttttaaaaaatctaaactttgccagactggtaatcttctctcgggtatttgtgttctgagtccaaaataatattacctgcctattccagataaagtagtcctattttaataaatatcaagggatagtagaaagtatattaaactctattgcaaaagatccgaattccaaaattactattaatagttttatatttaaaataatatgtacctaatcttgggcctcagttccctccatgtataaaagattattgtagtaaattcaaatttatggtctcttaagagctcagctttacactttgttaagtgaaataaagcagcagacttgaaattaggagatttgaattctacttcaaagtatatttttgtatttctatgagtgtgtggctacatgatttacattctgtattttctcatggaatataatgagatgtcatttagctttctctcaagcttaggaatgtcacactgagtcactgacttgtcgtcaggcctggaatcaccattctctctgctgccgtcacctcataacagctatctccatattctgtgttggatgtgtttccttctcaaagttcccctgaacaggagggtctgtgtattttaatctgcatatatccagtgactggcatagaattggtacattaaagagacaataacagtttgactaatttttttttcaaactttggttttaaaaactacatataggcatacatgtttcatttttattatatcaccataaattagtttccaaaataatattgtaatccaaaaatgtgttaactagctcctcaaattttttttatcattcttaattcagaattcactaagcatctattatatagcaaacaccagatacataactccttatggagctcacagcttagcaagtaagacaaaaaggtgcaaattattaattgcgttgcagtgtgagggtttctgtacgtgtaaacaaaatataagtaaatattgagaatttaagtaatgcttgtaatatgactcattttgaattacgatagatattttacttggtgaacatgatatatttgtttaatcctggctccttgtagagcacagctctctttaccagtggtgacatagagggaacagggttatttatgttatcgcaggcctttgtctgtgaaacttagagtagacgaaatttctttttagcattctctttaaaggtctccagatattttaaaaatatggaaaattgttatatatcatatcctaaattattattttatgtattctactttttcttttaagtatgtttttgcttttaggaggattctctatgggaggatgcatggcaatgcatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaataacactttcctgacttttttattattaaaatgcttatcactgtagacagtagctaatcttattaatgaaaaacaatagacaaacatctgtgcataatttttcagacacaattctgtaaatatttggaaaccttttaagtatttaaacttttaaatttttgaaataaagtattctaaactaatataaataaggacaatgaaaaaacatgaaaggacttagcataatgttattttatcttttctacaactttgtttaaattacctttccaaagatatttgtgtttatgtaattttccacggaataacattaatactctaggtttataaaccggtttcacattatttcatttgatcatcacaagagctttgtgaagtaagccgagaagttgttactggtatttaataatagcaatagaggagttaaagactttcccacagcttgcaggtcaagacaagaaattcaggtctcctaattctcagtggagctctatttctgttaacccaaattgctgctctgttttaggtctcaatttcatctgtaaaatgatactaatagtacttatcccattggatttttgttgagatttaaataaatagccaaaagccaatacataataaacactcaataaagattaaccataaggagagtcatgatctggttccaggaatacattgttagatgactgaaaaattgtattacttcaatgaaaatactataaataataacattttcatatattagttggttctcatgcatacataatctaattttatttgatcctcacaactgtttaagttttattaaatatacattatccctatttgtataaatagaatcatacaatacctgcctgctttcattcaacaaaattatcatgagatttttccatgttgtgtacatcaatagttcatctattttattgctcagtaatattccattgtgtggatgtatcactatttgtttacacattcaccactgatatataagttgcttccagtgtgaggctgttttaaataaagctgctatgaatattcatgtaagagtctctgcatcgacctatgttatttttctttggtaaataagtaggagtagaatggctgggttatattttaggcatacttataaccttccaagaaatagccaactctttgagaaaatagttgtgccattttacattctagcagcagtgtatgagagtagtattgctccagatccttgccaacactcattatgactcctttatccattcagtcattagctattgttagtgttagtgtattttttgtgtggcc

SEQ ID NO: 463146 - DNA, 846 bp, Homo sapiens
aggggcggaaccgcatgactggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggttttaaatcaagatttaacattccaacacataaaaattatttatccaacagctcctcccagatcatatactcctatgaaaggaggaatctccaatgtatggtttgacagatttaaaataaccaatgactgcccagaacaccttgaatcaattgatgtcatgtgtcaagtgcttactgatttgattgatgaagaagtaaaaagtggcatcaagaagaacaggatattaataggaggattctctatgggaggatgcatggcaatgcatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaata

SEQ ID NO: 463147 - DNA, 2074 bp, Homo sapiens
aggcatttggaagatgaaaagcttgtcagacttttcgaagaaagtggtctttgagccgagacgggtgattctggacaaggattaagaatgtggatcaagcaggttttaaatcaagatttaacattccaacacataaaaattatttatccaacagctcctcccagatcatatactcctatgaaaggaggaatctccaatgtatggtttgacagatttaaaataaccaatgactgcccagaacaccttgaatcaattgatgtcatgtgtcaagtgcttactgatttgattgatgaagaagtaaaaagtggcatcaagaagaacaggatattaataggaggattctctatgggaggatgcatggcaatgcatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaataacactttcctgacttttttattattaaaatgcttatcactgtagacagtagctaatcttattaatgaaaaacaatagacaaacatctgtgcataatttttcagacacaattctgtaaatatttggaaaccttttaagtatttaaacttttaaatttttgaaataaagtattctaaactaatataaataaggacaatgaaaaaacatgaaaggacttagcataatgttattttatcttttctacaactttgtttaaattacctttccaaagatatttgtgtttatgtaattttccacggaataacattaatactctaggtttataaaccggtttcacattatttcatttgatcatcacaagagctttgtgaagtaagccgagaagttgttactggtatttaataatagcaatagaggagttaaagactttcccacagcttgcaggtcaagacaagaaattcaggtctcctaattctcagtggagctctatttctgttaacccaaattgctgctctgttttaggtctcaatttcatctgtaaaatgatactaatagtacttatcccattggatttttgttgagatttaaataaatagccaaaagccaatacataataaacactcaataaagattaaccataaggagagtcatgatctggttccaggaatacattgttagatgactgaaaaattgtattacttcaatgaaaatactataaataataacattttcatatattagttggttctcatgcatacataatctaattttatttgatcctcacaactgtttaagttttattaaatatacattatccctatttgtataaatagaatcatacaatacctgcctgctttcattcaacaaaattatcatgagatttttccatgttgtgtacatcaatagttcatctattttattgctcagtaatattccattgtgtggatgtatcactatttgtttacacattcaccactgatatataagttgcttccagtgtgaggctgttttaaataaagctgctatgaatattcatgtaagagtctctgcatcgacctatgttatttttctttggtaaataagtaggagtagaatggctgggttatattttaggcatacttataaccttccaagaaatagccaactctttgagaaaatagttgtgccattttacattctagcagcagtgtatgagagtagtattgctccagatccttgccaacactcattatgactcctttatccattcagtcattagctattgttagtgttagtgtattttttgtgtggcc

SEQ ID NO: 463148 - DNA, 2015 bp, Homo sapiens
aaaatgaggccagacaggttcagcagcttggccaaggtctcttagctgttactgtgattctggacaaggattaagaatgtggatcaagcaggttttaaatcaagatttaacattccaacacataaaaattatttatccaacagctcctcccagatttaaaataaccaatgactgcccagaacaccttgaatcaattgatgtcatgtgtcaagtgcttactgatttgattgatgaagaagtaaaaagtggcatcaagaagaacaggatattaataggaggattctctatgggaggatgcatggcaatgcatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaataacactttcctgacttttttattattaaaatgcttatcactgtagacagtagctaatcttattaatgaaaaacaatagacaaacatctgtgcataatttttcagacacaattctgtaaatatttggaaaccttttaagtatttaaacttttaaatttttgaaataaagtattctaaactaatataaataaggacaatgaaaaaacatgaaaggacttagcataatgttattttatcttttctacaactttgtttaaattacctttccaaagatatttgtgtttatgtaattttccacggaataacattaatactctaggtttataaaccggtttcacattatttcatttgatcatcacaagagctttgtgaagtaagccgagaagttgttactggtatttaataatagcaatagaggagttaaagactttcccacagcttgcaggtcaagacaagaaattcaggtctcctaattctcagtggagctctatttctgttaacccaaattgctgctctgttttaggtctcaatttcatctgtaaaatgatactaatagtacttatcccattggatttttgttgagatttaaataaatagccaaaagccaatacataataaacactcaataaagattaaccataaggagagtcatgatctggttccaggaatacattgttagatgactgaaaaattgtattacttcaatgaaaatactataaataataacattttcatatattagttggttctcatgcatacataatctaattttatttgatcctcacaactgtttaagttttattaaatatacattatccctatttgtataaatagaatcatacaatacctgcctgctttcattcaacaaaattatcatgagatttttccatgttgtgtacatcaatagttcatctattttattgctcagtaatattccattgtgtggatgtatcactatttgtttacacattcaccactgatatataagttgcttccagtgtgaggctgttttaaataaagctgctatgaatattcatgtaagagtctctgcatcgacctatgttatttttctttggtaaataagtaggagtagaatggctgggttatattttaggcatacttataaccttccaagaaatagccaactctttgagaaaatagttgtgccattttacattctagcagcagtgtatgagagtagtattgctccagatccttgccaacactcattatgactcctttatccattcagtcattagctattgttagtgttagtgtattttttgtgtggcc

SEQ ID NO: 463149 - DNA, 1965 bp, Homo sapiens
taaatttaacattcacttaaatatctattgctgtttcttttgggttcttccagaataattttttcttattctttaccttaatttttaagggtattcaagaagatctccatgtttataaaatctaagttaaccatttctccccttttcattctgatgtataagtttacagcccagaaataggttgctaaagctatgttttaatattacgtgaatgcacaaaagatggaggattctctatgggaggatgcatggcaatgcatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaataacactttcctgacttttttattattaaaatgcttatcactgtagacagtagctaatcttattaatgaaaaacaatagacaaacatctgtgcataatttttcagacacaattctgtaaatatttggaaaccttttaagtatttaaacttttaaatttttgaaataaagtattctaaactaatataaataaggacaatgaaaaaacatgaaaggacttagcataatgttattttatcttttctacaactttgtttaaattacctttccaaagatatttgtgtttatgtaattttccacggaataacattaatactctaggtttataaaccggtttcacattatttcatttgatcatcacaagagctttgtgaagtaagccgagaagttgttactggtatttaataatagcaatagaggagttaaagactttcccacagcttgcaggtcaagacaagaaattcaggtctcctaattctcagtggagctctatttctgttaacccaaattgctgctctgttttaggtctcaatttcatctgtaaaatgatactaatagtacttatcccattggatttttgttgagatttaaataaatagccaaaagccaatacataataaacactcaataaagattaaccataaggagagtcatgatctggttccaggaatacattgttagatgactgaaaaattgtattacttcaatgaaaatactataaataataacattttcatatattagttggttctcatgcatacataatctaattttatttgatcctcacaactgtttaagttttattaaatatacattatccctatttgtataaatagaatcatacaatacctgcctgctttcattcaacaaaattatcatgagatttttccatgttgtgtacatcaatagttcatctattttattgctcagtaatattccattgtgtggatgtatcactatttgtttacacattcaccactgatatataagttgcttccagtgtgaggctgttttaaataaagctgctatgaatattcatgtaagagtctctgcatcgacctatgttatttttctttggtaaataagtaggagtagaatggctgggttatattttaggcatacttataaccttccaagaaatagccaactctttgagaaaatagttgtgccattttacattctagcagcagtgtatgagagtagtattgctccagatccttgccaacactcattatgactcctttatccattcagtcattagctattgttagtgttagtgtattttttgtgtggcc

SEQ ID NO: 463150 - DNA, 1875 bp, Homo sapiens
catttttaagacgtcctctatagaataaatgtaagtgacacacagttacaaattgagtgatgccaggaaccagctaagtccccaggcctggcccaccaatgtatacctcagacagcactccctctgccttttttttcccattagttattgaagccttggtaaaattggaattttcctgttctctctgatttctaagaatgatcttaaatggaatttcttaaacttttctgtctttgtatcttcttctctaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaataacactttcctgacttttttattattaaaatgcttatcactgtagacagtagctaatcttattaatgaaaaacaatagacaaacatctgtgcataatttttcagacacaattctgtaaatatttggaaaccttttaagtatttaaacttttaaatttttgaaataaagtattctaaactaatataaataaggacaatgaaaaaacatgaaaggacttagcataatgttattttatcttttctacaactttgtttaaattacctttccaaagatatttgtgtttatgtaattttccacggaataacattaatactctaggtttataaaccggtttcacattatttcatttgatcatcacaagagctttgtgaagtaagccgagaagttgttactggtatttaataatagcaatagaggagttaaagactttcccacagcttgcaggtcaagacaagaaattcaggtctcctaattctcagtggagctctatttctgttaacccaaattgctgctctgttttaggtctcaatttcatctgtaaaatgatactaatagtacttatcccattggatttttgttgagatttaaataaatagccaaaagccaatacataataaacactcaataaagattaaccataaggagagtcatgatctggttccaggaatacattgttagatgactgaaaaattgtattacttcaatgaaaatactataaataataacattttcatatattagttggttctcatgcatacataatctaattttatttgatcctcacaactgtttaagttttattaaatatacattatccctatttgtataaatagaatcatacaatacctgcctgctttcattcaacaaaattatcatgagatttttccatgttgtgtacatcaatagttcatctattttattgctcagtaatattccattgtgtggatgtatcactatttgtttacacattcaccactgatatataagttgcttccagtgtgaggctgttttaaataaagctgctatgaatattcatgtaagagtctctgcatcgacctatgttatttttctttggtaaataagtaggagtagaatggctgggttatattttaggcatacttataaccttccaagaaatagccaactctttgagaaaatagttgtgccattttacattctagcagcagtgtatgagagtagtattgctccagatccttgccaacactcattatgactcctttatccattcagtcattagctattgttagtgttagtgtattttttgtgtggcc

SEQ ID NO: 463151 - DNA, 2290 bp, Homo sapiens
aggggcggaaccgcatgactggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggttttaaatcaagatttaacattccaacacataaaaattatttatccaacagctcctcccagatcatatactcctatgaaaggaggaatctccaatgtatggtttgacagatttaaaataaccaatgactgcccagaacaccttgaatcaattgatgtcatgtgtcaagtgcttactgatttgattgatgaagaagtaaaaagtggcatcaagaagaacaggatattaatagatgtatctacatctggagttattgggggtattttgaaagagcctttcaggtggctcttgtccatggtgggctactgctacgataagaacttattatttcttgctggtatgttgaaaatcacagataacttttattcattatttacatagtgtgccttttttaaaaaatctaaactttgccagactggtaatcttctctcgggtatttgtgttctgagtccaaaataatattacctgcctattccagataaagtagtcctattttaataaatatcaagggatagtagaaagtatattaaactctattgcaaaagatccgaattccaaaattactattaatagttttatatttaaaataatatgtacctaatcttgggcctcagttccctccatgtataaaagattattgtagtaaattcaaatttatggtctcttaagagctcagctttacactttgttaagtgaaataaagcagcagacttgaaattaggagatttgaattctacttcaaagtatatttttgtatttctatgagtgtgtggctacatgatttacattctgtattttctcatggaatataatgagatgtcatttagctttctctcaagcttaggaatgtcacactgagtcactgacttgtcgtcaggcctggaatcaccattctctctgctgccgtcacctcataacagctatctccatattctgtgttggatgtgtttccttctcaaagttcccctgaacaggagggtctgtgtattttaatctgcatatatccagtgactggcatagaattggtacattaaagagacaataacagtttgactaatttttttttcaaactttggttttaaaaactacatataggcatacatgtttcatttttattatatcaccataaattagtttccaaaataatattgtaatccaaaaatgtgttaactagctcctcaaattttttttatcattcttaattcagaattcactaagcatctattatatagcaaacaccagatacataactccttatggagctcacagcttagcaagtaagacaaaaaggtgcaaattattaattgcgttgcagtgtgagggtttctgtacgtgtaaacaaaatataagtaaatattgagaatttaagtaatgcttgtaatatgactcattttgaattacgatagatattttacttggtgaacatgatatatttgtttaatcctggctccttgtagagcacagctctctttaccagtggtgacatagagggaacagggttatttatgttatcgcaggcctttgtctgtgaaacttagagtagacgaaatttctttttagcattctctttaaaggtctccagatattttaaaaatatggaaaattgttatatatcatatcctaaattattattttatgtattctactttttcttttaagtatgtttttgcttttaggaggattctctatgggaggatgcatggcaatgcatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaata

SEQ ID NO: 463152 - DNA, 3459 bp, Homo sapiens
aggcatttggaagatgaaaagcttgtcagacttttcgaagaaagtggtctttgagccgagacgggtaggcttaaatgggacggtgattggaagggaattggaaagatcatatactcctatgaaaggaggaatctccaatgtatggtttgacagatttaaaataaccaatgactgcccagaacaccttgaatcaattgatgtcatgtgtcaagtgcttactgatttgattgatgaagaagtaaaaagtggcatcaagaagaacaggatattaatagatgtatctacatctggagttattgggggtattttgaaagagcctttcaggtggctcttgtccatggtgggctactgctacgataagaacttattatttcttgctggtatgttgaaaatcacagataacttttattcattatttacatagtgtgccttttttaaaaaatctaaactttgccagactggtaatcttctctcgggtatttgtgttctgagtccaaaataatattacctgcctattccagataaagtagtcctattttaataaatatcaagggatagtagaaagtatattaaactctattgcaaaagatccgaattccaaaattactattaatagttttatatttaaaataatatgtacctaatcttgggcctcagttccctccatgtataaaagattattgtagtaaattcaaatttatggtctcttaagagctcagctttacactttgttaagtgaaataaagcagcagacttgaaattaggagatttgaattctacttcaaagtatatttttgtatttctatgagtgtgtggctacatgatttacattctgtattttctcatggaatataatgagatgtcatttagctttctctcaagcttaggaatgtcacactgagtcactgacttgtcgtcaggcctggaatcaccattctctctgctgccgtcacctcataacagctatctccatattctgtgttggatgtgtttccttctcaaagttcccctgaacaggagggtctgtgtattttaatctgcatatatccagtgactggcatagaattggtacattaaagagacaataacagtttgactaatttttttttcaaactttggttttaaaaactacatataggcatacatgtttcatttttattatatcaccataaattagtttccaaaataatattgtaatccaaaaatgtgttaactagctcctcaaattttttttatcattcttaattcagaattcactaagcatctattatatagcaaacaccagatacataactccttatggagctcacagcttagcaagtaagacaaaaaggtgcaaattattaattgcgttgcagtgtgagggtttctgtacgtgtaaacaaaatataagtaaatattgagaatttaagtaatgcttgtaatatgactcattttgaattacgatagatattttacttggtgaacatgatatatttgtttaatcctggctccttgtagagcacagctctctttaccagtggtgacatagagggaacagggttatttatgttatcgcaggcctttgtctgtgaaacttagagtagacgaaatttctttttagcattctctttaaaggtctccagatattttaaaaatatggaaaattgttatatatcatatcctaaattattattttatgtattctactttttcttttaagtatgtttttgcttttaggaggattctctatgggaggatgcatggcaatgcatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaataacactttcctgacttttttattattaaaatgcttatcactgtagacagtagctaatcttattaatgaaaaacaatagacaaacatctgtgcataatttttcagacacaattctgtaaatatttggaaaccttttaagtatttaaacttttaaatttttgaaataaagtattctaaactaatataaataaggacaatgaaaaaacatgaaaggacttagcataatgttattttatcttttctacaactttgtttaaattacctttccaaagatatttgtgtttatgtaattttccacggaataacattaatactctaggtttataaaccggtttcacattatttcatttgatcatcacaagagctttgtgaagtaagccgagaagttgttactggtatttaataatagcaatagaggagttaaagactttcccacagcttgcaggtcaagacaagaaattcaggtctcctaattctcagtggagctctatttctgttaacccaaattgctgctctgttttaggtctcaatttcatctgtaaaatgatactaatagtacttatcccattggatttttgttgagatttaaataaatagccaaaagccaatacataataaacactcaataaagattaaccataaggagagtcatgatctggttccaggaatacattgttagatgactgaaaaattgtattacttcaatgaaaatactataaataataacattttcatatattagttggttctcatgcatacataatctaattttatttgatcctcacaactgtttaagttttattaaatatacattatccctatttgtataaatagaatcatacaatacctgcctgctttcattcaacaaaattatcatgagatttttccatgttgtgtacatcaatagttcatctattttattgctcagtaatattccattgtgtggatgtatcactatttgtttacacattcaccactgatatataagttgcttccagtgtgaggctgttttaaataaagctgctatgaatattcatgtaagagtctctgcatcgacctatgttatttttctttggtaaataagtaggagtagaatggctgggttatattttaggcatacttataaccttccaagaaatagccaactctttgagaaaatagttgtgccattttacattctagcagcagtgtatgagagtagtattgctccagatccttgccaacactcattatgactcctttatccattcagtcattagctattgttagtgttagtgtattttttgtgtggcc

SEQ ID NO: 463153 - DNA, 798 bp, Homo sapiens
aggggcggaaccgcatgactggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggttttaaatcaagatttaacattccaacacataaaaattatttatccaacagctcctcccagatttaaaataaccaatgactgcccagaacaccttgaatcaattgatgtcatgtgtcaagtgcttactgatttgattgatgaagaagtaaaaagtggcatcaagaagaacaggatattaataggaggattctctatgggaggatgcatggcaatgcatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaata

SEQ ID NO: 463154 - DNA, 1967 bp, Homo sapiens
aggggcggaaccgcatgactggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggttttaaatcaagatttaacattccaacacataaaaattatttatccaacagctcctcccaggaggattctctatgggaggatgcatggcaatgcatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaataacactttcctgacttttttattattaaaatgcttatcactgtagacagtagctaatcttattaatgaaaaacaatagacaaacatctgtgcataatttttcagacacaattctgtaaatatttggaaaccttttaagtatttaaacttttaaatttttgaaataaagtattctaaactaatataaataaggacaatgaaaaaacatgaaaggacttagcataatgttattttatcttttctacaactttgtttaaattacctttccaaagatatttgtgtttatgtaattttccacggaataacattaatactctaggtttataaaccggtttcacattatttcatttgatcatcacaagagctttgtgaagtaagccgagaagttgttactggtatttaataatagcaatagaggagttaaagactttcccacagcttgcaggtcaagacaagaaattcaggtctcctaattctcagtggagctctatttctgttaacccaaattgctgctctgttttaggtctcaatttcatctgtaaaatgatactaatagtacttatcccattggatttttgttgagatttaaataaatagccaaaagccaatacataataaacactcaataaagattaaccataaggagagtcatgatctggttccaggaatacattgttagatgactgaaaaattgtattacttcaatgaaaatactataaataataacattttcatatattagttggttctcatgcatacataatctaattttatttgatcctcacaactgtttaagttttattaaatatacattatccctatttgtataaatagaatcatacaatacctgcctgctttcattcaacaaaattatcatgagatttttccatgttgtgtacatcaatagttcatctattttattgctcagtaatattccattgtgtggatgtatcactatttgtttacacattcaccactgatatataagttgcttccagtgtgaggctgttttaaataaagctgctatgaatattcatgtaagagtctctgcatcgacctatgttatttttctttggtaaataagtaggagtagaatggctgggttatattttaggcatacttataaccttccaagaaatagccaactctttgagaaaatagttgtgccattttacattctagcagcagtgtatgagagtagtattgctccagatccttgccaacactcattatgactcctttatccattcagtcattagctattgttagtgttagtgtattttttgtgtggcc

SEQ ID NO: 463155 - DNA, 2460 bp, Homo sapiens
aggggcggaaccgcatgactggcagtggcatcagcgatggcggctgcgtcggggtcggttctgcagcgctgtatcgtgtcgccggcagggaggcatagcgcctctctgatcttcctgcatggctcaggtggatttcaattttacgtcctggttttctacagctcgggaaacatcctcccctcggttaccccagtattgcccaagtggaggtgtcgccgggcccaaatagggcccagtgggtggctcccccgtcgccagccccggctgtagatgcacgggcagcgccacctgcccccagcctcccccgttagtcttcctctttctatcgggcggtcactggtccaccaccctcgctttggggccttgtgtcccgccgctcagccagccctccatccccacaacacacctccccattcctcgccccaagtttaaacagagcaagttagtaaggtgattctggacaaggattaagaatgtggatcaagcaggttttaaatcaagatttaacattccaacacataaaaattatttatccaacagctcctcccagatcatatactcctatgaaaggaggaatctccaatgtatggtttgacagatttaaaataaccaatgactgcccagaacaccttgaatcaattgatgtcatgtgtcaagtgcttactgatttgattgatgaagaagtaaaaagtggcatcaagaagaacaggatattaataggaggattctctatgggaggatgcatggcaatgcatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaataacactttcctgacttttttattattaaaatgcttatcactgtagacagtagctaatcttattaatgaaaaacaatagacaaacatctgtgcataatttttcagacacaattctgtaaatatttggaaaccttttaagtatttaaacttttaaatttttgaaataaagtattctaaactaatataaataaggacaatgaaaaaacatgaaaggacttagcataatgttattttatcttttctacaactttgtttaaattacctttccaaagatatttgtgtttatgtaattttccacggaataacattaatactctaggtttataaaccggtttcacattatttcatttgatcatcacaagagctttgtgaagtaagccgagaagttgttactggtatttaataatagcaatagaggagttaaagactttcccacagcttgcaggtcaagacaagaaattcaggtctcctaattctcagtggagctctatttctgttaacccaaattgctgctctgttttaggtctcaatttcatctgtaaaatgatactaatagtacttatcccattggatttttgttgagatttaaataaatagccaaaagccaatacataataaacactcaataaagattaaccataaggagagtcatgatctggttccaggaatacattgttagatgactgaaaaattgtattacttcaatgaaaatactataaataataacattttcatatattagttggttctcatgcatacataatctaattttatttgatcctcacaactgtttaagttttattaaatatacattatccctatttgtataaatagaatcatacaatacctgcctgctttcattcaacaaaattatcatgagatttttccatgttgtgtacatcaatagttcatctattttattgctcagtaatattccattgtgtggatgtatcactatttgtttacacattcaccactgatatataagttgcttccagtgtgaggctgttttaaataaagctgctatgaatattcatgtaagagtctctgcatcgacctatgttatttttctttggtaaataagtaggagtagaatggctgggttatattttaggcatacttataaccttccaagaaatagccaactctttgagaaaatagttgtgccattttacattctagcagcagtgtatgagagtagtattgctccagatccttgccaacactcattatgactcctttatccattcagtcattagctattgttagtgttagtgtattttttgtgtggcc

SEQ ID NO: 463156 - DNA, 2164 bp, Homo sapiens
aggggcggaaccgcatgactggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggttttaaatcaagatttaacattccaacacataaaaattatttatccaacagctcctcccagttacactgttggaccaagttttgccagatcatatactcctatgaaaggaggaatctccaatgtatggtttgacagatttaaaataaccaatgactgcccagaacaccttgaatcaattgatgtcatgtgtcaagtgcttactgatttgattgatgaagaagtaaaaagtggcatcaagaagaacaggatattaataggaggattctctatgggaggatgcatggcaatgcatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaataacactttcctgacttttttattattaaaatgcttatcactgtagacagtagctaatcttattaatgaaaaacaatagacaaacatctgtgcataatttttcagacacaattctgtaaatatttggaaaccttttaagtatttaaacttttaaatttttgaaataaagtattctaaactaatataaataaggacaatgaaaaaacatgaaaggacttagcataatgttattttatcttttctacaactttgtttaaattacctttccaaagatatttgtgtttatgtaattttccacggaataacattaatactctaggtttataaaccggtttcacattatttcatttgatcatcacaagagctttgtgaagtaagccgagaagttgttactggtatttaataatagcaatagaggagttaaagactttcccacagcttgcaggtcaagacaagaaattcaggtctcctaattctcagtggagctctatttctgttaacccaaattgctgctctgttttaggtctcaatttcatctgtaaaatgatactaatagtacttatcccattggatttttgttgagatttaaataaatagccaaaagccaatacataataaacactcaataaagattaaccataaggagagtcatgatctggttccaggaatacattgttagatgactgaaaaattgtattacttcaatgaaaatactataaataataacattttcatatattagttggttctcatgcatacataatctaattttatttgatcctcacaactgtttaagttttattaaatatacattatccctatttgtataaatagaatcatacaatacctgcctgctttcattcaacaaaattatcatgagatttttccatgttgtgtacatcaatagttcatctattttattgctcagtaatattccattgtgtggatgtatcactatttgtttacacattcaccactgatatataagttgcttccagtgtgaggctgttttaaataaagctgctatgaatattcatgtaagagtctctgcatcgacctatgttatttttctttggtaaataagtaggagtagaatggctgggttatattttaggcatacttataaccttccaagaaatagccaactctttgagaaaatagttgtgccattttacattctagcagcagtgtatgagagtagtattgctccagatccttgccaacactcattatgactcctttatccattcagtcattagctattgttagtgttagtgtattttttgtgtggcc

SEQ ID NO: 463157 - DNA, 3206 bp, Homo sapiens
aagctcatccccatggctttgtagacaaaactcccacatccccctggttccccaccaaccatcccacccctgaataaacaacagctcatttgtaagagattttaatttcatcttggtatgccattaaggagtggaataaggatctctattcattttcactcacatagtatctcctacattctccaactggtctttaccacagaaacctgtggggccatacagcatctgcataattttcactcatcagactggtttggagtgatagggacgtgtctctgtgttcaagtctccaatgatgtccccagaaatgaggccaagcctatcctggcccctcctggatgggtccacagtgacccgctgtcttccccaccaactcattctgggttcccaggagacttcctagcacagaacaataccatcctagcaccgcaactggagaccagggtgtggaactgtccccatgtacaatggctgctgggtcttctgtgccgaggatcagaggagtaaacgtttgcttaattaaggccttctgtagcactgatactgctgatctctggcatgaagcgcaagacttgcaattcaatgacaacaaacaggtctacaaggagagcacaacttcccatttaaaaccaacaaacaagaagctttgaaaacaagataaatggaagtgtcaataatgaatatgcatgaaggtctttctcctgtagtcattggttaggcgattctggcagtattttgtagggcacattattctgctttggaacttcggaatgggtgttgtaaaagtcaagtcagcatgtatgagaacaccaatctataagagtgttcaacaaaggaaggcattgttattttactatcattatttttactactttatgttattttggaaagagccaagtcaccgaggtgtcttctattaaatcaattagcctggaaggagaactaagcaagatgagaaactgaacgtatctgtgactctgcaagcagtccctgacgctgtggtgggatccaggcctggacgctgtggataaggtcagtgccatccccaatcagcagttctaagcctgcagctcaggagccctcaaccctctcacaagttcctcgtggctcagtcttcccttgaaggccttatttctccagtgggtgtggtctaggcttcactgagtccagatatgtcatccaaagagctgggtagtgggaggcctctggtaggaacagcctggattccagccagaactgcctgggaggaggcaccagcttaccagagctcagcctctgggtgttctgctgatcttgctgctgctgctgctgtcgcctggccagcttcttcatctgataaggagaggaccataggattagaagtcaggtggcctgcagcatgttcacaaagtaagggggggcctggaagtgacaccttccccgggagagggcttgttggcaaagctctggctcttacttagtaaaggagcaacagtggccagccccatatgcgagaagcattgcagctgagagctcttccactctgcagcagtataaagacagctggctgggaagcaggggtgcagcttgtcttagcaggaatagggattttttcctcagtaaataaaacttgctgcttgtggtgtgaccattttacattaggtaataagtgtgtgactgtgaaatctgcagcccagcctagacgtatggaacaagaggttgtgatttgggggcttggaggatacttcaaatgaggccttgaatgctcgcctctgttgagttgtcaagatggttctcggacgtttggggcgcttatggtccttgccttcctcagcagttcctttccctgccccatgggctgacttgcagagactttcttcatcatcacttttacctgaaagaagcaaaagacaatgtttgtgaaaatgtactaatacaggcaagttacttaactctctacaactaaatgtactcttctgcaaaatagtgatatatgagaggatctacttcattggggttgctgtgaggattaaatgagtttataccagtacggcactgagtgccctaaatgccaatgagccttgactgttgatgattaatattatttcttagatgtcatttttcaagactagacctagacactatgtctgaaactctagttactgccaagtggtagaaaatattattgttaaaaaggccatagagaaaagcattagattacctgccagtacagataactcagaatggacaggtaacactgataactagtcaacattgcttttctgtaaagtaaataactctctactgttaaagtaattgtctaactatttgaaatacttcaactctataagcagtgaacaacatgagggttaactctgaaaggaaataaaatctctactctgactctggaggcaggaaacactgctgatggttagcatggtttgatatgttctctcccacagtcaataacatatatgcatttaataagaaatgccactacccaacagtcaccaatgtggaattttgggcatcctggcacatctgagccagaaagattctgaagatggaggaacagaggaaccttttggcacctctcaaagtacagatagatgccacaagccagctgccaacaggaatccagaccctggctaaccatcacccagcttccatctactgtgttcaggggcagacctgcctgacttggatatcagcttctccatgaaaatatgcagtgcctaaaatttacactgatcgatttgttcacgagaaaggacatttctaaaagagccaggagactgcccccagaaccaagaggagtactggagagcagaagatgaagaaaaacctttaaacagcagagcagtgaagtggagggagaggcggcccctctcctttgccagagactcccactcccagatgcaggctggagcgatccctcataatttaagctgacacccctcagcggagatgaaaggaacaccactcgctgctctccaacaacaaatgtcagcatccctggaggccgtttagacacaaacgcagcataaatctgactcctagtggggaagtccagagattaagtctccacacacagcctaccagagtgaaatgaatttgcttggcacaaagtttgaacatgtttctcagggcctttctttcccctttcttgtaaaaaaaaaatctggaatggttcagggctgttttcccccttgctgttccttccactc

SEQ ID NO: 463158 - DNA, 1051 bp, Homo sapiens
acaacagacgctccccttgccctttatgatgtttacatgggcggagggatccctcccagctgacagccacaccgcgccggcccttctttttttaaagagcctagccacgggcgctgactggccggcagccgggcgcgtcatcctccgggggcggggcccgggccgcattgtctcgtctagggccggctggacgccccagaggccggacctgggcaaccccagcctggaggtgccggggccggagctcccagagggctgggtgcgaggcctaggcggggtcaggttcgggttcctaggccatagcggagctgcagcccaggcggccggagcggaacccagccccgctccgagtgccacgtctccaggaaccccctccttactcttggacaacactccgcccccgcccgggcctccgtcccccaaaccgccctcatttgtgcagcgccagatccttcggacacatccctaggtgtctccatcctcattcggtccatccaactcccagacctcacgtcaaccggctgcaccccactttccagcctgcgccccagatctgcagccttcgcccctagatacacccgcctggtgatgaggcgctcctcgcgttccttccgtctccagtgcaccggctttccctcgtcctctgcgcagtccatctcagctcatctctccaattcaatgccatcatctctcctcaccatctctcggtgccctggaatgtttgctgtcagatgtcccctgtgaaacccacaaacgcttgcgatttggcctccttgttttattttgtgtagtcctacaacgtcttgttactaccccctattacaacacttataactcaagataagaagccagcaacaacaaaacaattttgggcggtcgccccgagagagaggtttaaacgccctgtggggcgcggaggggccaagagacagcagcaagggcaccacggtcccagaagaccggggcacacacagggttgggtctcccaaaaagaagcggggcacgggtttcgacaacccagggtggggctgggctacaggcagggcgtacg

SEQ ID NO: 463159 - DNA, 657 bp, Homo sapiens
acgaagcgactggcaccagctgagtgcggcgactccaagctggtgcagctaggggtcagtcggtctagcatacgactgcagcagcggcgacggaaccagccgctcgatgcacgtctcagaaccctcttatctggacaatccgcccgccggctcgtccccaacgcctcattgtgcggcgatccttcggacacatccctaggtgtctccatcctcattcggtccatccaactcccagacctcacgtcaaccggctgcaccccactttccagcctgcgccccagatctgcagccttcgcccctagatacacccgcctggtgatgaggcgctcctcgcgttccttccgtctccagtgcaccggctttccctcgtcctctgcgcagtccatctcagctcatctctccaattcaatgccatcatctctcctcaccatctctcggtgccctggaatgtttgctgtcagatgtcccctgtgaaacccacaaacgcttgcgatttggcctccttgttttattttgtgtagtcctacaacgtcttgttactaccccctattacaacacttataactcagtatttgtcttttttccgcggtgtccctgcactctccccatacatattcctctcctgccagattgtaagcctctagagggaagaagtaa

SEQ ID NO: 463160 - DNA, 1041 bp, Homo sapiens
acaacagacgctccccttgccctttatgatgtttacatgggcggagggatccctcccagctgacagccacaccgcgccggcccttctttttttaaagagcctagccacgggcgctgactggccggcagccgggcgcgtcatcctccgggggcggggcccgggccgcattgtctcgtctagggccggctggacgccccagaggccggacctgggcaaccccagcctggaggtgccggggccggagctcccagagggctgggtgcgaggcctaggcggggtcaggttcgggttcctaggccatagcggagctgcagcccaggcggccggagcggaacccagccccgctccgagtgccacgtctccaggaaccccctccttactcttggacaacactccgcccccgcccgggcctccgtcccccaaaccgccctcatttgtgcagcgccagatccttcggacacatccctaggtgtctccatcctcattcggtccatccaactcccagacctcacgtcaaccggctgcaccccactttccagcctgcgccccagatctgcagccttcgcccctagatacacccgcctggtgatgaggcgctcctcgcgttccttccgggctccaggtgtccgtgagcctcccttccgccctggcctccggtctctgccttgctcgtgcttctaccaccacccttcccctcccaacccggtggatcctctcgtctcccccagtctccagtgcaccggctttccctcgtcctctgcgcagtccatctcagctcatctctccaattcaatgccatcatctctcctcaccatctctcggtgccctggaatgtttgctgtcagatgtcccctgtgaaacccacaaacgcttgcgatttggcctccttgttttattttgtgtagtcctacaacgtcttgttactaccccctattacaacacttataactcagtatttgtcttttttccgcggtgtccctgcactctccccatacatattcctctcctgccagattgtaagcctctagagggaagaagtaa

SEQ ID NO: 463161 - DNA, 1245 bp, Homo sapiens
acaacagacgctccccttgccctttatgatgtttacatgggcggagggatccctcccagctgacagccacaccgcgccggcccttctttttttaaagagcctagccacgggcgctgactggccggcagccgggcgcgtcatcctccgggggcggggcccgggccgcattgtctcgtctagggccggctggacgccccagaggccggacctgggcaaccccagcctggaggtgccggggccggagctcccagagggctgggtgcgaggcctaggcggggtcaggttcgggttcctaggccatagcggagctgcagcccaggcggccggagcggaacccagccccgctccgagtgccacgtctccaggaaccccctccttactcttggacaacactccgcccccgcccgggcctccgtcccccaaaccgccctcatttgtgcagcgccagatccttcggacacatccctaggtgtctccatcctcattcggtccatccaactcccagacctcacgtcaaccggctgcaccccactttccagcctgcgccccagatctgcagccttcgcccctagatacacccgcctggtgatgaggcgctcctcgcgttccttccggtaaccgcgttgcgaagaccacgctgccgggttgcaaacttggggggacttcctccctcccctccccctgggcgccgtgcaactgccctgggaccgggttctgggatgaggggggcagaccgggctccccagcggccggcgcagcacgtagcgcacgtgtagggtccgctccccaccccctcgccgcctctgacaacttttcagggctccaggtgtccgtgagcctcccttccgccctggcctccggtctctgccttgctcgtgcttctaccaccacccttcccctcccaacccggtggatcctctcgtctcccccagtctccagtgcaccggctttccctcgtcctctgcgcagtccatctcagctcatctctccaattcaatgccatcatctctcctcaccatctctcggtgccctggaatgtttgctgtcagatgtcccctgtgaaacccacaaacgcttgcgatttggcctccttgttttattttgtgtagtcctacaacgtcttgttactaccccctattacaacacttataactcagtatttgtcttttttccgcggtgtccctgcactctccccatacatattcctctcctgccagattgtaagcctctagagggaagaagtaa

SEQ ID NO: 463162 - DNA, 389 bp, Homo sapiens
gttggatccggttggatccggttggatccgaattcggatccaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcagcaacaagcttc

SEQ ID NO: 463163 - DNA, 506 bp, Homo sapiens
aggccttaaaggctcccaaaaagggggttcctgccggtccacccagtgaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtca

SEQ ID NO: 463164 - DNA, 1018 bp, Homo sapiens
ggcaatggggacaaagtcctccctcgtcccctgccgcagggttgttgagaaaaggtgaaatgggggagggatccccactactggcttccctgctgtacaccactaaggtgggaggggctggtcggggggccgtgatgcaggctcagctgactgatgctttgctttgcctccagatcatgagcgtcttgttgttcatcgagcactcggtagaggtggcccatggcaaggcgtcctgcaagctctcccagatgggctacctcaggatcggccgattcctcattgctctcaggccactccccagggatgccttcctcagcctcaccctggctgaagtggaccccagcctgcacctccagcccagcaccctctctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaagtctcatatcgattccaggaggcgcagagaaaactaagatgccacctctgccttagaggagtgtacagttcagacacatagatacaattacaacttggtgtgaagcacagggacaataagcacagaggaaggacctggcctcttctcagg

SEQ ID NO: 463165 - DNA, 431 bp, Homo sapiens
  misc_feature (269)..(269): n is a, c, g, or t
  misc_feature (271)..(271): n is a, c, g, or t
  misc_feature (309)..(310): n is a, c, g, or t
  misc_feature (312)..(312): n is a, c, g, or t
  misc_feature (316)..(316): n is a, c, g, or t
  misc_feature (348)..(348): n is a, c, g, or t
  misc_feature (352)..(352): n is a, c, g, or t
  misc_feature (356)..(356): n is a, c, g, or t
  misc_feature (358)..(358): n is a, c, g, or t
  misc_feature (379)..(379): n is a, c, g, or t
  misc_feature (384)..(384): n is a, c, g, or t
  misc_feature (392)..(392): n is a, c, g, or t
  misc_feature (405)..(405): n is a, c, g, or t
  misc_feature (413)..(413): n is a, c, g, or t
  misc_feature (415)..(415): n is a, c, g, or t
gcagcagcttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcggtagaggtggcccatggcaaggcgtcctgcaagctctcccagatgggctacctcaggatcgattatntnttcaattcagaagaaaaaggatgagccgcagcatgagnngnagcngctagatactagaacgttactgttgtactaanatcngatntnatcattcggaaagataggganaagantaagggtnccccgccaatagnaaaaggantntgcgaatgggcgggaa

SEQ ID NO: 463166 - DNA, 2090 bp, Homo sapiens
ggcctgggctttcctgtgcatcctcatgtccccaaaccagtggttccccaagtgtggtcctgggagcctggctggggtcccaggggcacccctgagcacctccctgctctccttgcctttcagctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcatagcagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcagcaacaagcttc

SEQ ID NO: 463167 - DNA, 1997 bp, Homo sapiens
ggcctgggctttcctgtgcatcctcatgtccccaaaccagtggttccccaagtgtggtcctgggagcctggctggggtcccaggggcacccctgagcacctccctgctctccttgcctttcagctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgacatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcatagcagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcagcaacaagcttc

SEQ ID NO: 463168 - DNA, 944 bp, Homo sapiens
cccctatatatttatatatagggggtaactaattaataatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcatagcagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcagcaacaagcttc

SEQ ID NO: 463169 - DNA, 1278 bp, Homo sapiens
gcagcagcttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcggtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctcctcctcccaccccaaggcatcaagcccttctcgcctggcagctcgaagtagaaccccttcaagtaaattatttctcaatggccaatcagaacaggagggcagagagaaagagaaagaagaagacagagagagaggagaggaaacgccgagagaggaagggagagagaaagaagaaaagaagcacagacgaa

SEQ ID NO: 463170 - DNA, 1071 bp, Homo sapiens
gcagcagcttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcggtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctgacccacactcatctgggcaaccccttccttacagcctcggatcacctccttggcctctac

SEQ ID NO: 463171 - DNA, 629 bp, Homo sapiens
gcagcagcttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcggtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcagcaacaagcttc

SEQ ID NO: 463172 - DNA, 449 bp, Homo sapiens
caaccagaatgagaggtccgagcaggagcagctggatgctggcttctggagagagtggtggctcctgcctggcatatgtcctaggcctgctggagcgtgagaaggacgctcagcaaagcacagcctgacctgggcctttttccaggtctacatgttcaagtgcgtgtggcggtgctacagattgatcaagtgcatgaactcggtggaggagaagagaaactccaagatgctccagaaggtgagtgtggctgcaggtgggtgccagccctgtcactaactccctgtgccatttgggtcaagtttccttccctctctggaccttggtttctctatttgtaagatgagggttggaacagaagaaatgtgttctctttcagttctggtagtctaagattcattcactcactcattcatttattcagtatttactgcctctcactctttgctag

SEQ ID NO: 463173 - DNA, 828 bp, Homo sapiens
gcagcagcttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcggtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtcctgccgtcctactctgaaagtgggtaccgagctgaatcgaaaag

SEQ ID NO: 463174 - DNA, 397 bp, Homo sapiens
agcaaattgagtcaaatcctgctctttgagccctgatagatggggatggttcccttacgtctcctgggacaccaagactcctctcattcagggcctgggtcttatccactccctgtccccagagtgtcactcagagggaggtgacctcaactgaggagggcagggaaggtttgggagagggtgggaaggggatgcatgaggatatcaggctgggtggcggagtgttggctgcatgcaggggacacttgacggtgctgggcctacctttcagaaccgggagaagtacctgctgcccttcctgtccctgcaaatcatggactatctcctgtgcctgctcaccctgctgggctcctacattgagctgcccgcctacctcaagttggcctcccggagccgt

SEQ ID NO: 463175 - DNA, 2230 bp, Homo sapiens
gcagcagcttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcggtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcatagcagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcagcaacaagcttc

SEQ ID NO: 463176 - DNA, 2548 bp, Homo sapiens
  misc_feature (2279)..(2279): n is a, c, g, or t
  misc_feature (2283)..(2283): n is a, c, g, or t
  misc_feature (2285)..(2285): n is a, c, g, or t
  misc_feature (2289)..(2289): n is a, c, g, or t
  misc_feature (2294)..(2294): n is a, c, g, or t
  misc_feature (2302)..(2304): n is a, c, g, or t
  misc_feature (2307)..(2307): n is a, c, g, or t
  misc_feature (2328)..(2328): n is a, c, g, or t
  misc_feature (2339)..(2339): n is a, c, g, or t
  misc_feature (2351)..(2351): n is a, c, g, or t
  misc_feature (2365)..(2366): n is a, c, g, or t
  misc_feature (2368)..(2368): n is a, c, g, or t
  misc_feature (2393)..(2393): n is a, c, g, or t
  misc_feature (2407)..(2407): n is a, c, g, or t
  misc_feature (2411)..(2411): n is a, c, g, or t
  misc_feature (2414)..(2414): n is a, c, g, or t
gcagcagcttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcggtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcatagcagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcagcaacaagcttccaaaaaaaaaaaaaaaaaaaaaaaaaaaactcccggggcccctaaggcngggngngggnaaaangagagggnnnggnaaggggcccggggccaaaagngggtccctggncccaagttttcntggcccccaagggnngnaaaccgccggggctccccccaatangggggagccggaantaanttntccgaataagcccggggtaacccgggcttaaggcgactgtgcgcacagaaaaatagccagagacgacgaaacacaaacgagagacagagaaacgcagagccagagggttacaccacgcttggcaccacacaaag

SEQ ID NO: 463177 - DNA, 2212 bp, Homo sapiens
gcagcagcttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcggtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcatagcagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcagcaacaagcttc

SEQ ID NO: 463178 - DNA, 1261 bp, Homo sapiens
gcagcagcttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcggtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtca

SEQ ID NO: 463179 - DNA, 378 bp, Homo sapiens
gcacccctacagtcccagcagccagtccaggcccaggtgaccccgcagcctcaaaccccagttcagctcccgtctgtggctacccctcagtcatcgcagcaacagccgacgcctgtgcacgcccagcctcctggcacaccgctttccagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaa

SEQ ID NO: 463180 - DNA, 401 bp, Homo sapiens
gcggccgcctactactactactactgctcgaattcaaagcttctaacgatgtacggggacatgttctttttcattaaagagagaaatcaactattcaggaccggcccccacctttcctcaggagtcatttctgttccgcacaggcctgctgaactgggtgctttatatagggtaagtgtttctcattttttgttccctgtcctcaagccttaggggcaaaagaaacatccaagatttgaaatttcttttcttcttctcatctgcatggctgtagccatctctctgttctgcattatcttatgacaaaaaaaaaaattcttattttgaagcaaactcaaagctaggtcctgatgtctcaaggcacaggtactcgtacttaaaggtgagtctgaaatctgtgg

SEQ ID NO: 463181 - DNA, 2676 bp, Homo sapiens
cagaagagagacgaaaaaaaaactaggctaggacgaggccggggttaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccaggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgagggtgaggctctctgcacactccagagtgaggactttaataatctagtggactgtacatgttgggaggggaagagcggggtgccgagggtctggagggagaagaattgactgccccttttgctcttggagttaagcagaaatctaaagagaaggcaaagaatcttgccttcctggcatcatttcctcctaccatcccaggccatcatttatttattacagccaacagactggcctctttcttccctttgactgggaatgggtcaaaggcggtgcaggaggaggatctggtccagataattcacaagcagggtgcattttcctctcattattgagaactgtgagtgtttatcaagaaggcagagcaggagaagatgaaccagtcttcttcccctcactacccagatctctgcctgccaacaagccccgtgttcaccctggcaaagagtctttacattcagaccaaggagagtgtgactccttctcagcactagctagaaacctcaagcccttgcttaagggcctttttcagagagacccaatgcccagaaggctagatgcgtggggaggagccacatacgagaaactgcctccctgcttcgggtcagaacaagccccaggaagaaagtatttcaaacaacaaggtgcatctgccccaacccatccagcctgcatgttggtgctgagaacagccttttatggggcttgcactgagccatgggcatgtctgaacacaacaaggaagaggccagagcagcaacagcacgcaaagggttgatgggcatttcttttaagacagagcagaaaactcttagatactttgcgtccttcctatttgactcagtctatgaaagccaggttagcttgctttcttcctccctaaatcctccatcctcatgaccaacaaagaaatagttgaatcattttccaggcacatcttggggaggatgtggggccattggaggctgtccttcctagataagtctttaggagtgagaacaaggagtcttaccctcctctgtccacccacccccatgaatgggcctggctccagccaggagttgtggtttttcctgagctcctcacctatctcttctggatttcacattggcaaacggggttgcaaagtgctcttcgtgctctttggacagtgccttgtggagaggaatgcccatgcccctgcattccaaggccttggtaagcaagctcagagtagctggatttttctaaagcaattgcagaacacctgctttttctttgtttcctctagaaaggaccaaccacgccgagctcagttatggcacacacagtgggacctagacaaagggagagggtgaccgacatcccaactaggtaaacacagaggaggttccacatggacttatctgggtggctgttttgaaaacgagaaacagtcaagagtccctggccccacagacccacctccccaactcagcactgtctgtctgtgcagcaggtgcaaggacgtgttgaactagctctctgcagcctccttggaggatgtgatcctatgggaggggtaggagtattcaggtccttgacatctcccaaatgtgtgattccgggatgccaaaggcctttggccaggtaatgcagtgtctacaggctgaggttgacatgcatccccaccctctgagaaaaagatcctcagacaatccatgtgcttctcttgtccttcattccaccggagtctgtctcatacccaaccagatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaa

SEQ ID NO: 463182 - DNA, 2320 bp, Homo sapiens
ggcatagtgggcagaagaatcttgaacaaggagtccagagcaggtcaagtctcctgatacaggttgtgactcatggttttttgtctctgcctgtagcagctacaggtctgtaaagcaaggggagagtgataaggaaagaactcacctttctggggctctctgacattaatgccacctcccatttgctttttgcagacactgtcatctctcaagtacccatcttggagggtacggaccccacatgagggtgaggctctctgcacactccagagtgaggactttaataatctagtggactgtacatgttgggaggggaagagcggggtgccgagggtctggagggagaagaattgactgccccttttgctcttggagttaagcagaaatctaaagagaaggcaaagaatcttgccttcctggcatcatttcctcctaccatcccaggccatcatttatttattacagccaacagactggcctctttcttccctttgactgggaatgggtcaaaggcggtgcaggaggaggatctggtccagataattcacaagcagggtgcattttcctctcattattgagaactgtgagtgtttatcaagaaggcagagcaggagaagatgaaccagtcttcttcccctcactacccagatctctgcctgccaacaagccccgtgttcaccctggcaaagagtctttacattcagaccaaggagagtgtgactccttctcagcactagctagaaacctcaagcccttgcttaagggcctttttcagagagacccaatgcccagaaggctagatgcgtggggaggagccacatacgagaaactgcctccctgcttcgggtcagaacaagccccaggaagaaagtatttcaaacaacaaggtgcatctgccccaacccatccagcctgcatgttggtgctgagaacagccttttatggggcttgcactgagccatgggcatgtctgaacacaacaaggaagaggccagagcagcaacagcacgcaaagggttgatgggcatttcttttaagacagagcagaaaactcttagatactttgcgtccttcctatttgactcagtctatgaaagccaggttagcttgctttcttcctccctaaatcctccatcctcatgaccaacaaagaaatagttgaatcattttccaggcacatcttggggaggatgtggggccattggaggctgtccttcctagataagtctttaggagtgagaacaaggagtcttaccctcctctgtccacccacccccatgaatgggcctggctccagccaggagttgtggtttttcctgagctcctcacctatctcttctggatttcacattggcaaacggggttgcaaagtgctcttcgtgctctttggacagtgccttgtggagaggaatgcccatgcccctgcattccaaggccttggtaagcaagctcagagtagctggatttttctaaagcaattgcagaacacctgctttttctttgtttcctctagaaaggaccaaccacgccgagctcagttatggcacacacagtgggacctagacaaagggagagggtgaccgacatcccaactaggtaaacacagaggaggttccacatggacttatctgggtggctgttttgaaaacgagaaacagtcaagagtccctggccccacagacccacctccccaactcagcactgtctgtctgtgcagcaggtgcaaggacgtgttgaactagctctctgcagcctccttggaggatgtgatcctatgggaggggtaggagtattcaggtccttgacatctcccaaatgtgtgattccgggatgccaaaggcctttggccaggtaatgcagtgtctacaggctgaggttgacatgcatccccaccctctgagaaaaagatcctcagacaatccatgtgcttctcttgtccttcattccaccggagtctgtctcatacccaaccagatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaa

SEQ ID NO: 463183 - DNA, 1056 bp, Homo sapiens
cagaagagagacgaaaaaaaaactaggctaggacgaggccggggttaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccaggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgagggtgaggctctctgcacactccagaaaaggaccaaccacgccgagctcagttatggcacacacagtgggacctagacaaagggagagggtgaccgacatcccaactagatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaa

SEQ ID NO: 463184 - DNA, 980 bp, Homo sapiens
cagaagagagacgaaaaaaaaactaggctaggacgaggccggggttaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccaggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggaaaggaccaaccacgccgagctcagttatggcacacacagtgggacctagacaaagggagagggtgaccgacatcccaactagatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaa

SEQ ID NO: 463185 - DNA, 1032 bp, Homo sapiens
cagaagagagacgaaaaaaaaactaggctaggacgaggccggggttaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccaggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgaggaaaggaccaaccacgccgagctcagttatggcacacacagtgggacctagacaaagggagagggtgaccgacatcccaactagatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaa

SEQ ID NO: 463186 - DNA, 1306 bp, Homo sapiens
atgaccagtgatttacgaaattcgaggcctccggtaaccccaagagagccaccaaggagcatttcaagaccaaggagagtgtgactccttctcagcactagctagaaacctcaagcccttgcttaagggcctttttcagagagacccaatgcccagaaggctagatgcgtggggaggagccacatacgagaaactgcctccctgcttcgggtcagaacaagccccaggaagaaagtatttcaaacaacaaggtgcatctgccccaacccatccagcctgcatgttggtgctgagaacagccttttatggggcttgcactgagccatgggcatgtctgaacacaacaaggaagaggccagagcagcaacagcacgcaaagggttgatgggcatttcttttaagacagagcagaaaactcttagatactttgcgtccttcctatttgactcagtctatgaaagccaggttagcttgctttcttcctccctaaatcctccatcctcatgaccaacaaagaaatagttgaatcattttccaggcacatcttggggaggatgtggggccattggaggctgtccttcctagataagtctttaggagtgagaacaaggagtcttaccctcctctgtccacccacccccatgaatgggcctggctccagccaggagttgtggtttttcctgagctcctcacctatctcttctggatttcacattggcaaacggggttgcaaagtgctcttcgtgctctttggacagtgccttgtggagaggaatgcccatgcccctgcattccaaggccttggtaagcaagctcagagtagctggatttttctaaagcaattgcagaacacctgctttttctttgtttcctctagaaaggaccaaccacgccgagctcagttatggcacacacagtgggacctagacaaagggagagggtgaccgacatcccaactagatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaa

SEQ ID NO: 463187 - DNA, 738 bp, Homo sapiens
agtggggcatactgcagcctcaacctcagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgaggaaaggaccaaccacgccgagctcagttatggcacacacagtgggacctagacaaagggagagggtgaccgacatcccaactagatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaa

SEQ ID NO: 463188 - DNA, 1041 bp, Homo sapiens
cagaagagagacgaaaaaaaaactaggctaggacgaggccggggttaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccaggcaggagtgcagtggctcaatcttgggctcactgcagcctcaacctcccaggttcaagcgattctcctgcctcagcccctcaagtagctgggactacaagcgcacaccaccacgcctgactaattttttgtatttttttgtagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgaggatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaa

SEQ ID NO: 463189 - DNA, 691 bp, Homo sapiens
cagaagagagacgaaaaaaaaactaggctaggacgaggccggggttaccacctccttgaaatgggctgagtccctcttgctcacccttgacttggaaaaaccagtttctcttttattaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaa

SEQ ID NO: 463190 - DNA, 2590 bp, Homo sapiens
cagaagagagacgaaaaaaaaactaggctaggacgaggccggggttaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccaggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgagggtgaggctctctgcacactccagagtgaggactttaataatctagtggactgtacatgttgggaggggaagagcggggtgccgagggtctggagggagaagaattgactgccccttttgctcttggagttaagcagaaatctaaagagaaggcaaagaatcttgccttcctggcatcatttcctcctaccatcccaggccatcatttatttattacagccaacagactggcctctttcttccctttgactgggaatgggtcaaaggcggtgcaggaggaggatctggtccagataattcacaagcagggtgcattttcctctcattattgagaactgtgagtgtttatcaagaaggcagagcaggagaagatgaaccagtcttcttcccctcactacccagatctctgcctgccaacaagccccgtgttcaccctggcaaagagtctttacattcagaccaaggagagtgtgactccttctcagcactagctagaaacctcaagcccttgcttaagggcctttttcagagagacccaatgcccagaaggctagatgcgtggggaggagccacatacgagaaactgcctccctgcttcgggtcagaacaagccccaggaagaaagtatttcaaacaacaaggtgcatctgccccaacccatccagcctgcatgttggtgctgagaacagccttttatggggcttgcactgagccatgggcatgtctgaacacaacaaggaagaggccagagcagcaacagcacgcaaagggttgatgggcatttcttttaagacagagcagaaaactcttagatactttgcgtccttcctatttgactcagtctatgaaagccaggttagcttgctttcttcctccctaaatcctccatcctcatgaccaacaaagaaatagttgaatcattttccaggcacatcttggggaggatgtggggccattggaggctgtccttcctagataagtctttaggagtgagaacaaggagtcttaccctcctctgtccacccacccccatgaatgggcctggctccagccaggagttgtggtttttcctgagctcctcacctatctcttctggatttcacattggcaaacggggttgcaaagtgctcttcgtgctctttggacagtgccttgtggagaggaatgcccatgcccctgcattccaaggccttggtaagcaagctcagagtagctggatttttctaaagcaattgcagaacacctgctttttctttgtttcctctagaaaggaccaaccacgccgagctcagttatggcacacacagtgggacctagacaaagggagagggtgaccgacatcccaactaggtaaacacagaggaggttccacatggacttatctgggtggctgttttgaaaacgagaaacagtcaagagtccctggccccacagacccacctccccaactcagcactgtctgtctgtgcagcaggtgcaaggacgtgttgaactagctctctgcagcctccttggaggatgtgatcctatgggaggggtaggagtattcaggtccttgacatctcccaaatgtgtgattccgggatgccaaaggcctttggccaggtaatgcagtgtctacaggctgaggttgacatgcatccccaccctctgagaaaaagatcctcagacaatccatgtgcttctcttgtccttcattccaccggagtctgtctcatacccaaccagatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagcccccgagccacggccgccgccggggggggcggctgctgtacggcgg

SEQ ID NO: 463191 - DNA, 252 bp, Homo sapiens
tcctagttttagaagtttcaaagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaa

SEQ ID NO: 463192 - DNA, 873 bp, Homo sapiens
cagaagagagacgaaaaaaaaactaggctaggacgaggccggggttaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccaggcaggagtgcagtggctcaatcttgggctcactgcagcctcaacctcccaggttcaagcgattctcctgcctcagcccctcaagtagctgggactacaagcgcacaccaccacgcctgactaattttttgtatttttttgtagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatatagggtaagtgtttctcattttttgttccctgtcctcaagccttaggggcaaaagaaacatccaagatttgaaatttcttttcttcttctcatctgcatggctgtagccatctctctgttctgcattatcttatgacaaaaaaaaaaattcttattttgaagcaaactcaaagctaggtcctgatgtctcaaggcacaggtactcgtacttaaaggtgagtctgaaatctgtgg

SEQ ID NO: 463193 - DNA, 878 bp, Homo sapiens
cagaagagagacgaaaaaaaaactaggctaggacgaggccggggttaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccaggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgaggaaaggaccaaccacgccgagctcagttatggcacacacagtgggacctagacaaagggagagggtgaccgacatcccaactagggtccccaggcaggtggctgggacactatttgcaatcagcaaggaaccctgctgcccttagactccccacagagcaagcagaacttgcagaatggggtaaaaacactctattaaagattttttaaacctatttatattgtaataaagtaaatgtaaataaaatttaagtgaaggcagattgcagatatttcc

SEQ ID NO: 463194 - DNA, 3144 bp, Homo sapiens
  misc_feature (1)..(3): n is a, c, g, or t
  misc_feature (6)..(8): n is a, c, g, or t
  misc_feature (10)..(10): n is a, c, g, or t
nnnctnnngnttaggtgcaaggctcagataacctgcagtgtctctccaactctgggatgacaaagacctcacttcccttttctggtgttcacacaacaatgagaaataccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccaggcaggagtgcagtggctcaatcttgggctcactgcagcctcaacctcccaggttcaagcgattctcctgcctcagcccctcaagtagctgggactacaagcgcacaccaccacgcctgactaattttttgtatttttttgtagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgagggtgaggctctctgcacactccagagtgaggactttaataatctagtggactgtacatgttgggaggggaagagcggggtgccgagggtctggagggagaagaattgactgccccttttgctcttggagttaagcagaaatctaaagagaaggcaaagaatcttgccttcctggcatcatttcctcctaccatcccaggccatcatttatttattacagccaacagactggcctctttcttccctttgactgggaatgggtcaaaggcggtgcaggaggaggatctggtccagataattcacaagcagggtgcattttcctctcattattgagaactgtgagtgtttatcaagaaggcagagcaggagaagatgaaccagtcttcttcccctcactacccagatctctgcctgccaacaagccccgtgttcaccctggcaaagagtctttacattcagaccaaggagagtgtgactccttctcagcactagctagaaacctcaagcccttgcttaagggcctttttcagagagacccaatgcccagaaggctagatgcgtggggaggagccacatacgagaaactgcctccctgcttcgggtcagaacaagccccaggaagaaagtatttcaaacaacaaggtgcatctgccccaacccatccagcctgcatgttggtgctgagaacagccttttatggggcttgcactgagccatgggcatgtctgaacacaacaaggaagaggccagagcagcaacagcacgcaaagggttgatgggcatttcttttaagacagagcagaaaactcttagatactttgcgtccttcctatttgactcagtctatgaaagccaggttagcttgctttcttcctccctaaatcctccatcctcatgaccaacaaagaaatagttgaatcattttccaggcacatcttggggaggatgtggggccattggaggctgtccttcctagataagtctttaggagtgagaacaaggagtcttaccctcctctgtccacccacccccatgaatgggcctggctccagccaggagttgtggtttttcctgagctcctcacctatctcttctggatttcacattggcaaacggggttgcaaagtgctcttcgtgctctttggacagtgccttgtggagaggaatgcccatgcccctgcattccaaggccttggtaagcaagctcagagtagctggatttttctaaagcaattgcagaacacctgctttttctttgtttcctctagaaaggaccaaccacgccgagctcagttatggcacacacagtgggacctagacaaagggagagggtgaccgacatcccaactaggtaaacacagaggaggttccacatggacttatctgggtggctgttttgaaaacgagaaacagtcaagagtccctggccccacagacccacctccccaactcagcactgtctgtctgtgcagcaggtgcaaggacgtgttgaactagctctctgcagcctccttggaggatgtgatcctatgggaggggtaggagtattcaggtccttgacatctcccaaatgtgtgattccgggatgccaaaggcctttggccaggtaatgcagtgtctacaggctgaggttgacatgcatccccaccctctgagaaaaagatcctcagacaatccatgtgcttctcttgtccttcattccaccggagtctgtctcatacccaaccagatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaagcctctctgcctctatgttttataccatcggatgccaactcccggccttctaagccacctcccctttaggctaaaactgagacatgaacttgaaaaattgacactggcttcctctctctttagggtccccaggcaggtggctgggacactatttgcaatcagcaaggaaccctgctgcccttagactccccacagagcaagcagaacttgcagaatggggtaaaaacactctattaaagattttttaaacctatttatattgtaataaagtaaatgtaaataaaatttaagtgaaggcagattgcagatatttcc

SEQ ID NO: 463195 - DNA, 1552 bp, Homo sapiens
cagaagagagacgaaaaaaaaactaggctaggacgaggccggggttaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccaggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgagggtgaggctctctgcacactccagaaaaggaccaaccacgccgagctcagttatggcacacacagtgggacctagacaaagggagagggtgaccgacatcccaactagatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaaaaaaaaaaaaaaaaaaaaaaaaaaaaaaaaaaaaaaaaaagggggggggccccacacagaaaattacccacccgaggagggccacaacagaatgaaggcagaagcaccgaggcttcgatgtggaacaagaggggcgcccccaataagggggggcgcggcactaagaaagcctaagagcagcggcgccgcaagatgataacacacgggtcggacacgggaaaaaagcggatcaggcgcggtgggaacatcctcgtggcgaaggaacacccccgcactattcgtgcggtgggggcgcccaacaatgtggtgggcgacacagatcatcctcatcgaagagactatatacgagcgcccctcgagccgcgaacaattatgcaaattctcaggaggggctactgcgggcggttaaaccgccaggcggcaagtaacggtgaccccgctggcagaagacttggcgacagcggaaagcgacgtcttagtcaccttttttcgcgga

SEQ ID NO: 463196 - DNA, 1448 bp, Homo sapiens
tgcctccagtggacgtagctgatgaccctggagcaagctgatcatggggaaatgatctggttaaaaatgaatatgagaaacaaaggtagaggcactaaccattatacaaacaagatgcttcttcctcttccctacaagagagaagaaactctcagcagtctttgtattcatctcaagtctccaggtgacatgaagtcttctccatcaggtcctgatgcagctcctgtggagggtgaggatatcatgaaatgtgtggtgaaagaaggaaaccatcattcagccatgaccccaagatcagccggtacctacaccgggcagagagctgcttggcaaagggctgagcagcacacacataagtggtacgtgttgcctccaaaatccaaagatactcaagaccggtatagctacgttattataaaaacaatgagaataggggagtggcatggtttgacttacactgtttttaaagattgctctggctgcaatgtgggtcctggcttcccacaccagggcatgctggtgccattcacggagataagaaatactggaagaccagtgaaatcaggctgatctggacctgagtcacagctccatcaaatgctggattattcaggagaacttgtatgatctcttcaaccttctagatgagctccatttgttaaaattacattaaataatatataaaaagtgcctagaccactccttgacacatagtaactgcttataaatctcagtatcactactacttctctttctgctgcatacaccagcatagatatcaagcgtctgtgctttcaaactatccaggaagaactatactatggaagtgacccacagcatttacagaggaaacacagatatagacaaatataaatcctaagtaagggagtgtgtattagtctgttttcacgatgctgataaagacatacctgagactgggtaatttataaagaaaaagaggtttaatggactcacagttccacgtggctggggaggcctcacaagcatgatggaagatgaaagacatgccttacatggtggcaggcaagagagagaatgagaatgaagcgataggggtttccccgtataaagccatcagatctcatgagacttatttactaccatgagaacagtatgggggaaaccactcccatgattcaattatctctcactgggtccctcccacaacatgtaggaattatgggaactacaattcaaaatgacatttgggtgggaacacagccaaaccatatcaaagtagtaggactaaaggaaagaacacatgaagtgcatattaattatttttctgaagaaacgtgatgagctttgcataaaattataagtgctatataaagtagtattgtatcaatcaacataaatgtgtgactgctgggcaaacatacctctggcttcacatcctcaaccctcacctctaagaattactgacc

SEQ ID NO: 463197 - DNA, 970 bp, Homo sapiens
caacgaaagcagagatttattgaaaatgaaagtacatttcacagggtgggagtggcccgagcagtggctcaaaggccctggttacacagtcttctggggtccaaatccaccattggccacttgatgtacacccggtgcaaatgaagcagtggcccacaatcagaggccaaagtgaagttacaaagttacactcctatgcaaacatctgcttggttgctttctgcaaccaatcagaggtactttcaattttccatctgccatgtagaaagtgttgcaaagggagtagcctctggtccttttgttacttaggtgtggaaaattggggttttccttttgatttagttctaggaagtcagcatgaactggccttaggttccttgcctccacaccctattctcctgcctcaaattcaccagataataggatacctccacacaggtattctctctttcaattctcaaggatatattctggacttgggcaaatgctctgacagtggcctctgttaccaacattaacagcatgttaccagagaggaatctgagaaaactctttatttgggtaacattgatttttaacatggctcaaacctgttatttccacagctggcatagggaaatcattaggtttctctccagatggataatgatttttgtaacttgatttacatttaggaatttaaggttcttaatgaaggttgacatatttgtgaatccaagttattgcgtagttctattgatgatagtagtcatcttatatgcttagaaaatattcctttggatggctatgttaattgctataattttcttctgtcattttaaatcattttttctttgtgaaaacaaaatgttacaaatcaccattttgtactatttagctgtaaattacagtgtattgaactaaaatgtttcagttgtaacaaaggatggagaaaattatcaaaatttacatctatactaaaatagctcaa

SEQ ID NO: 463198 - DNA, 1726 bp, Homo sapiens
gagtgcgcctgtccctgtggtgggagcagtggcgccgagcgtgcccacgggccgccgcttgggtttctctcgtgttcagggtagtatggacgtggacaatggcagtggcccctggctggcccaagagccgggcgtcataaccaacccggggccgcgaggctgggatcaggcaccccggagccgcttgcccgtggccgggctgctctccccctctaagcctaagcaccgccagtcgcggcgctgcgctttccgccgacctcccagagcgtcccgccgtcgccggcggccagcctcgcgcaggaccagtgtggcgccgccctgctgttgctggggggcgcccgaggcctccattccttgcccaggcttccggctctcggggcggcctcccttccgcccacgctccagggcttccccggctcccgagctccgagcttccaccacatcggccggctcaggacagggcttccactgtaaagtcggctgccagacgtgttggagctcaccgaacccagagttgatctctgcagcatgccatcactgctggggatgaggaaacggtgatttcaggactgttttttctgtctcttcagtgcctctttcagtgatctgaggttaaaaccagactatggaggattcatcaacagaccaggaagcaacagcctgggctccagaattgaccagtagtccgtgcacagacgaggagaggtcccatgaaacttcggcgcagtctgggaaccgagctctttttgtaacaagttgtttgtcaggaggcccggtcatgaaagcccttcctgactgggctcaaggaatacaaaaaggacaacttgtttttgccattgtctgttgtttttcaataactagttctccgaaacagcactggatgaatgcctcaaggggctcacacaactcgttccaggacttagtgaccattgtttctgtccctgttcaatagagttcaaatttaatatttaaattttgctccacaatgtgccatattatctgtatccaacctgtcattgggcatttaggttgattccatgtctttactattgtgaataatgctgcaataaacatttacgtgcttgtgtctttatgatagaacaatttatatacctctgggtatatacccagtaatgagattgctgggtcaagtgatagttctgcttttatctctttcgaggagagcactgttgtgctttccacaatggtgggaccaatgtacactcccaagcatctgtcattttttgactttttcataatagccattctgactggtgtgagatggtgtctcactgtgccttggatttgcatttctctaatgatcagtgatactgagctttgtattctatggttgttggtcacatgtatgtattcttttgaaaagcattcatgtcctttgcccactttttaaacatttttttatttccataggttttaggacaacaggtggcatttggttacattagtaagttctttattgatttgtaagattttggtgcatccatcaactcatctgtatacactgaacccaatttgtagccttttatcactcacccccttctcccgtttctccctgagtccccaaagtctattgtgtcattcttaagcttttgcatccttatagcttagctcccaattataagtgagaatatatgatgtttggttttccattcctgagttacttcacttagaataatagtcttcaatcccatccaggttgctgcaa

SEQ ID NO: 463199 - DNA, 1235 bp, Homo sapiens
gtcttgctttactctcacgcccaagaatcagaattcagaacttttaataagaaaagctttcagaactcaggaaggacaaggaagacattctggttctccatgcttaacattggactgtttcttcaactgagactatggaggattcatcaacagaccaggaagcaacagcctgggctccagaattgaccagtagtccgtgcacagacgaggagaggtcccatgaaacttcggcgcagtctgggaaccgagctctttttgtaacaagttgtttgtcaggaggcccggtcatgaaagcccttcctgactgggctcaaggaatacaaaaaggacaacttgtttttgccattgtctgttgtttttcaataactagttctccgaaacagcactggatgaatgcctcaaggggctcacacaactcgttccaggacttagtgaccattgtttctgtccctgttcaatagagttcaaatttaatatttaaattttgctccacaatgtgccatattatctgtatccaacctgtcattgggcatttaggttgattccatgtctttactattgtgaataatgctgcaataaacatttacgtgcttgtgtctttatgatagaacaatttatatacctctgggtatatacccagtaatgagattgctgggtcaagtgatagttctgcttttatctctttcgaggagagcactgttgtgctttccacaatggtgggaccaatgtacactcccaagcatctgtcattttttgactttttcataatagccattctgactggtgtgagatggtgtctcactgtgccttggatttgcatttctctaatgatcagtgatactgagctttgtattctatggttgttggtcacatgtatgtattcttttgaaaagcattcatgtcctttgcccactttttaaacatttttttatttccataggttttaggacaacaggtggcatttggttacattagtaagttctttattgatttgtaagattttggtgcatccatcaactcatctgtatacactgaacccaatttgtagccttttatcactcacccccttctcccgtttctccctgagtccccaaagtctattgtgtcattcttaagcttttgcatccttatagcttagctcccaattataagtgagaatatatgatgtttggttttccattcctgagttacttcacttagaataatagtcttcaatcccatccaggttgctgcaa

SEQ ID NO: 463200 - DNA, 1268 bp, Homo sapiens
ggtgtggttaggaggagcctgatcattgtgggcctggtcagtggtaggtatggggctgggcaaggtcaatcctgctggatatctagaaggtgtaaaccaaggacctaggaaaataccaggaggtagaatgcagcttgagatcaactgtccgatcaaagaacttgaacttgatctggagtgctttggggagccatggaaggtgctggataaaggaggggccagtcagatacgtgttagagatgactgtagaaggctgactggaatgagtgaacaagagcagaccagggagggagcttgtgggggaggtctggagatggcaagggagggatcctgcttggatgaacagtctccagagactgtctcaggaactcatagggagaatctgcagctgaaaggggacgccagaggagacatcactctcttgccctttgactgcgtctggatgcccctactgaccaacactaccatccccttattagactggagaggctgccgggaggggattgtttctgtggactgtaccctgagtgtttccctggtggggtaatgggcaggtgggagtggtggtaccgactctttagaaccagcaatgccaaacagatcccactcggggaaagttcatgctaagtgtcatgtgtcctctggaattttctgaagctttccagcttttttattacccccctaaccagctcatctgatttccagggatctctactaagatgttggcagcccggccagctggtctggccatggatgtgacttcaggggctggttatgcttcatgcacctgcttctagcttcactgttgggccagatttcatccccaccccagctctgcagcgcagctgcttcttgattcctccatggaccctgcgtgaaattaccccatgtttccctttgtgcaccactgaggaaggaagcatgaaggacacacagccattttgcagaccctggtcacagtgaaacattccatgggaactcgggctgtgagaaacatccttcctaaccacatgactgcaggaacatccttatcgcatcctcccaggcaaaggtccaacagcctgactgcagggacatccttgccgtttcctgctgggcagcaagctctaccacccagacccctccctcccatcccatgattacctcagcctgtgagcggcagttggcgctggcactaagctggttcacccctcctcagggttttgttggcaataaaagtgttgctgttgaagccgcaaaaaaaaaaaacaagggcggacgcaatagag

SEQ ID NO: 463201 - DNA, 771 bp, Homo sapiens
ctcatcccaaaccaagggaggggaccctgagtgtttccctggtggggtaatgggcaggtgggagtggtggtaccgactctttagaaccagcaatgccaaacagatcccactcggggaaagttcatgctaagtgtcatgtgtcctctggaattttctgaagctttccagcttttttattacccccctaaccagctcatctgatttccagggatctctactaagatgttggcagcccggccagctggtctggccatggatgtgacttcaggggctggttatgcttcatgcacctgcttctagcttcactgttgggccagatttcatccccaccccagctctgcagcgcagctgcttcttgattcctccatggaccctgcgtgaaattaccccatgtttccctttgtgcaccactgaggaaggaagcatgaaggacacacagccattttgcagaccctggtcacagtgaaacattccatgggaactcgggctgtgagaaacatccttcctaaccacatgactgcaggaacatccttatcgcatcctcccaggcaaaggtccaacagcctgactgcagggacatccttgccgtttcctgctgggcagcaagctctaccacccagacccctccctcccatcccatgattacctcagcctgtgagcggcagttggcgctggcactaagctggttcacccctcctcagggttttgttggcaataaaagtgttgctgttgaagccgcaaaaaaaaaaaacaagggcggacgcaatagag

SEQ ID NO: 463202 - DNA, 1098 bp, Homo sapiens
ggtgtggttaggaggagcctgatcattgtgggcctggtcagtggtaggtatggggctgggcaaggtcaatcctgctggatatctagaaggtgtaaaccaaggacctaggaaaataccaggaggtagaatgcagcttgagatcaactgtccgatcaaagaacttgaacttgatctggagtgctttggggagccatggaaggtgctggataaaggaggggccagtcagatacgtgttagagatgactgtagaaggctgactggaatgagtgaacaagagcagaccagggagggagcttgtgggggaggtctggagatggcaagggagggatcctgcttggatgaacagtctccagagactgtctcaggaactcatagggagaatctgcagctgaaaggggacgccagaggagacatcactctcttgccctttgactgcgtctggatgcccctactgaccaacactaccatccccttattagactggagaggctgccgggagggtttctaagcctcctattgtggctcacctccaacaggatctctactaagatgttggcagcccggccagctggtctggccatggatgtgacttcaggggctggttatgcttcatgcacctgcttctagcttcactgttgggccagatttcatccccaccccagctctgcagcgcagctgcttcttgattcctccatggaccctgcgtgaaattaccccatgtttccctttgtgcaccactgaggaaggaagcatgaaggacacacagccattttgcagaccctggtcacagtgaaacattccatgggaactcgggctgtgagaaacatccttcctaaccacatgactgcaggaacatccttatcgcatcctcccaggcaaaggtccaacagcctgactgcagggacatccttgccgtttcctgctgggcagcaagctctaccacccagacccctccctcccatcccatgattacctcagcctgtgagcggcagttggcgctggcactaagctggttcacccctcctcagggttttgttggcaataaaagtgttgctgttgaagccgcaaaaaaaaaaaacaagggcggacgcaatagag

SEQ ID NO: 463203 - DNA, 7268 bp, Homo sapiens
cgcgcttgggcggcggaggctgcagctacctcggcgccggctcggctctaggacgtgtcgggctgcacgggtcgggggcggctccctgctgcttccgagcctagccgcctggccttcggcatttgcaggcagacacactgccctccagaaacgatgggtgtcgctagatccagctgggactctgccagcctccggcactcagtctaagagaagggccatcttccagccctgctgtccctgcctgtcatggccacattcggctgctgtctgcatgtctggggacacagggcacccagccccagccctgagaagttaagccaggccttctggctcagttccacaggggcactccagaccccaggcccctttcagagcaaaagcaactgatgctatgggagaagcccctgcccacctgtccactcgcctggcactgcccactctgagacccatgcactgggttcccctggaggtgccaaccctgtgagtccctccctgtcccctgacgctgagaaggccctgccaacccccaccatgtgtgaggtgatgcccacaatcaatgaggggggtccccctcatggcgccgatgctgacgccaacttcgagcagctgatggtgaacatgctggacgagcgggagaagttgctggagtctcttcgggagagtcaggagaccttggcggccacacagagccggctccaggatgccatacacgagcgggaccagctccagcgccaccttaactccgccctcccccaggaatttgccaccttaacccgggagctgagcatgtgtcgggagcagcttctagagcgggaggaagagatatcagaactgaaagcagaacggaataacacacggctgcttctggaacatctggagtgcctggtgtcccgccatgaacggtcactgcggatgactgtggtgaagcgccaggcccagtcaccttcgggggtctccagtgaggtggaggtgctgaaggccctcaagtcactgtttgagcaccacaaggccctggatgagaaggtgcgagagcggctccgggcagcgctggagcgagtcaccaccttggaggagcagctggcaggtgcccaccagcaggtgtctgccctgcagcagggggcaggggtgcgggatggagcggcagaagaggaggggactgtggagctggggccgaaacgcctgtggaaggtaggaggatacgggccgggtagaggagctgcaggagctcctggagaagcagaactttgagttgagccaggcccgggagcgactggtcaccctaacaacaaccgtgactgaactcgaggaggacctgggcacggcccgccgggacctcatcaagtcggaggagctgagcagcaagcatcagcgggacctccgggaggctctggcccagaaggaggacatggaagagcggattactacactggagaagcgctacctggctgctcagcgtgaggcaacatccatccatgacctcaatgacaagctggagaatgagctggccaacaaggagtccctgcaccgccagtgtgaggagaaggcccgacacctgcaggagctgctggaggtggcagagcagaagctgcagcagacgatgcgcaaggcagagacgctgccagaggtggaggctgagctggcccagagaattgcagccctcaccaaggcaagtgggccaggggcctgggatctgcctctgtcccccatgttctgagctctcagggagccaggcagggaagggagcgcgtgggaggcgcactgggccaggagccagaaaactgcttcccgccgtgtgattccagggagcacactgccttgtgcctgtcagttggaagagtaatccctgtcctcatcaccctgcagggatgtgacagtctcataagaaggggtgtaaaagtacttgaaggagaagaagctatgttgatgcaaagtgtttttctttttcttttttttttttttttaatcctctacaccgtcgtggtgaacactttctttcacttggggctggagcagaaagattaggactttcatctctggaaaggtgaaaccttagaagagaaatggtatatatatccctgaagggcaaaggggatgttttaaggctaggcctgagcgaggaggaggcaggggagacctggcaggtattgaagtacctgggaagaaaggcaatggggatggtggtcctgctccaagatgataagtggaggctgagcgtcactggtactgggggccatgatccccagggccaccctggcaccagggctgaagaacggcatggcaacattgaggagcacctgcggcagctggagggacagctggaggagaagaaccaggagctggcacgggtgcgccagcgggaaaagatgaatgaggaccacaacaagcggctgtcggacacagtggaccggctgctcagcgagtccaacgagcgtctgcagctccacctgaaggagcgcatggctgccctggaggagaagaacacgttgatccaggagttggagagctcccagcggcagattgaggagcagcaccaccacaagggccgcctgtctgaagagattgagaagctgcgccaagaggtggaccagctgaagggccgaggggggccgtttgtggatggcgtccactccaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacagacagtgaggagggcagctgggctcagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatgatccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgggtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctcccagcatcccttccccttctctcctcctctgcctcacttctttagtaatcccaaccctataaaaatgaacctaatgggtggattgaatatacattgagcccaaagtcaagtttggggaaaaggcagactaaggcctcctttctctgacctcccaggaagaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaaatctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgtacaaatggcctccagtctttttttttttttttttttttttttttaactctgaactcacctgagatttccagcttctttcacagttgtaaaggctgctgtactctggaaggaaatgtcacaattttcagaacttgtagtcaataactatttatttatataagcacaggactgatagatt

SEQ ID NO: 463204 - DNA, 6126 bp, Homo sapiens
cctcatagctgactctagaggatacacggagggccaacgcaaccgggaaggaggatacgggccgggtagaggagctgcaggagctcctggagaagcagaactttgagttgagccaggcccgggagcgactggtcaccctaacaacaaccgtgactgaactcgaggaggacctgggcacggcccgccgggacctcatcaagtcggaggagctgagcagcaagcatcagcgggacctccgggaggctctggcccagaaggaggacatggaagagcggattactacactggagaagcgctacctggctgctcagcgtgaggcaacatccatccatgacctcaatgacaagctggagaatgagctggccaacaaggagtccctgcaccgccagtgtgaggagaaggcccgacacctgcaggagctgctggaggtggcagagcagaagctgcagcagacgatgcgcaaggcagagacgctgccagaggtggaggctgagctggcccagagaattgcagccctcaccaaggcaagtgggccaggggcctgggatctgcctctgtcccccatgttctgagctctcagggagccaggcagggaagggagcgcgtgggaggcgcactgggccaggagccagaaaactgcttcccgccgtgtgattccagggagcacactgccttgtgcctgtcagttggaagagtaatccctgtcctcatcaccctgcagggatgtgacagtctcataagaaggggtgtaaaagtacttgaaggagaagaagctatgttgatgcaaagtgtttttctttttcttttttttttttttttaatcctctacaccgtcgtggtgaacactttctttcacttggggctggagcagaaagattaggactttcatctctggaaaggtgaaaccttagaagagaaatggtatatatatccctgaagggcaaaggggatgttttaaggctaggcctgagcgaggaggaggcaggggagacctggcaggtattgaagtacctgggaagaaaggcaatggggatggtggtcctgctccaagatgataagtggaggctgagcgtcactggtactgggggccatgatccccagggccaccctggcaccagggctgaagaacggcatggcaacattgaggagcacctgcggcagctggagggacagctggaggagaagaaccaggagctggcacgggtgcgccagcgggaaaagatgaatgaggaccacaacaagcggctgtcggacacagtggaccggctgctcagcgagtccaacgagcgtctgcagctccacctgaaggagcgcatggctgccctggaggagaagaacacgttgatccaggagttggagagctcccagcggcagattgaggagcagcaccaccacaagggccgcctgtctgaagagattgagaagctgcgccaagaggtggaccagctgaagggccgaggggggccgtttgtggatggcgtccactccaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacagacagtgaggagggcagctgggctcagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatgatccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgggtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctcccagcatcccttccccttctctcctcctctgcctcacttctttagtaatcccaaccctataaaaatgaacctaatgggtggattgaatatacattgagcccaaagtcaagtttggggaaaaggcagactaaggcctcctttctctgacctcccaggaagaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaaatctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgtacaaatggcctccagtctttttttttttttttttttttttttttaactctgaactcacctgagatttccagcttctttcacagttgtaaaggctgctgtactctggaaggaaatgtcacaattttcagaacttgtagtcaataactatttatttatataagcacaggactgatagatt

SEQ ID NO: 463205 - DNA, 346 bp, Homo sapiens
gacagtgaggagggcagctgggctcaggtaagactccctaccctgtctagaaccagctcccaaaacttcaggacagtgttcttctggtaggttctctccgcagcaggaatctctgagtccttcatatgaaaagccctggacataggttctctgctcccatcagagtgccccccgcccccacccagttccctcaaactgcttgttctggtttctcagggtggcaggtgaggagccctggaggactgtggcccctgcattcctggcccttctcctcagtctcattcttttcctgggaataatcagacctagattagtatgagtcttcttcctctccctgtccctctca

SEQ ID NO: 463206 - DNA, 6180 bp, Homo sapiens
cgcgcttgggcggcggaggctgcagctacctcggcgccggctcggctctaggacgtgtcgggctgcacgggtcgggggcggctccctgctgcttccgagcctagccgcctggccttcggcatttgcaggcagacacactgccctccagaaacgatgggtgtcgctagatccagctgggactctgccagcctccggcactcagtctaagagaagggccatcttccagccctgctgtccctgcctgtcatggccacattcggctgctgtctgcatgtctggggacacagggcacccagccccagccctgagaagttaagccaggccttctggctcagttccacaggggcactccagaccccaggcccctttcagagcaaaagcaactgatgctatgggagaagcccctgcccacctgtccactcgcctggcactgcccactctgagacccatgcactgggttcccctggaggtgccaaccctgtgagtccctccctgtcccctgacgctgagaaggccctgccaacccccaccatgtgtgaggtgatgcccacaatcaatgaggggggtccccctcatggcgccgatgctgacgccaacttcgagcagctgatggtgaacatgctggacgagcgggagaagttgctggagtctcttcgggagagtcaggagaccttggcggccacacagagccggctccaggatgccatacacgagcgggaccagctccagcgccaccttaactccgccctcccccaggaatttgccaccttaacccgggagctgagcatgtgtcgggagcagcttctagagcgggaggaagagatatcagaactgaaagcagaacggaataacacacggctgcttctggaacatctggagtgcctggtgtcccgccatgaacggtcactgcggatgactgtggtgaagcgccaggcccagtcaccttcgggggtctccagtgaggtggaggtgctgaaggccctcaagtcactgtttgagcaccacaaggccctggatgagaaggtgcgagagcggctccgggcagcgctggagcgagtcaccaccttggaggagcagctggcaggtgcccaccagcaggtgtctgccctgcagcagggggcaggggtgcgggatggagcggcagaagaggaggggactgtggagctggggccgaaacgcctgtggaaggtaggaggatacgggccgggtagaggagctgcaggagctcctggagaagcagaactttgagttgagccaggcccgggagcgactggtcaccctaacaacaaccgtgactgaactcgaggaggacctgggcacggcccgccgggacctcatcaagtcggaggagctgagcagcaagcatcagcgggacctccgggaggctctggcccagaaggaggacatggaagagcggattactacactggagaagcgctacctggctgctcagcgtgaggcaacatccatccatgacctcaatgacaagctggagaatgagctggccaacaaggagtccctgcaccgccagtgtgaggagaaggcccgacacctgcaggagctgctggaggtggcagagcagaagctgcagcagacgatgcgcaaggcagagacgctgccagaggtggaggctgagctggcccagagaattgcagccctcaccaaggcaagtgggccaggggcctgggatctgcctctgtcccccatgttctgagctctcagggagccaggcagggaagggagcgcgtgggaggcgcactgggccaggagccagaaaactgcttcccgccgtgtgattccagggagcacactgccttgtgcctgtcagttggaagagtaatccctgtcctcatcaccctgcagggatgtgacagtctcataagaaggggtgtaaaagtacttgaaggagaagaagctatgttgatgcaaagtgtttttctttttcttttttttttttttttaatcctctacaccgtcgtggtgaacactttctttcacttggggctggagcagaaagattaggactttcatctctggaaaggtgaaaccttagaagagaaatggtatatatatccctgaagggcaaaggggatgttttaaggctaggcctgagcgaggaggaggcaggggagacctggcaggtattgaagtacctgggaagaaaggcaatggggatggtggtcctgctccaagatgataagtggaggctgagcgtcactggtactgggggccatgatccccagggccaccctggcaccagggctgaagaacggcatggcaacattgaggagcacctgcggcagctggagggacagctggaggagaagaaccaggagctggcacgggtgcgccagcgggaaaagatgaatgaggaccacaacaagcggctgtcggacacagtggaccggctgctcagcgagtccaacgagcgtctgcagctccacctgaaggagcgcatggctgccctggaggagaagaacacgttgatccaggagttggagagctcccagcggcagattgaggagcagcaccaccacaagggccgcctgtctgaagagattgagaagctgcgccaagaggtggaccagctgaagggccgaggggggccgtttgtggatggcgtccactccaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacaaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaaggtgagtaacaggcgggctgggcatggccgaggcccagccgagcgcgggcttcttcctggcaccccagggccgggccgggtggagaggggcgaggccgaggctggtgccccgcgctcctgcgctgcagctgcactaacgctccgcggggagcgtgtgtgcgcactaacccgccgctctgtgtgttctcccgcggctgccgacttctcccagctgggacggcggggtcgcagagactggagacctccacggttcggacctactcctgctgaccccccatcctcccgccccgggtctgacgggggagtgcccgtggctcggggtaagtgggccaggcccggggacgcgggcaccttgctgctggccctcggccccacgcacctgcccttggctgccggcctggccctgccgctccagtcccgcttaccagcactgcctggcttgccccttcctgcttcgtctggcctggggcgctttgcgcttggagcacgctgcgttgccgctgtcgcacacatcctacaacctctctccagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaaatctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgtacaaatggcctccagtctttttttttttttttttttttttttttaactctgaactcacctgagatttccagcttctttcacagttgtaaaggctgctgtactctggaaggaaatgtcacaattttcagaacttgtagtcaataactatttatttatataagcacaggactgatagatt

SEQ ID NO: 463207 - DNA, 3332 bp, Homo sapiens
  misc_feature (4)..(5): n is a, c, g, or t
  misc_feature (12)..(12): n is a, c, g, or t
  misc_feature (14)..(14): n is a, c, g, or t
  misc_feature (17)..(21): n is a, c, g, or t
ctcnncctctcncnctnnnnnatacatgattaaaccactgcaaacaaaggtctgtggaggatgctttgtccatactgcctggttcacttcacattacataaatcacggcgcagagctaccagcctaaaccacctctgttatcttcatttctctacagatttgcctttctttcaaacccactatcccattttcttctgtggccccagacagctgtctttgcagcacaacagacagcagtcactgcagctttgctttgagcatgttctacagaagtccacatcccttgcagttgcctttcctggatcatgggaccccatcacagtgagctcttccctatctgcaggtagaggactaagaattatacatttgctgggggcactgccatgtatactcactttacttcccattttactaaactgtattctaattttattcatttccctgtttagatttaaaacgttcagtaaaagcacagaaagtaaaagtagtataaaggcaagaccagtgaatgaaaaacaactcagaaattgaccacaaattcagtgctactttatatgacaatcccttctatctttaatagtattaatcaaatgtcttaaatcatttataaagaacagtctcttctaactactgtgaaaaacatgtgagggatgcatattaccagattaacctgagttatccaatgtgacattgtcatgagactgtgatttggactgtcatctatatcaacttcttaaggcctccattttttatacagttaaatagacactaacaaaggtagccaatacataaaattttatgtccagaagaattttaatgacaaacagatgctaggaaaacaattcctgccctggttacttttgtgtgaggatataatgtgcttaaaagcaagaaagacaataagctatttgtaaaatataattttttataatttcatggtgttctgattttaataaacacaaataaatttattaatctttgctgtctaatgaaaattattcacatcctgttgtttagtaaaatcattaaatgagaatatagctaatacaaacttttatttgtagaaagagaaaaacatagcagcatagcaaaatatacttgcattttgtataagcttcaaacaccacaaagtccattgaacgtttaataattatgcatatttcatttgttattttcataatgtataacatataaaagtactttactgaatatgagaaagactcagggagagagtctgaataacaaaaagaggaaatataggaaggaaagggaaagacaaagaaggagggtgagacagagaagagagaacaaacatccaggagtagtgatgtgaattatttgcttagttaccacaaaagtaataattacactaactctgtgggaacaatggtaatttcacagtagctcacgttactgttatcaccttatatcctgataactgtgaaattaatttgtggcactactgtatgtgtcggccataagctgttcccttggtaacagtattatgctaccatagagaaggaatgtttggcagtaaaatgggcagcagcaagctgattacacagggaaaagcttctatctaaatacacatagcataacaatcacccctggaaaaactacatggcttaccaaaagaggtctctctgttcactgtccattatctgttgactgaactagttcaaatgaataacaagtaatgatcaaattgccagtttatattttacaacagagtcttatctttaaaaaaatgcaaggaggaaatacaaaaatgtaatacatttatcttgctttcttttctatttcctcccctgaaattattactatgctattggaagccatacaaacacatatatacacaaatatacatatgcttcaatgaaaagcaggcatgcagctgacagctcggcaaccctgagcacagaattttgaagagagaatacactaaaagggaagaacataactacatgacatcataagaagtcctgaattagaagcgtatatttgaaaggtcatgcatcctgagctgccaacagcttaacaaccagaggcagaggccagctttgccagctcactgcttctactcatctttcatgatagtagccaggctgaatatagttccaggatgataatgaattggctgggcatactgtttatattagtatgtatgttcctgtactaaaccaagcatcatgaggccagcactattttgccatttttcagaaaaaaaatatgaacccttcaaaacatagtaagccttttttaaagtatatatttgattttgaaataatcaaaatatatgtagggatatgactgcatcctaagatttatgataagttctgatgagtaatattttctttctacatgcaaggcaaagttaatagtaactagaaagtctttatttggcatatcatagatttctgtcaaccaaaacaactaactctggggaacataacgttctgacaacttcagaagagttaagtcacagacaaaagtttattggatcttagttggctcctacccaccaattctttcttttccaagtggaacataatagattttcaatatttgttaaataattgaaaaaatatcctcaaaattcttttttggccatcttcccaacaagaatatggtcctaacctatatgtagagtcctttgctgtgtcatctatttcttcagaattattctcctaattcatatgtctggatagtctctctgaattgttatagaaaattaaaaatgtgaactatgaaattaatttttaaacttttataaccatctagtcatacacagaataaccacaaatataaacatggtttcaaagaattccctgtgacaatcaagcaaatagtgaaatagtttctgctattatgaatttatcacttactcagtgtatgaccatgggcaaatatcttcacctcaatcctgtgaggcaggtactattattctacccattttaagtatagatttgcaatatttgttaaatattcaatatttgttattataaaatgagtatactaatagtacctacctcacagtattgaggtgaagatatttgtccatgtacgtacaatatgggcataataatagtacctacctcacaggattgttattaagaataaataagataatccatacaaagtatttaacacattattgaaaaattaaatgatcaaaataaagcttgttgttattgttatcttttaataaatgcatctaaagtatttttaaatgtattcacttcagttatttaaagtttcatctgctgtatcacagagcacatatatgttcagaaacatttgttaagtatctatgtaccagataataaaggtgg

SEQ ID NO: 463208 - DNA, 1038 bp, Homo sapiens
agtgggtgcttttccttggcactgacactactgctagaccacggtccgcttaggtcacgggcatcttcccagatgctggcgttactgctagaccaaggagcccttgtcttctgggatgtgtcgtccttcattaaggtagcttatccaaaccagttcccaaatggtataaaaaagcctctaccaaaaggagggaggcttagcctgaaagaagacaggaaaaacaggcaggaaaaaacaagctgtgaaagaaagcaaggagctcaaagggctcaaaggcacatacaatgtgacagctttgaagggcagagggtcttgacattgactctccacaatgatatggagatcagtgtgttggcaacttctagcgtcagtgcagctctccttacctgcacagctagagacacagacaatattggcaatacagtattcttgtgggatttgtttgcttccagcataacagatgaatttttctccagcaaacacaacaattcattttcaacaggcaccagttcctcctaaatatggatgattcaccacgtctcagtgtgggttcccccaggagcagaacttaagacaaagatttcagtgcacgtagtttatttgggacttgatcccaaggagactggaagcattggtcaaggagggacagaatgggacagggaacagggagaagacaaaataaggatgtgttgccaagtgagttacactgcagatgactggtgcttactcccatgacagaactctggggagccacgtcgaacatggacctcagagttacacagccaggggataacggaactgaggcatgcattctccagtccagtcagtagtagaaggcttttctgcggtggggaatggaacccaggccaagtgggttctagctgcagagaaggggatacacaaccttaggtaagagggtgcacatcccagccattggatgtggggctggaggaagtcattcggctgggctcctaccgtttatacttattataccgttacggtcagtaagagacaggtggtgatgacgttgtcagttaa

SEQ ID NO: 463209 - DNA, 1557 bp, Homo sapiens
agtgggtgcttttccttggcactgacactactgctagaccacggtccgcttaggtcacgggcatcttcccagatgctggcgttactgctagaccaaggagcccttgtcttctgggatgtgtcgtccttcattaaggtagcttatccaaaccagttcccaaatggtataaaaaagcctctaccaaaaggagggaggcttagcctgaaagaagacaggaaaaacaggcaggaaaaaacaagctgtgaaagaaagcaaggagctcaaagggctcaaaggcacatacaatgtgacagctttgaagggcagagggtcttgacattgactctccacaatgatatggagatcagtgtgttggcaacttctagcgtcagtgcagctctccttacctgcacagctagagacacagacaatattggcaatacagtattcttgtgggatttgtttgcttccagcataacagatgaatttttctccagcaaacacaacaattcattttcaacaggcaccagttcctcctaaatatggatgattcaccacgtctcagtgtgggttcccccaggagcagaacttaagacaaagatttcagtgcacgtagtttatttgggacttgatcccaaggagactggaagcattggtcaaggagggacagaatgggacagggaacagggagaagacaaaataaggatgtgttgccaagtgagttacactgcagatgactggtgcttactcccatgacagaactctggggagccacgtcgaacatggacctcagagttacacagccaggggataacggaactgaggcatgcattctccagtccagtcagtagtagaaggcttttctgcggtggggaatggaacccaggccaagtgggttctagctgcagagaaggggatacacaaccttagggagatgccatccgcctcagtgtgtgccctaagaaattaaagagatgccaggaaggaaaagtattaatgaggagtacaaaattctactttagaaaacatcttggccggatgcagtggctcatgcctgtaatcccagcactttgggaggctgaggcaggtggatcgcctgaagtcaggagttcgagatcatcctggccaacatgatgaaaccccgtctctactaaaaatacaaaaaatttgctgggcatggtggtgcatgtctgtaatcccagctactcgggaggttgaggcatgataatcacttgaacccgggagaaggaggttgcagtgagctgagatggtgccattgcactccagcctgggcaataagagtaaaactccatctcaaaataataataaataataataataataataaccacggatttttgcaaggctacagagaaaagggaatgcctatacactcttggtaagaatgtaaattagttcagccactgtggaaagcggtttgaagatttctcaaaaaacagaactatcatgagacccagcaatcccattactgggtgtatacccaaaagaaaataaattataattattctacccaaagacacatacactaatatattcacaatagcaaagacatggaat

SEQ ID NO: 463210 - DNA, 3846 bp, Homo sapiens
  misc_feature (1)..(1): n is a, c, g, or t
  misc_feature (4)..(5): n is a, c, g, or t
nccnncccagcggggcagcttctgaggcagatgaggagcagcagggaaagtcgtggcctggtgttccctgtcgcagtgccccaactcattcctgtggatgtctaaacttgcccaaaggcaaaactcaatgtctctggctccagtcgattttgaatgtgtttcagaggaaaatttggttggtaacattgaagagacacttctcacctgcctgaaatgcccttcattatcttttcaggttgcaagggctctggaacagcccttgcagtactcacataaagagctggtttatagtgaggggcagcagcaacttcaagagggggaggatgcgaccatgagtccccgccccagacccaggagccttgaccttggggctgccgtagcagtggatgctcttcagctggatgacctgtcctgggccagtgaccctggacttcagccatatttcagcatctcaaggtacagtatgccaacacctcagctccatgttgagtcaaagcagttaacacagccaaggtattcagaggacactaatgataacagtagctactgactatttcctggccagctggggaaataaagaagtaagtttaataagtcttctaaatttgtccttgccattgtgataaataactttatcttgacaattaattatattatggcaaattaattataacttgccataatgataaataactttatcctgagtagagcagcgacacaagccctttaggacacatgcctgaggcaatgacagtctaactttgaaacagtggaagacctagtttcaaattcaagtttgctttgagtagaaattaactttacctctttttgcatggcaatggggccaatcttccttaagctgctccttaaaagaaaaggaatcatactgctaagaattcagacttcagcagacatggggagcattgggaggagcccgaatcactgatggaattgaacagtgcgtggagacggttcagcaggacaaggtccctggctccacctcttctgccacaaacatcagcatggtggtgtctgccagcccttcatccagtgtgagaagacagagatgaacactggagaaatcaacaagaaattgcgcccccagccggcagagaacaaacagcagttcagaaacataaagagaaatttcttgtaactcaagtggcctaattcctggccaaccagcagaagaaataccagtatgaagaattcaaagacctcataaaatctatgctgagggatgagctgcaattcaaggacgagaagcttgcagagcagcttgggcaagctgaggagctcaggcaatataaagtcctagttcactctcaggcacgagagctggcctggttaaggaagagattacaggaagggagagatgcctcccgctcattgaatcagcatctccaggccctcctcactccggatgagcctgacaactcccaggggcaggatatctgagagcagctggctgagggctgcaggctgacagagaacctcatccacaaactcagcccaggccggcaaattgtctcttgcaagtgtctttagcattcaaatgtgggaacacttaacgactgcttttcaaaatgagatgaagctccttgccgtgtggtgttggagaaggcacttgatgtgggggcatttggtggtaggagtgcttcagactggagtactctccatggagagaatgtccctgaataacacagcagaagccacttggtgggcctgtgaagtcccctgatggacagaggactgtgggacaagtttgtcctctcctaagagaaagaattagtttcgaaatgtgaactgtgacaggacaccaagcctgtgcctgggaatcagatctgtggcaggatggcggagacagctgccaaagtccagagagaggctggacaagtctccagggatatggggaccaaaagatgttttcaatatttggccacatcttgatggtggccctccagatcagaaatgcattgcctgatggattaggaaactgtgccagggcattttgttaaagataaaacatgagagctttcagttgaatggtgacccatgcctagatgttcatgtgtctgcacacattgggctgactatgcttgcagaatgtgaagtgagaaatatctgaatgaacattcctgtatttacagaaaatgatgaagatgtggatgacgatgtttacgttgaggaggctgagaaagtgcgggaatcacgtgcccccaggtaacactgaataatcaggagcaataatgggtggtaacatatgaaaaagatctaggaggcacactctctctggcgtctacattgggccaaaagcctgcattcccctggccacaatatgttaaattcaacccagcttagacacagggtgtggcagctgttatggttctctgtgtgtgctgagtgtcatgtctgtaccatacagggatagctgagtctccatcctcctcagctcctatctgcccagtgcaatgaacaccagctgctgtcttcctctttggctcccatagcagccatgctctgttgcagagagtggaggagtgcctgttccctcttaaagggaacctcctgtttgctttctgggaccactctcttatgcttcctgtcaaaactagctaggactccctgaggtccaatccctctctgtttaatcttctgttatgtctgtgtcacctggctcatcagggaggtgcgaagcctgaagagaaggaattgatgaaatgatcatacagatatgtatattgcatatatctatgcaatatacatattgcatcaatatcccatgatattgccggctcaatgaggacagagtcctctctctattatgatttggatttgaagggaagatgccatgggtcctaaacatcgcagcatgaccagcgtgtgctgcccacgacctgcagtgccatggtcaggtggaagtcattttacttcagtagaggacagtgttctcttctgaccttttcctcagtggctagatctgtatctctctctctcttctcccatctgccctccgttccctgccccgctttgttttttctctctgttcccaccctgctggccccttccacctgttttcttttcttcagctttcatcgttcacccccctctgcccacccatatgccccaggctaagtcccctgcacattcctggggaggggcgtagatgtgtatggttttaggcagtgccctctagatgtgtccatgatggggaaacatggctcagctgccagtataatgctttaaaagagtggccacttttgaaggccttttacatctaggatcctctatgacttaaaatatatgggccacattggaattccttgttccccaggaccttgcagtggatgccttctttcactgagcattcacagggtgcctattaggtgccaggccctgctctgggctaggggctccattgtgagcaatcctcagttcattgccacatggagcccacctctgcaggcatcaagagggtggggccgtcaaccacatctaccagtgctaagcatcaaggacaatgaaggctgagaatagcctgctggatttggctatatggtaggtaaggacttgtttgattctggggaaagcaatttcagcaatggggaggagaaagcagccttgttgcagggagctgaggatgcttagtagtgaggagatgaggagaacggtgagctagcatttatgaagcaacctttgcttcctatgtgataattacacttttcccaactttcagatttgtgtttcttcccttgccagaagttagtctctttacagactggacttgcaactttccggagtcattgtctttgcttgcattcctaccagaatccctagtgactctgc

SEQ ID NO: 463211 - DNA, 4097 bp, Homo sapiens
  misc_feature (1)..(1): n is a, c, g, or t
  misc_feature (4)..(5): n is a, c, g, or t
nccnncccagcggggcagcttctgaggcagatgaggagcagcagggaaagtcgtggcctggtgttccctgtcgcagtgccccaactcattcctgtggatgtctaaacttgcccaaaggcaaaactcaatgtctctggctccagtcgattttgaatgtgtttcagaggaaaatttggttggtaacattgaagagacacttctcacctgcctgaaatgcccttcattatcttttcaggttgcaagggctctggaacagcccttgcagtactcacataaagagctggtttatagtgaggggcagcagcaacttcaagagggggaggatgcgaccatgagtccccgccccagacccaggagccttgaccttggggctgccgtagcagtggatgctcttcagctggatgacctgtcctgggccagtgaccctggacttcagccatatttcagcatctcaaggtacagtatgccaacacctcagctccatgttgagtcaaagcagttaacacagccaaggtattcagaggacactaatgataacagtagctactgactatttcctggccagctggggaaataaagaagtaagtttaataagtcttctaaatttgtccttgccattgtgataaataactttatcttgacaattaattatattatggcaaattaattataacttgccataatgataaataactttatcctgagtagagcagcgacacaagccctttaggacacatgcctgaggcaatgacagtctaactttgaaacagtggaagacctagtttcaaattcaagtttgctttgagtagaaattaactttacctctttttgcatggcaatggggccaatcttccttaagctgctccttaaaagaaaaggaatcatactgctaagaattcagacttcagcagacatggggagcattgggaggagcccgaatcactgatggaattgaacagtgcgtggagacggttcagcaggacaaggggcgcctgtgtttcagcaaagcctgggcaattggaacgcagggctcctaagattccatgacacccccaccttctaattctgttattgcaactgcagaccgttacctggcatgctggctgccacctccctcactcttgtcagagtctgagctacaggcagtgccttcagctctgagctcaggcgtctcaaaccttgtttttgcgattaaggactctcaagtgctgtggggagtgatcacgtttttctcaacatccctggctccacctcttctgccacaaacatcagcatggtggtgtctgccagcccttcatccagtgtgagaagacagagatgaacactggagaaatcaacaagaaattgcgcccccagccggcagagaacaaacagcagttcagaaacataaagagaaatttcttgtaactcaagtggcctaattcctggccaaccagcagaagaaataccagtatgaagaattcaaagacctcataaaatctatgctgagggatgagctgcaattcaaggacgagaagcttgcagagcagcttgggcaagctgaggagctcaggcaatataaagtcctagttcactctcaggcacgagagctggcctggttaaggaagagattacaggaagggagagatgcctcccgctcattgaatcagcatctccaggccctcctcactccggatgagcctgacaactcccaggggcaggatatctgagagcagctggctgagggctgcaggctgacagagaacctcatccacaaactcagcccaggccggcaaattgtctcttgcaagtgtctttagcattcaaatgtgggaacacttaacgactgcttttcaaaatgagatgaagctccttgccgtgtggtgttggagaaggcacttgatgtgggggcatttggtggtaggagtgcttcagactggagtactctccatggagagaatgtccctgaataacacagcagaagccacttggtgggcctgtgaagtcccctgatggacagaggactgtgggacaagtttgtcctctcctaagagaaagaattagtttcgaaatgtgaactgtgacaggacaccaagcctgtgcctgggaatcagatctgtggcaggatggcggagacagctgccaaagtccagagagaggctggacaagtctccagggatatggggaccaaaagatgttttcaatatttggccacatcttgatggtggccctccagatcagaaatgcattgcctgatggattaggaaactgtgccagggcattttgttaaagataaaacatgagagctttcagttgaatggtgacccatgcctagatgttcatgtgtctgcacacattgggctgactatgcttgcagaatgtgaagtgagaaatatctgaatgaacattcctgtatttacagaaaatgatgaagatgtggatgacgatgtttacgttgaggaggctgagaaagtgcgggaatcacgtgcccccaggtaacactgaataatcaggagcaataatgggtggtaacatatgaaaaagatctaggaggcacactctctctggcgtctacattgggccaaaagcctgcattcccctggccacaatatgttaaattcaacccagcttagacacagggtgtggcagctgttatggttctctgtgtgtgctgagtgtcatgtctgtaccatacagggatagctgagtctccatcctcctcagctcctatctgcccagtgcaatgaacaccagctgctgtcttcctctttggctcccatagcagccatgctctgttgcagagagtggaggagtgcctgttccctcttaaagggaacctcctgtttgctttctgggaccactctcttatgcttcctgtcaaaactagctaggactccctgaggtccaatccctctctgtttaatcttctgttatgtctgtgtcacctggctcatcagggaggtgcgaagcctgaagagaaggaattgatgaaatgatcatacagatatgtatattgcatatatctatgcaatatacatattgcatcaatatcccatgatattgccggctcaatgaggacagagtcctctctctattatgatttggatttgaagggaagatgccatgggtcctaaacatcgcagcatgaccagcgtgtgctgcccacgacctgcagtgccatggtcaggtggaagtcattttacttcagtagaggacagtgttctcttctgaccttttcctcagtggctagatctgtatctctctctctcttctcccatctgccctccgttccctgccccgctttgttttttctctctgttcccaccctgctggccccttccacctgttttcttttcttcagctttcatcgttcacccccctctgcccacccatatgccccaggctaagtcccctgcacattcctggggaggggcgtagatgtgtatggttttaggcagtgccctctagatgtgtccatgatggggaaacatggctcagctgccagtataatgctttaaaagagtggccacttttgaaggccttttacatctaggatcctctatgacttaaaatatatgggccacattggaattccttgttccccaggaccttgcagtggatgccttctttcactgagcattcacagggtgcctattaggtgccaggccctgctctgggctaggggctccattgtgagcaatcctcagttcattgccacatggagcccacctctgcaggcatcaagagggtggggccgtcaaccacatctaccagtgctaagcatcaaggacaatgaaggctgagaatagcctgctggatttggctatatggtaggtaaggacttgtttgattctggggaaagcaatttcagcaatggggaggagaaagcagccttgttgcagggagctgaggatgcttagtagtgaggagatgaggagaacggtgagctagcatttatgaagcaacctttgcttcctatgtgataattacacttttcccaactttcagatttgtgtttcttcccttgccagaagttagtctctttacagactggacttgcaactttccggagtcattgtctttgcttgcattcctaccagaatccctagtgactctgc

SEQ ID NO: 463212 - DNA, 1318 bp, Homo sapiens
gattgccacaaggttgcagggaatggggagtgactgctagtgggtactaggtttctttctggggtgatgaaaatattctaaagttgattacgtggtgatgattgtacaactctgtgccttttgggctttaaactctgcatccttccagtgtcctgggaagagtaccagccctgggaggggaggccctgaggactttgtcaatgatgatggtggtaatgatggcagaaataattcagtggttgcatactacgtgccaagcactgttgtaagttctttatatggcacctcatttaatttccccaacaactctgtgaagaaggtccactattctccccagaacttcacagacaacattggaaaggccctggacatcctccatgctgaggttcctcgggcatttgtgaacctggtgacggtgcttgagatcgtcaacctgagggagctgtaccaggagaaaaaagtctactgcccaaggatgatcctcaggtctctgtgtccctgtgtcctgaagtttgatgataactcaacagaacttgctaccctcatcgaattcaacaagaagtttcaggagaagacccaccaactgattgagagtgggcgatatgacacaagggaagattttactgtggttgtgcagccgttctttgaaaacgtggacatgccaaagacctcggaaggattgcctgacaactctttcttcgctcctgactgtttccacttcagcagcaagtctcactcccgagcagccagtgctctctggaacaatatgctggagcctgttggccagaagacgactcgtcataagtttgaaaacaagatcaatatcacatgtccgaaccaggtccagccgtttctgaggacctacaagaacagcatgcagggtcatgggacctggctgccatgcagggacagagccccttctgccttgcaccctacctcagtgcatgccctgagacctgcagacatccaagttgtggctgctctgggggattctctgaccgctggcaatggaattggctccaaaccagacgacctccccgatgtcaccacacagtatcggggactgtcatacagagaaagtaaaccagggttcttatcagactcctgggtcagcaaatccaacaggaaatgcaccagaaaagcaccaaatccctgaatcttcacctccccgcttgcatgtatacgtgtacacgtggtgttcctacgtctctgtttactgtctttatgtgtttattcatgttgtcttgtagtcacacagctgcctttacatatatgtacacatctgcacagaaaacctctgaaacccatcgcacacttc

SEQ ID NO: 463213 - DNA, 2188 bp, Homo sapiens
ccaggcggtgcgcttcggacccagccagggcatgtgctcggaggcccgcctggctcgcaggttgcgggatgcgctgcgggaggaggagccgtgggcagtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgttcgatctgtcgaggcactgacgccgctgcatgtggccgccgcgtggggctgccgccgcggcctggagcagctgctgagccaaggagcggacccggcgctgcgcgaccaggacggactccggccgctggacctggccctgcagcagggacacctggagtgcgcgcgagtcctgcaggatctcgacacgcggaccaggacccggacccggatcggggcagagactcaggagcccgagcctgcacctggcaccccaggcctctctggacctaccgatgagacgctggactccatagcactccaaaagcagccatgcagaggtgacaacagggacattggcttggaggctgacccaggaccccccagcctccctgttccccttgaaactgtggacaaacatgggagctcggcgtcccctccagggcactgggattacagctcagacgcctctttcgtcacagcggttgaggtctctggagctgaggacccagcctcggacactcccccctgggctgggtcattgccaccgaccaggcagggacttctgcatgttgtccatgccaaccagagggtacctaggtctcagggcacggaggcagaactgaatgcccgtctgcaggccctgactctgaccccaccaaatgctgctggcttccagtcctccccttcctccatgcctctcctggacaggagtccagctcatagccccccacggacaccaacccctggagcttctgactgccactgcctgtgggagcaccagacatccattgatagtgacatggccacgctctggctgacagaggatgaggcaagctctacaggtggcagggaacctgtcggcccttgccggcacctgccagtctccactgtgtctgacttggagttgctgaagggactccgagcacttggtgagaatcctcaccccatcacacccttcaccaggcagttgtaccaccagcagctggaagaagcccagattgctcctggcccagagttttcagggcacagcctagaactggctgcagccctgcggacgggctgtattccagatgtccaggcagatgaagacgcgctggcccagcagtttgagcagccagatcctgccaggaggtggcgggagggggtcgtgaagtctagcttcacctatctgctgctggaccccagggagactcaggacctgccagcccgagccttctcactgaccccagctgagcgccttcagactttcatccgtgccatcttctacgtgggcaaagggacgagggcccggccatatgtccacctctgggaggcccttggtcaccatgggcggtcaagaaaacaggcctgccccaaggtgcgtcagatcttggacatctgggccagtggttgcggtgttgtgtccctacattgcttccagcacgtggtcgctgtggaggcttatacacgggaggcgtgtattgtggaagccctagggatccagacgctcaccaaccagaagcaagggcactgctatggagtggtggcaggctggccacctgctcgtcgccggcgcttgggggtgcacctgctgcaccgtgccctccttgtcttcctggctgaaggcgagcgacagcttcatccccaggacatccaggcccggggctgagtgctggggagttggccatccagcctggggagaaatgtttgaatgttccagctgccccatgctgacagcagcccccatctctggtttcagaaggggtgtgtgtgtgtgtgtgtgtgtgtgtgtgtgtgtgtgtgtgtgtttgtgtgtgtgtgtgtgtgtgtagggagcacccaggcagatctcccccaggctgagagaggactttgttacagatggtactgctggagaggtagtaagtagtgagctccccatcgtgggaggaggacaagaagggaagcagaaggtgctttggaacagtccggtgcttctgtaagaggc

SEQ ID NO: 463214 - DNA, 462 bp, Homo sapiens
cagcggctgccacggagctcgcagctgcggcttctgaggagtaagcggcgcggtagcgaaggccgccgaacctgcctggctagccggcgacttgagtgacgaggcagtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgttcgatctgtcgaggcactgacgccgctgcatgtggccgccgcgtggggctgccgccgcggcctggagcagctgctgagccaaggagcggacccggcgctgcgcgaccaggttgggaggcactgcgcgggcaaagaaaggctgggtgagcccagagggagggaaggaaggtaagagggcctcgggcgccccctgctgaccgcgcccctgta

SEQ ID NO: 463215 - DNA, 2197 bp, Homo sapiens
cagcggctgccacggagctcgcagctgcggcttctgaggagtaagcggcgcggtagcgaaggccgccgaacctgcctggctagccggcgacttgagtgacgaggcagtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgttcgatctgtcgaggcactgacgccgctgcatgtggccgccgcgtggggctgccgccgcggcctggagcagctgctgagccaaggagcggacccggcgctgcgcgaccaggacggactccggccgctggacctggccctgcagcagggacacctggagtgcgcgcgagtcctgcaggatctcgacacgcggaccaggacccggacccggatcggggcagagactcaggagcccgagcctgcacctggcaccccaggcctctctggacctaccgatgagacgctggactccatagcactccaaaagcagccatgcagaggtgacaacagggacattggcttggaggctgacccaggaccccccagcctccctgttccccttgaaactgtggacaaacatgggagctcggcgtcccctccagggcactgggattacagctcagacgcctctttcgtcacagcggttgaggtctctggagctgaggacccagcctcggacactcccccctgggctgggtcattgccaccgaccaggcagggacttctgcatgttgtccatgccaaccagagggtacctaggtctcagggcacggaggcagaactgaatgcccgtctgcaggccctgactctgaccccaccaaatgctgctggcttccagtcctccccttcctccatgcctctcctggacaggagtccagctcatagccccccacggacaccaacccctggagcttctgactgccactgcctgtgggagcaccagacatccattgatagtgacatggccacgctctggctgacagaggatgaggcaagctctacaggtggcagggaacctgtcggcccttgccggcacctgccagtctccactgtgtctgacttggagttgctgaagggactccgagcacttggtgagaatcctcaccccatcacacccttcaccaggcagttgtaccaccagcagctggaagaagcccagattgctcctggcccagagttttcagggcacagcctagaactggctgcagccctgcggacgggctgtattccagatgtccaggcagatgaagacgcgctggcccagcagtttgagcagccagatcctgccaggaggtggcgggagggggtcgtgaagtctagcttcacctatctgctgctggaccccagggagactcaggacctgccagcccgagccttctcactgaccccagctgagcgccttcagactttcatccgtgccatcttctacgtgggcaaagggacgagggcccggccatatgtccacctctgggaggcccttggtcaccatgggcggtcaagaaaacaggcctgccccaaggtgcgtcagatcttggacatctgggccagtggttgcggtgttgtgtccctacattgcttccagcacgtggtcgctgtggaggcttatacacgggaggcgtgtattgtggaagccctagggatccagacgctcaccaaccagaagcaagggcactgctatggagtggtggcaggctggccacctgctcgtcgccggcgcttgggggtgcacctgctgcaccgtgccctccttgtcttcctggctgaaggcgagcgacagcttcatccccaggacatccaggcccggggctgagtgctggggagttggccatccagcctggggagaaatgtttgaatgttccagctgccccatgctgacagcagcccccatctctggtttcagaaggggtgtgtgtgtgtgtgtgtgtgtgtgtgtgtgtgtgtgtgtgtgtttgtgtgtgtgtgtgtgtgtgtagggagcacccaggcagatctcccccaggctgagagaggactttgttacagatggtactgctggagaggtagtaagtagtgagctccccatcgtgggaggaggacaagaagggaagcagaaggtgctttggaacagtccggtgcttctgtaagaggc

SEQ ID NO: 463216 - DNA, 208 bp, Homo sapiens
  misc_feature (5)..(5): n is a, c, g, or t
gcggnccggaaggtagctgtactgagagcaccatccgccgcacaagtgaacctcatgggaatggggtttggagcagccctgcccctcgctgtgaacttcctgttggtgctggttcacatgatgctcttatagttggtaagttttatgaagtgtttgctgaggaattctgtcatctttaacagtaacgctaccttacttataatgaatg

SEQ ID NO: 463217 - DNA, 222 bp, Homo sapiens
ctagaggagtccccgcgaaaggtgaagcgtgttatctgagagcaccatccgccgcacaagtgaacctcatgggaatggggtttggagcagccctgcccctcgctgtgaacttcctgttggtgctggttcacatgatgctcttatagttggtaagttttatgaagtgtttgctgaggaattctgtcatctttaacagtaacgctaccttacttataatgaatg

SEQ ID NO: 463218 - DNA, 491 bp, Homo sapiens
cagaagggaagcagtactcaataaaatcaatttggatattttatggtgagtattatggtgaagaacattcaatacctgaggaaactcaagtatccaacaaactcaacccttacagagacacatagagctgaaaataaatatataaataaacttaggaaaaacacaaaaatcttttgtccaaatcctccagctatccttaatgggagacacacaggaactccccctggagatattccctatggaaaagaagtatcttacacatgtgacccccacccagacagagggatgaccttcaacctcattggggagagcaccatccgccgcacaagtgaacctcatgggaatggggtttggagcagccctgcccctcgctgtgaacttcctgttggtgctggttcacatgatgctcttatagttggtaagttttatgaagtgtttgctgaggaattctgtcatctttaacagtaacgctaccttacttataatgaatg

SEQ ID NO: 463219 - DNA, 1001 bp, Homo sapiens
gcacccaaggaagcagctgtgaacagcagaaagaggatgagaggattggggaagacctcggtttctttcctgttgcttcataaaatgtcagggctggacagcactggctacagacaggaatcagagggtccagagcttctaccagggcacctcaggaatcgtgcctgggacatggggacgctctgtccccattctaccagaggagcttctatgttgcctcattttttttttttgtatactgggcattcatgtgagatttcatttggaaagattttgctactgaaaaaaacttaaaaacagtcagcttggttcagagtttctgcagatgaaggagaagggtctggtgagcatccagcgcttggcagcctgtcactcagaggtcctcaccgggaagctgcacgacgtgtgcttggtggtgactggggaggtcaccaacctgcggtccaaggtgtctcacctggccatcagcaccttgggagacctcttccaggccttgaagaagaatatggaccaggaggccgaggagatcgcccgctgcttgctgcagaagatggcggacaccaacgagttcatccagagagcagccggccagtctctgagggctatggtggagaatgtgacccttgcccgctccctggtggtcctcacctcggcgggtgtctattcagttcagcaaacatgcattaagctcctgccaagcaccagggatgtgtcaggcacagcagggcaccaccggaaccccttgatccggaaatacgcggctgagcacctctcagctgtgctggagcagatcggcgctgagaagcttctctcgggcaccagagacagcacagacatgttggtgcacaacctggtgaggctggcacaggactccaaccaggacaccagtgacctggatgagattggagactattactctaagtgaaataactcaggaatggaaaaccaaacatcgtatgttgtcactcataagtgggagctaagctatgaggatgcaaggg

SEQ ID NO: 463220 - DNA, 1853 bp, Homo sapiens
attctccttgctaatctccacacgcagaaactgaggctcagaaaggctgaggcacttgccagggcgcacagccatacctatcctccaactctcctgacccaaggaccacagtcacatgactatctgtgcaggctgcaggattgtccctctggtggtgcaccgggagtcccaggaactccccttacaccccgccctgcgtgcgccttggcggagccttccgcgccagtccaggctgttttatgtatcccaggggccccaggaagaggagacagtggtcttccctgaactccgagacctgccccggggccctgccggtgtgcaccttgccgtccatgttggcaatgctgcagttgcactcggtggcgccgtagaactccccgatttggcgtacgccgaagcgctccgtgaactcctcccagatggcaggacgcagcccgttccccaccgccaggcgcacgcggtgtcgcctctccgcctcgcgcaccggctgcttcagcaggtagcggcagatctccccgatgtactgaaccacctgggggacgggggactttgcacatgctagccttttgcctgaagcagtcttcccccagatgcatttgcctgaactcttcagtctcagctcaaacgtcactgagaggcatcccctgtgcccccagctgtgcccctgagaaggggctgggggtggagggatggggagtaactggggatgggatttcctttggggggcatgagaatgttctggatctagatagacatggtgattgtacattgtgaatgccaccaaattactgactttttttttttttaaagatggaatctcactctgtcacccagactggagtgcagtggcccgatctcagctcactgcagcctccgcttcccaggttcaagcgattctcctgcctcagccttccaggcagctgggattacagattagtaattttcccaagaccctccaaacagaaccaaaactcctcaaaagcgaagccaagcacagctgtggaccttgtggtataccccaagatgctcagcccagagcccccaacccctgctcagctgtgtgacctggcctgaatctctctgggccccatctgtccaatctgcatctgccaacttgccacagtccctggacaacctctcacccaatccttcccagtcagccttgctattccctccgggctccatacctgtttcctgtacctcccgcctgtatttcctgtatcctgccccacattacagcactgaaaccctcagcctggtctcctctcactgtggaggggaaagaagaattcctgttcttaacctctgcctgctctcctctccgggacagcagatgcctccacctccgcctcacgcgttcctcacctggaagccccagactcatcgcccttcccatcccagggtctcaattccctacagtcagcagcagggaagacccacagggcacaaggcatggggaaggcattgccttaaggagctcaggcaccctgggcccaatcctagccgcattacaagccttagtttccccagctgcaaaatgggtccaccctccaaagttataggattgcattgagtttacacgtggagggtttagctctggtctggacacagagcaggtactcaggaaacactacttgccctctctgtccccatcctgaacagccattccttaagccccgctccccaccccacccctagagacgggggagcaggttgcgccagcaggtggacaggagggcgcacataagggagttaagggaatagagcctggtcggggggcggggcctggctgggagaggacgggacctgaccaggaggaggtggggctttgctgggaggtacggggcctcacc

SEQ ID NO: 463221 - DNA, 2685 bp, Homo sapiens
tccggtggacagcggcttttagcttcagcctgaccatactggggaactctgggggtttgtcctgatgggaagcagcagaggtgagcggtcatctccctcactgttcaccctgcagtcatctccctcactgttcacctagagctgtcatctccctcactgttcacctagagctgtcatctccctcactgttcacctacagcggtcatctccctcactgttcacctacagcggtcatctccctcactgttcacctacagcggtcatctccctcactgttcacctacagcggtcatctccctcactgttcacctacagcggtcatctccctcactgttcacctagagcggtcatctccctcactgttcacctagagcggtcatctccctcactgttcacctagagcggtcatctccctcactgttcacctagagcggtcatctccctcactgttcacctagagcggtcatctccctcactgttcacctagagtggtcatctccctcactgttcacctagagcggtcatctccctcactgttcacttagaggagaggtcatctccctcactgttcacctagagctgtcatctccctcactgttcacttagaggagaggtcatctccctcactgttcacctagagctgtcatctccctcactgttcacctacagcggtcatctccctcactgttcacttagaggagaggtcatctccctcactgttcaccctgcggtcatctccctcactgttcacctaaagcggtcatctccctcactgttcacctagagctgtcatctccctcactgttcaccctgcggtcatctctctcactgttcacctagaggagaggtcatctccctcactgttcaccctgcggtcatctccctcactgttcacctagagcggtcatctccctcactgttcatctagaggagaggtcatctccctcactgttcatcctgcggtcatctccctcactgttcacctagagtggtcatctccctcactgttcaccctgcggtcatctccctcaccgttcacctagagcggtcatctccctcactgttcacctagagcggtcatctctctcactgttcacctagaggagaggtcatctccctcactgttcaccctgcggtcatctccctcactgttcacctagagcggtcatctccctcactgttcatctagaggagaggtcatctccctcactgttcaccctgcggtcatctccctcactgttcaccctgcggtcatctccctcactgttcaccctgcggtcatctccctcactgttcaccctgcggtcatctccctcactgttcaccctgcggtcatctccctcactgttcaccctgcggtcatctccctcactgttcacctagagcggtcatctccctcactgttcacctagagcggtcatctccctcactgttcacctagagcggtcatctccctcactgttcatctagaggagaggtcatctccctcactgttcaccctgcggtcatctccctcactgttcaccctgcggtcatctccctcactgttcacctagagcggtcatctcccttactgttcacctagagcggtcatctccctcactgttcacctagagtggtcatctccctcactgttcacctagaggagaggtcatctccctcactgttcacctaggatggttgccgtggggaggaggcggaaagttcgcccaccccttagagtacagaaaaagaaagatttcagagatgtcagtttgggaaggtccttgaaaagtcacttggcaaagaaaagttgtgagaagaaggttgatgttttgtcaaagaaatgcaacgatgacagatgccaacctgccttttcttccagcggcagaggacctcaggccgtggtgtgcatgcccgtgtatcggtgtggacacctcattgcctctgaggattctcttcccttcactctcatcacaaaagaggtgcagaaagcagtctatggattcatgccaaatgagtggtactggaagggaattcggtttgctcagctagaggacgtgttgggaagatgggtctgattggagatgactaaaagacacctataaagatatagaagttaagacaaaagtcacaattatgttgacaactgctgttacagtgttttcaatatatttatccaatagaaaagttttattttactgcacaataatatgttctattaaattaataaaaacgtactcatgagtgacttcttgtcatacagatctctatatctcttagagctgtattttctctgactgtaaaatggagacacaagccagaaaatctttaagttcctgccaagttttaagagtttgaagcttccacgatactctgtgcccaggcccttcctgatgtctgcttttacagcgggacaagcagcaatgctgttgtactctctgcatcttggggcttgttcctctgaacccttgaagacaagggctgagccgcgtcagctctttcccaaaacacaatttaaacccttcggagtggtcagaaatgccactttgggaggcctccctgggttctctgggtgttttgttgaagcagtctcaggttctctaacgttctttttgttgaagatgatatctacaagctttataagctttcttctgatggggagagggaagaggttctcttaaatacagtgttcaactatcaacc

SEQ ID NO: 463222 - DNA, 1938 bp, Homo sapiens
cagccattcagcgtttgggtgaagacggaggcgggttctggacagacgtacgctgtcagggagtgtttacttcgcctccacttctgttcctccccgccctggtgctgctccgggtcacatactcgtcctgagccggcttcagcctctctgcgcagaagtgtcccggagccatggccgagtaatcttatgcgaagtctaccaagcttgtgctcaagggaaccaagacgaagaggcgagatggaaagaaagtatcaaggagtgagctgaagccactgcccttgagaaccctctcgaggagtctggcctcatgaagatgccagaataaacggcagatatatcctgaatgaatgtgagatttttaccctgtgaatttcctgtgaggagtgtaagaagaaaaagagcaaagagaagaagagaaaaagagaagaagatgaagaaacccagtttgatatgttggaatctggtgaacagtaacaaactttgatgaaatttcaggaaccatagccattgaaatggatgagggaacctatatacatgcactcgacaatggtctttttaccctgggagctccacacaaagaaggggaaaatggctttgttggcctcaaatggctgctttattagatgcaatgaagcaggggacatagaagcaaaaagtaaaacagcaggagaagaagaaatgatcaagtcttttatagatggaaatttaggctgtttccagtcttttgctcttataaacagtgctgcggtacataacattgaatatgcatcaatttgtggatgtgcgggtggacctgaagataaatttccggaatcagaattaccaggtggatatgagctcagccttacagacaggaagacagcctctgaccctccttacatcctcattgtttttgtcagtcagttcatggaaatcacagtgatttcaagatgtgcagccctggaactggaatctggccacagagatcccttaagagacatgagtcattaccattgccaattgcctgttctgtgggtgatcctaattgttgaatgcagatcaattaacttatgacatgtgatagtaaacagctatccaaacttaggaggatataagaagcttgtaaaagaggtgggttccaattaattaaaaacaagttgtgtaatgttaaaaatcttaatactttggtaatagtctgtgcaacgtaaaatagctattaagctttcaatctgatcaaatgaacacttgtctactagggataatttgatcctagtgtattcacttggaggacaaaactaaattaatgattgctttattgcctagcaggatctgatgtgtaaaatgtttctgaaataattttttctgtagtgtttctgacacaagggctgcggaggaagcatatgatagcacttactcatatagattatatatatgaattaaaaacacatagccagaacctgtctttttctgaatatagttgctcagttaattttttcttctgcataagaaatcatctcgaatgttcttatgtgatacgtaaagtggggaaagtggaagataaacatataacccattggattctcttttccaatatctagattagatcctgtgctgaaagagaaaccaagaaaaaagatgacattccagaagaagacaaaggaaatgtaaaacaatgtgaaatcaattatgtaaagaaatttcagagcttccaagagcacaaacttaaaataagtaaagaagacagtaaaattcttaaaaaggctcagaaagatggatttttgcaagagacgcttctggacagaggaccaaattgaaagccgacagatactgcaaatgactgggatttttgtttctgccttatctttttgtgtttttttctgaataaaatattcaggggaaatgcttttacagagttcttgagttgttgtgaaattattgtttagctagtagctagtttaa

SEQ ID NO: 463223 - DNA, 917 bp, Homo sapiens
cagccattcagcgtttgggtgaagacggaggcgggttctggacagacgtacgctgtcagggagtgtttacttcgcctccacttctgttcctccccgccctggtgctgctccgggtcacatactcgtcctgagccggcttcagcctctctgcgcagaagtgtcccggagccatggccgagtaatcttatgcgaagtctaccaagcttgtgctcaagggaaccaagacgaagaggtgggtcctgcacctccggcgggagcctcctcagttcttttcggacgcactccacccccctcgaatccggtggaagccgtggcgcggagagccggctttgtggcctcccaggctttgccctggcccctgtccgggctggactgaggccggaccgcggttcctggcgcctgtgcagagaggggcagcctcccgcactgacgaccctggaaacaggatagacgggcgggtgacccgtggccccgtacccacgagtttcggtcctctgaggcatctctgcaggcctctgcctgaagaagagagaggagcgagagagaagaagagaagaaagagaagaacaaaagaaacccagaaagaaaaaaagaaacaaaaaacaagaacaaacaaaaaaaaaaacagaaaccatagccaaagaacaaggagaagagaaaaccaagaaaacagatcactacaacgatgagtctagtgaacccccgagaagagaagctcccacacaaaagaagaggagagaaaaaagagtgtgaggagaagccctacaaaaaaactgggcgatgaataaggaaacaagaaaggcaggaaaaccaaagaaagccaggggaagagaggacgaacaagaagaagaaaaagctgggggcatggatgaaggatccagtagcgaggaagggggaacccgaagaaaaaccgagac

SEQ ID NO: 463224 - DNA, 860 bp, Homo sapiens
atttattattcttcctatgtagataagtaatgtcctagatttataccatagaaaaacaggtagagacgtttagctgtgagtgtacaagtataaatcaattaagtgccagattttgatcatcaccagttgctcattcaagtcctatgttgcaaagttactcttacccttttttacattacttgataaaggcaatgtttaattacatatttcctgttaactagctggtagagtacatacgtaaagtcagtaaataatgttacaaattttttccagctgagtaagtgaatatgtatctagttgtaagaaatcaagaagaggataaaaaatataatcaggatgtggactctaaaacggaataaactctatgtcctgtaacttttctcacttgtaataatacagcattctcaccctgttaaatggaaatttagagcacccttaaattccggaataaaattgctatttggatagaaaaaacccttaggcaacatttattgaatattaggaaataacttttataggattataatccattttttatagaaaccaaatttaaaagtatacatattttaatataagtgttgtgataatacagtaaccaaaattgaacacacagttttatagctttttatatttagtagcagttgaatatatatggcatgttttacatagattaattttactatttttatttgtttaaacaagaggaccaaattgaaagccgacagatactgcaaatgactgggatttttgtttctgccttatctttttgtgtttttttctgaataaaatattcaggggaaatgcttttacagagttcttgagttgttgtgaaattattgtttagctagtagctagtttaa

SEQ ID NO: 463225 - DNA, 1821 bp, Homo sapiens
aagcttgtgcataagggacccaaggcgaagagatttgcctgaggttgactatacatacaaatattgagcatttcctcctggtctccgtgataaacaaaggttttgatattgttcggcgagatggaaagaaagtatcaaggagtgagctgaagccactgcccttgagaaccctctcgaggagtctggcctcatgaagatgccagaataaacggcagatatatcctgaatgaatgtgagatttttaccctgtgaatttcctgtgaggagtgtaagaagaaaaagagcaaagagaagaagagaaaaagagaagaagatgaagaaacccagtttgatatgttggaatctggtgaacagtaacaaactttgatgaaatttcaggaaccatagccattgaaatggatgagggaacctatatacatgcactcgacaatggtctttttaccctgggagctccacacaaagaaggggaaaatggctttgttggcctcaaatggctgctttattagatgcaatgaagcaggggacatagaagcaaaaagtaaaacagcaggagaagaagaaatgatcaagtcttttatagatggaaatttaggctgtttccagtcttttgctcttataaacagtgctgcggtacataacattgaatatgcatcaatttgtggatgtgcgggtggacctgaagataaatttccggaatcagaattaccaggtggatatgagctcagccttacagacaggaagacagcctctgaccctccttacatcctcattgtttttgtcagtcagttcatggaaatcacagtgatttcaagatgtgcagccctggaactggaatctggccacagagatcccttaagagacatgagtcattaccattgccaattgcctgttctgtgggtgatcctaattgttgaatgcagatcaattaacttatgacatgtgatagtaaacagctatccaaacttaggaggatataagaagcttgtaaaagaggtgggttccaattaattaaaaacaagttgtgtaatgttaaaaatcttaatactttggtaatagtctgtgcaacgtaaaatagctattaagctttcaatctgatcaaatgaacacttgtctactagggataatttgatcctagtgtattcacttggaggacaaaactaaattaatgattgctttattgcctagcaggatctgatgtgtaaaatgtttctgaaataattttttctgtagtgtttctgacacaagggctgcggaggaagcatatgatagcacttactcatatagattatatatatgaattaaaaacacatagccagaacctgtctttttctgaatatagttgctcagttaattttttcttctgcataagaaatcatctcgaatgttcttatgtgatacgtaaagtggggaaagtggaagataaacatataacccattggattctcttttccaatatctagattagatcctgtgctgaaagagaaaccaagaaaaaagatgacattccagaagaagacaaaggaaatgtaaaacaatgtgaaatcaattatgtaaagaaatttcagagcttccaagagcacaaacttaaaataagtaaagaagacagtaaaattcttaaaaaggctcagaaagatggatttttgcaagagacgcttctggacagaggaccaaattgaaagccgacagatactgcaaatgactgggatttttgtttctgccttatctttttgtgtttttttctgaataaaatattcaggggaaatgcttttacagagttcttgagttgttgtgaaattattgtttagctagtagctagtttaa

SEQ ID NO: 463226 - DNA, 1084 bp, Homo sapiens
  misc_feature (881)..(881): n is a, c, g, or t
  misc_feature (1084)..(1084): n is a, c, g, or t
cagccattcagcgtttgggtgaagacggaggcgggttctggacagacgtacgctgtcagggagtgtttacttcgcctccacttctgttcctccccgccctggtgctgctccgggtcacatactcgtcctgagccggcttcagcctctctgcgcagaagtgtcccggagccatggccgagtaatcttatgcgaagtctaccaagcttgtgctcaagggaaccaagacgaagaggtgggtcctgcacctccggcgggagcctcctcagttcttttcggacgcactccacccccctcgaatccggtggaagccgtggcgcggagagccggctttgtggcctcccaggctttgccctggcccctgtccgggctggactgaggccggaccgcggttcctggcgcctgtgcagagaggggcagcctcccgcactgacgaccctggaaacaggatagacgggcgggtgacccgtggccccgtacccacgagtttcggtcctctgaggcatctctgcaggcctctgcctgtaagaagaaaaagagcaaagagaagaagagaaaaagagaagaagatgaagaaacccagtttgatatgttggaatctggtgaacagtaacaaactttgatgaaatttcaggaaccatagccattgaaatggatgagggaacctatatacatgcactcgacaatggtctttttaccctgggagctccacacaaagaaggggaaaatggctttgttggcctcaaatggctgctttattagatgcaatgaagcaggggacatagaagcaaaaagtaaaacagcaggagaagaagaaatgatcaagattagatctgtgctgaagagaagcagaaaagatgactccgaagagacaaggactggtncccatgtgactcctttttagcaattcgagcttcagagccaactatagtacgaacgtaatctaaagtccaaatggttgtagacttgggaggccctgaacgcggtgcaacgggtggcgccaccgggtccaatcggggttaaaaggggggttcggccgccttaggcgtattacccgggtgtttggccttgttttatcttttcccgn

SEQ ID NO: 463227 - DNA, 2074 bp, Homo sapiens
cagccattcagcgtttgggtgaagacggaggcgggttctggacagacgtacgctgtcagggagtgtttacttcgcctccacttctgttcctccccgccctggtgctgctccgggtcacatactcgtcctgagccggcttcagcctctctgcgcagaagtgtcccggagccatggccgagtaatcttatgcgaagtctaccaagcttgtgctcaagggaaccaagacgaagaggtgggtcctgcacctccggcgggagcctcctcagttcttttcggacgcactccacccccctcgaatccggtggaagccgtggcgcggagagccggctttgtggcctcccaggctttgccctggcccctgtccgggctggactgaggccggaccgcggttcctggcgcctgtgcagagaggggcagcctcccgcactgacgaccctggaaacaggatagacgggcgggtgacccgtggccccgtacccacgagtttcggtcctctgaggcatctctgcaggcctctgcctgtaagaagaaaaagagcaaagagaagaagagaaaaagagaagaagatgaagaaacccagtttgatatgttggaatctggtgaacagtaacaaactttgatgaaatttcaggaaccatagccattgaaatggatgagggaacctatatacatgcactcgacaatggtctttttaccctgggagctccacacaaagaaggggaaaatggctttgttggcctcaaatggctgctttattagatgcaatgaagcaggggacatagaagcaaaaagtaaaacagcaggagaagaagaaatgatcaagtcttttatagatggaaatttaggctgtttccagtcttttgctcttataaacagtgctgcggtacataacattgaatatgcatcaatttgtggatgtgcgggtggacctgaagataaatttccggaatcagaattaccaggtggatatgagctcagccttacagacaggaagacagcctctgaccctccttacatcctcattgtttttgtcagtcagttcatggaaatcacagtgatttcaagatgtgcagccctggaactggaatctggccacagagatcccttaagagacatgagtcattaccattgccaattgcctgttctgtgggtgatcctaattgttgaatgcagatcaattaacttatgacatgtgatagtaaacagctatccaaacttaggaggatataagaagcttgtaaaagaggtgggttccaattaattaaaaacaagttgtgtaatgttaaaaatcttaatactttggtaatagtctgtgcaacgtaaaatagctattaagctttcaatctgatcaaatgaacacttgtctactagggataatttgatcctagtgtattcacttggaggacaaaactaaattaatgattgctttattgcctagcaggatctgatgtgtaaaatgtttctgaaataattttttctgtagtgtttctgacacaagggctgcggaggaagcatatgatagcacttactcatatagattatatatatgaattaaaaacacatagccagaacctgtctttttctgaatatagttgctcagttaattttttcttctgcataagaaatcatctcgaatgttcttatgtgatacgtaaagtggggaaagtggaagataaacatataacccattggattctcttttccaatatctagattagatcctgtgctgaaagagaaaccaagaaaaaagatgacattccagaagaagacaaaggaaatgtaaaacaatgtgaaatcaattatgtaaagaaatttcagagcttccaagagcacaaacttaaaataagtaaagaagacagtaaaattcttaaaaaggctcagaaagatggatttttgcaagagacgcttctggacagaggaccaaattgaaagccgacagatactgcaaatgactgggatttttgtttctgccttatctttttgtgtttttttctgaataaaatattcaggggaaatgcttttacagagttcttgagttgttgtgaaattattgtttagctagtagctagtttaa

SEQ ID NO: 463228 - DNA, 852 bp, Homo sapiens
cgccaggaggctgcaagtgggtctggagaggcccagctcttcttccctgctgtgtctccaggcccgactctggcctcccaacaacgtctttggactcagctcctgcccagctcccagcggccctggtaggcccacaacttcccaaagccaagctccgcaggcccagctcaggcctcacggtggcctctccaggctcagctcctgctctccgatggcatctgcaggccccaaacagcctccggtcggtgggctcctctaggcccagcttgggcctcctggcagcctctgtaggcccaagtcgtcctcaagtcagcctggaattgggcctggaagagcagcaagtcggcctccccgggcccagctccgtcctctcggcggcctctccaggtgcaaaacttcctcgagtcagcctctccaggcccagctcctcctgcctcccagtggtctctttcagcccagcccagctcatggctctcggcggccttcccaggccccgcttttgacttttggtggcctcttcaggcccagaacttgacctccagtgggcctttgcaggcccggcctcctgcctctcaaaggcctgcatgggcccggcctcgggcctcacagcggactctccacgcccagctagctctcgcctcactgcggcctccccagtccaaagctcctgcctttcggccacttcggcaggtccagctcctgcctgccagtggcctctttaggcccagctcattcctcacaacggccttcccaggccccgtttttcccttccggcagcctcttggcctctaatttgtttatcttttgtgtataaatcccaaaatattaaattttggaatatttccaccatta

SEQ ID NO: 463229 - DNA, 4406 bp, Homo sapiens
  misc_feature (2)..(3): n is a, c, g, or t
  misc_feature (6)..(7): n is a, c, g, or t
  misc_feature (10)..(10): n is a, c, g, or t
tnngtnnctnccgctggatctaccatgaaagacttctgaatccaggaagagagactgactgggcaacatgttattcagggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacatgcccactgattctacattatgctcctacctcccggcagcctctccaggcccagaactttctccagtcagcctctacagaccaagctcatgactcacaatggcctatttaggcccataccctacctcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagttcatgcttctttgcagcctctccaggcccagctcctgcatcttggtggcccctccaggcccagcctctgcctcccgtcggcctctacagtcccaacatctgcctcacagcagattcttcaggcccagcatctgcctcactgtggaccccccaagccaagctcccaacctttcagcagcttctacacacccagctcctgccacccagtggcctctctaggccaagctcatgcttcacaagggcctttgcaggcccaacttttgtctcatggcaaccttccctggccagattcctgcttgtctcccagcagcctagacaggcccaggtcttgcctcacactggcctctctacatccagctcatgcctcacgttggcctctccaggcccaactcctgtcccaggacgtcatctccgggcccaaaacttactcaagcacagctcttgcctcctggcagcctctgcaggcccaaattctccaaaagatggcctctcctaactcagctcctgcctcatgtcggcctacacaggcccagactcttaccacacagtagaccctccaggcccaccacttgcctgatcatagcctcctaaggccaagctcctgcctttcggcagcctctacaggccaagctcctgcctcgcaattgcctttgtaggccaagatcatgccgtgaagtggcctttcctagcctaacttttgctttttgatgcatactccagtcccaaaacttcctccagtcagccggtccaggccaagctcttcctcccaaaggcttctgcaggccaaaatcgtcgtgaagtcaccctctgcaggcctagctcctgcgtccgagtgctgtgtaggccaagctaatgcctcacagcacacttttgaggctgagcgtttccttttgtgcatcctctccaagccctgaacttactccagttggcctctccagaccaagctctccctcccagtggcctctacaggccaaaattgtcctcaggtcagcctctccagggccaactcctagctaccggtggcttctgcggccaaaatcgacctcaagtcagcctcttcacacccagctcttgcctctgagtggcctctccaggagcaaaactttctcaagtcggcctctccatgcccagcctcctgcttcccgagggcatgtacaggcccagcctctgcctcacagcagactcttcacacccagctcttccctgtctgcggcctctccagtccaaagctgctcctgccttttggcagcttgtacaggtccagctcctccctcacggtgacctctttcggcccaactcatgcctcttgcaacgtgccgaagtgtcagctcctgcctcacactggcctgttgaggcccagctcatgcctctcgtggcctcaacgggcccatcccctccctgttggcggcctctacaggcccggcctctacctcacagtgggctctccaggcccacctcttcctcaccctggcctcctggggcaatgctcctccctctcgggagcctctgcgggcccagctcctgcctcccagtggcctctgtaggccaagcccgtgcctcagggcagactttccaggcctagcgtttgctgctttgcatcttctccaggccctggacttcctccagtcggcctctccaggcccagctcttcctctcagcgcctctgcaggcccagactgttgtcaagtcggcctccccaggcccagctccggcctctcggcggcctctctggatgcaaaagttcctcgagtcagcctctccaggcccagctcctcctgcctcccagtggcctctttcagcccagcccagctcatgcctcctggcggccttcccaggccctgcttttgacttttggtggcctctgcaggcctcgacaaggcccggcctcctgcctcccgaaggcctgcacaggcccagcctctgcctcacagcagactctccacgcccagctagctctcgcctcactgcggcctcccgagtccaaagctcctgcctctcggccgcttcggcaggcccagctcctgcctgccagtggcctcttcaggcccatggggctcattcctcacaacggcctttccaggcccagtttttcccttccggtggcctctccgggcccagaacctcctcaagtcggcctctccagacccacttgcaccctccgggcgtcctctccggacccagctcttcctcacggctgcgtctccaggcccgactcctgcctctcaacaacctctttggactcagtgcctacccatctcctggcggccttggtcggcccacagcttcctcaagccaagctccccaggcccaggtcaggcctcacggtggcctctccaggatgagctcctgccctccgatggcatctgcaggccccaaatggtctccggtcggtgggctcctccatgccaagcttgggcctcccggcggcctctgcaggcccaagtcgtcctcaagttggcctggaattgggcctggaagagcagcaagtcggcctccccgggcccagctccatcctctcggcggcctctccaggtgcaaaacttcctcgagtcagcctctccaggcccagctcctcctgcctcccagtggcctctttcagcccagcccagctcatggctctcggtggccttcccaggccccgcttttgacttttggcggcctcttcaggtccagaacttgacctccagtgggcctttgcaggcccggcctcctgcctctcaaaggcctgcatgggcccggcctcggcctcggcctcacagcggactctccacgcccagctagctctcacctcactgcggcctcccgagtccaaagctcctgcctctcggccgcttgggcaggcccagctcccgcctgccagtggcctcttcaggcccatggggctcattcctcacaacaacctttccaggcccagtttttcccttccggcggcctctccgggcccagaacctcctcaagtcggcctctccagacccacttgcagcctcctggcgtcctctccaggcccagctcttcttccctgctgtgtctccaggcccgactctggcctcccaacaacgtctttggactcagctcctgcccagctcccagcggccctggtaggcccacaacttcccaaagccaagctccgcaggcccagctcaggcctcacggtggcctctccaggctcagctcctgctctccgatggcatctgcaggccccaaacagcctccggtcggtgggctcctctaggcccagcttgggcctcctggcagcctctgtaggcccaagtcgtcctcaagtcagcctggaattgggcctggaagagcagcaagtcggcctccccgggcccagctccgtcctctcggcggcctctccaggtgcaaaacttcctcgagtcagcctctccaggcccagctcctcctgcctcccagtggtctctttcagcccagcccagctcatggctctcggcggccttcccaggccccgcttttgacttttggtggcctcttcaggcccagaacttgacctccagtgggcctttgcaggcccggcctcctgcctctcaaaggcctgcatgggcccggcctcgggcctcacagcggactctccacgcccagctagctctcgcctcactgcggcctccccagtccaaagctcctgcctttcggccacttcggcaggtccagctcctgcctgccagtggcctctttaggcccagctcattcctcacaacggccttcccaggccccgtttttcccttccggcagcctcttggcctctaatttgtttatcttttgtgtataaatcccaaaatattaaattttggaatatttccaccatta

SEQ ID NO: 463230 - DNA, 764 bp, Homo sapiens
tctgaaatcttcccttgatggtatagttgggacacagaagccacagttcagacctgtcccaggttggttctctgggtaccttttgtaggaatatgaaaacgggggccactgccttggctcaacagccctgacaggatacacgctcctgacttcccagcgagaatatctccgccttttggatgctctctgccctgaatccttgggtaagggtcccggggttcccaggaacaggtttctccaccccagcatcattaacatgtggggccagatcattctctgcggtgggggcgtcccgtgtacagcagggcagtaagcagcatccctggcttccacccactccctgcctgcagcagcccccaccctgggtgcgacaaccaccaatgtctccagcattgccaagtgtctcccgggggcagcgttgctacgggtgagcatccctactctggaaaacaaacaaacaaacaaacaaacaaacacccactcttgcaagggtgagggggagagttaggtcatgggaccagaatcagaatagcaaaggataaaaacagtaaaatctgggatgggtgcactgtctcatgcctgtagtcccagctactcgggaggctgaggcgggaggatcgcttaagcctgggaggtggtggcagtgagccgagattgccccactgcactccagcctgggcaatagactgaaaccccatctccaaaaacaacaacaaaaacaattaaaaacaataggctgggcacggtggctcatgcctataatc

SEQ ID NO: 463231 - DNA, 800 bp, Homo sapiens
  misc_feature (1)..(1): n is a, c, g, or t
  misc_feature (3)..(5): n is a, c, g, or t
ngnnntccaggtgcccctgagccgaggaacgcaggcggtggtcgtggggaagggaagaggagccccgggagacgacagcagcatgggtgggcggccttcgagccctctggacaagcagcagcggcagcacctaagggaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggctggtctggaactcctgggcccaagggatcctcccacttcagcctccaaaggtgctgggattacaggcatgagccaccgcggctggtccccaaataaattaaccaaagctgaattcacttattttggactgctgtatgcatttcaggggtattttctcctagtgaatgaacgtctagaagatgcgacctcctgtttgttttcaggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcataggcctcactttctttacccagaaaatgggtttttaggccaggtgtggtgg

SEQ ID NO: 463232 - DNA, 692 bp, Homo sapiens
tgtacatcatttcattttacaaatggggaaactgaggcttagacaatttaaaatccaggcagcctggctccagcatccatcttcactgctgctgagctgtctcttcagccacccaccctctgaccccatcatccttccacctagcgacattccctggccacccggcctgtgccggcctctgccagccacggggctgctgccatcagcagagcaggattccagctccctaggagctcaccacgcccagatggggcctggtacacagttggtgctcaataagagcagttcgtcttcttctgagcatgggtgcatccctctggctgggggctttggagctagtgtgaccgagtgtgtgcagggcgtggtggctgctcccaggggccctctttgccccaagatggccctcctgtcccccatcctggatgtggtcctcacggtggccctcagcctcctcctcctggggctgatcctgggcctcctttgtttcttcacttgccgcctggccaggccgctcagcacatgacatacccaaataagctctcagttcttgttttgtttattcattttttcctttgtccctgctccctgcctccccactgccattcccacagctcaccgaagtccctatgctaatgtacttaatatggccttggagttgtaagtgtccttgtacgttacacagcattctgtcc

SEQ ID NO: 463233 - DNA, 2570 bp, Homo sapiens
taggagttggcccagtgagagttgagagagaggccacccgcggcgtcttgacttggcttagttttctccttaatctgagaaactttccctgtccgcgccattccagatctcttgttaagaatggggaggagtgaaggaagggaccgattgggcagcgttaaggtgcttgcttttccgccagaaggtactttcaggtgtgtcctgcttaccactgtggccacagacaagccccgaatacctggagaaggtggctagggtgctggcagctgcggctgccccactcctcttcactgtctgtttttgtgggagttggctgttgaaatatcaccacttcctctgcagaagctccgcagcctctgccttctttgaaagctgcagaccagccgccctctcatgctggtatttcttgttccacggccttctgtagcaggcccgtgctcctgcatgctgtgttcttccgtagaagtgcgcgcaaccggtgttgatgagggccagggagtggccgcggtgggcatgatgcggcttttcctgtggccttctctgattattgttcaaccggtcaggaacacggcacatgggaaggcaggcccaagggacctccagctggtgcctggacttggatctgggcatcatgctgcagcctgctgggaggccggtagggttagctggactctgagtagggagtggtctgcagacctctggcaggctgcggtgtggatgcgcggagctaaagctgggcttgcaaagtcacagttagctgtgcactgctttgggggtgggtacattttaaagcatgtgcatttgggctgtagttaagagcttgggaattttcaaaatcattgactctctatagtccttttatactgtcctatattttccaggatgtcattaaggtctcctggccctagacagctgttttcctattggctctttaagaattgtaccagtccacagacctggtttggcagactttatgccgtgagcatctgtgatgtaatttcgatcctggaacatttgagatccaggtccacctgggactgcacagcaagtctctgcgtgtctcagggcgaaatagagaacttgtgctaggtcaagcctagttatgaaaaagaatcctgaatgtgctgatgtgagaaggacatttcatatacatggaatcataatatgtggacttttgtgactggcttctttcagttagtgtaatgttttcaagcttcatccatgttgtcacatgtctcagtatttcagtcctttttcttgttgaataatattccattgagtgtatataccacattttatttattcatcagttgaacatttgggttgttttcacctattggctattatgaataatggcaaaacctttatgtacaggttttcgtgtggacatggttttcatttttcttgggtatatacccaggagtggagttgctgggtcatctgataactctgtattcaacgttttgagaaactaccaggctgttttccaaagtgactgtaccattttacaatcccagtggcagtgtatgaaggttccagtttcttcatattcttgtcagcacttgttaatgcctgttgttttgattccagccttcctggtaggtgtgaagtggaagctcattgaggttttgacttgtgtttcctgaatgactcatgatgttgagcatcttctcatatgccaactgtccatttgcatatcccatttggagaactgtctatcaaagtcttttgcccatttttaaattgagtcatttgtctttttattgagttgtaagagttctttatatattccgaatattccttatatagtcttatcagatatatgacttccaagttttttcttccatttagtgggttgtcttttcactctcttcatgatgtccttggaagcacaaaagttgtacattttgtgacatcccatgtatctatttttctctggttgcttgtttttggtgtcctagctaagaaaccactgacaagtttgaaatcactgagatttaaccctatgctttcttctaagagcttgatcattttatgcttgcatttacatctttggtctattttgagtttttttggtatatgatgtaaggtttccattttttcttttgcatgtggatattcagttgcttcagcaccattaattgaaaaaaactgcttttcccccattgaattattttgacacctatggtcaaaaatcaatcgattgtaatttattttctattttaataactgtccctttcttcttgactacttcgcaataaaatatgtattgctctacagtcatttgaaaacagtatgctatttccccaggtctcaggatgcaccctcacagtctcatagcttgacgccttccacccggcatcttccactctgttctttcctggtcttgatcttctgagtgagtaactcaagaatcctatgtgcccacctttcttctctttgaagagttgtttagttgggaaatcatgttttctagttacaggaaatctttttttttcctcctctgtatgttgcagtagaatcctcttgagcactataattattttaattaaaattcaagttgtatgtat

SEQ ID NO: 463234 - DNA, 1533 bp, Homo sapiens
aacagtgttcttagaggtagccacacctcagcaagggctttctaacttggaacagcaaagttcaaatgaacgaatagacacaaactgtgaaagagtcctgaacccattacaaggtgaatctttacagcacaattgccttctgaagctacttgaaacagggcatgggacttaaaggagaaaaaaaaaggaaatggaccatctcttctaacacctggaatgtgatccaagcctggagacaaattgatggtttgcagctagaagacagtaaatctagcaatggagcccatatatgaggagtacctagcaaatcatggaacaatagtaaaaccatattactggctaagcttctctctcgattgctctaattgtccttaccatattcgaacaggtgaagaagcaagagtttccctcacagaattttgtcagatttttggattcccttatgggacaacatttcctcaaacaaaacacctcacattttatgaactaaaaacttcttctggtagcctggtgcaaaagggccatgctagcagttgcactgggaattatatccatccagaatcaatgctctttgaaatgaatggttatcttgactcagccatatacaataatgacagcatcaggcatatcattctgtattccaacaactccccttgtaatgaagctaaccactgctgcatcagcaaaatgtataatttcctgattacgtatccaggcatcactcttagtatttatttttctcagctctatcatactgagatggactttcctgcctcagcatggaaccgcgaagctctccggagcctggccagcttatggccgcgggttgttttgagtccaataagtggtgggatctggcattctgttctccacagctttataagtggtgtctcaggatcacatgtttttcagcccattttaactgggagagcactggctgacaggcacaacgcatatgaaatcaatgccataacaggcgtaaaaccttacttcactgatgttcttctccagacaaaaaggaatccaaacacaaaagctcaggaggctttagagagctaccccttaaacaatgcctttcctggacagttttttcaaatgccgagtggacaactccaacccaacctacctccagacctcagggctcctgttgtttttgtgctagtgcctctcagggacttaccaccaatgcatatgggccaaaacccaaataaacccaggaatatcgtaaggcacttaaatatgcctcaaatgtcattccaggaaaccaaggaccttggaaggcttcccactggaagtttaacacagaaccagttgatgtagatattcataggagtattaaatcataagatagtctatggacaacatgctaaacatctttttatatttcagtaattatgttgccagagaaccctggtattaaagcatccttaccagaactgaaattcacttatttatatttataatacattttacatatttgattaacattgattttgcacttctatttcaaataataaaaataaataatgtcac

SEQ ID NO: 463235 - DNA, 6348 bp, Homo sapiens
ccgccgccgcctgactctcccgggagactccctaggcccggacctggggccgaggagggccgggatggcctgagtgcccgcggcgcggcggcgcagcagcgggattgcaccatggggaaccaggatgggaagctgaagaggagcgcaggtgatgctttgcacgaaggcggcggtggcgccgaggatgcgctggggcccagggatgtggaagccacaaagaaggggagcgggggcaagaaggcgctaggcaagcacggcaaggggggagggggcggcggcggcggcggggagtcgggcaagaagaagagcaagtccgactccagagcctcggtgttttccaacctgcggatcaggaagaatctgtccaaggggaaaggcgccggcggctcccgcgaagatgtactggattcccaggccctgcagaccggggagctggacagcgctcactccctgctcaccaagactccagacctcagcctctcggcggacgaggccggcctgtcggataccgagtgtgcggacccttttgaggtgaccggtccagggggtcctgggcctgccgaggctagggtcgggggccggccgatcgccgaggatgtggaaactgcagcaggggcgcaggatggacaaaggaccagctcgggctcggacacggacatctatagcttccattcggctacggagcaagaggatttgctttcagacatccagcaggcgatccgcctgcagcagcagcagcagcagcagctccagctccagctccagcaacagcagcagcagcagcagctccagggcgccgaggagcctgcagcgccccccactgccgtctcccctcagcccggggccttcctgggcctggaccggttcctgctggggccgagcggcggggctggggaggccccgggcagtccggacaccgagcaggcgctgtccgcgctctccgacctgcccgagagcctggccgccgagccccgggagccccagcaaccgccgtcccccggcggcctcccggtctccgaggcgcccagtctcccggcagcgcaacccgcggccaaagactcgccctcctccacggctttcccatttcccgaggccgggccgggggaggaagcggccggagcccccgtgcgaggggctggggacacggatgaggagggtgaggaggatgcttttgaggatgcgccccggggctctccgggggaggagtgggccccggaggtgggagaggacgccccgcagaggctgggggaagagccggaggaggaggcgcaaggacctgacgcccccgcggccgcttccctgcccggcagccccgcgcctagccagcgctgtttcaagccctacccgctcatcaccccctgctacatcaagaccaccacccggcagctcagctcgcccaatcactccccgtctcagtcccctaatcagagccccaggatcaagaggcggccggaaccctccctgagccgagggtccagaactgccctggcctccgtagccgccccggccaagaagcaccgggccgacggcggccttgcggccggcctgagccgctcggctgactggacggaggagctaggcgcccgcacgccccgggtgggaggctccgcgcacctgctggagcgcggggtggcgagtgacagcggcggtggggtgtccccagcactggccgccaaggcgtctggggcccccgcggctgcggatggcttccagaacgtgttcacaggtgagcgcgccctgctgctggcctccgggtctcaagtcgcctgtcagtcagggccttcccctgccacccgccctccctgggctctggaaggcggtgacctggtagtggcacatctcttctccgtagggaatccttttccgcccagcgagctcaccccccacggtgaaatgacttggacatacttgttggttttctgtgttcttacaagatcttaaagggaacaacttagttgtgtctgtcctaagttgctctgcccatttcaccaaaatacctgctattcacaaagtttcgggtcacgccagggagataaactcctttttcgtctcgttagctaaaccatcattcttctctttcatttttcatcaccacagcattaaaaagaaaaaaaattgttcatggttctttcgcaagagtcggttttggaggcacaaatcatttattccggtacgatccaaaggcagtctctgaccgctctcatagctgtgtgtatttgtccacgtttggtatgtatgtgatatgtagtttctatcttgcagcagtctgggttccgctgcttagtgaagttaagcggtcactcactgctgtttgctgctgcaagaaaatccgatacatgctattagaaaattaataaataaatagaatagtagggataattttcattcagtttcatggtccagcccagaacagcctgtagtttggagacagtgaaggtggaaaggtcaaaagcacgtctagtccaactggtacctcccctccctagcatatgttatagactcatacccagggcggcataaagcacagccagagtatgtttgctctggtcagtgtcaagcagtccaatgagtttatcctagcttacaggcttacagggcccaaggccttaccttaagagcccaacatgtttacctaacctctattcttaattattaaatgaaatagagtgttagaatttaatgaatcgaaaaatatgaaaagttacatgactactgataggtttatgataaatatttgaaggattaaacatttcaaatgcaatctgaaaattttaaaatcttatgttctattattttaataaatacattatctgtaaaacattgcttagatgaaatttctcggcacagacagcgacttcttagttgactaaatgctggtaatattggggtagctacttttattgaccacattttaattttcatctgtgggccaccttttattttgcccttatagggtcttacccttaaaagtagcttcttccattcatttcacatactcttatttttcttcttttccaccttctctttattgtgtagattgttaaaaagaatgtttgtagttttatacccactagataaattgtaaaaaaacaaaaacaaaatgcaaaacaaataaaaaagaaagatcacttttgatagaagaagattggaaagtttttgcattaatttttgtgaatttaatgttggtaagaaatcacatattttctctttatctaagtgacattcacgtatatagtttttgaaaagtgaaaataattcaccataatgattatcaatcattaatattaatgatagctattcctactagcataagactttggaaatttatttatttcattcatttagcaaatatatatatgtatatacatttgtaagcatatatgtgcatacacacacacacacacacacacacattgagcagccacattgtgctaggcagtattctaaatagtagcacactgtgctaggcagtattctagatgtaggtgatacatagaccattaaatcatgattttgcctttctaaggctcgctgactagtgaggaggagacatgacataagtgcagtgcacagaaatatctgtatagatatagacatgcaaatcactgctgggaacatcacggatgcagtggcttatctgcttggtggcaaggggtgagggaagaggacttgagagaggaggattgaacagagtcctggaagatcacaagaccctaaataggttgaatgtttgttttcctttaaaaaaacaagtgtcttcttggaacttgcattttagtttaatttgctaagtattcccaaatttgaaatttgggactcttaaaagagtcctgtataggaaccacctgggttttgttgacctctccaggtgatttgttttttaaattgtgcaaagtaaaattgcagagctagtcgtttttataaggacatcacctattttgtatttgatggttggatacagctggttggtaatcagcaaatatatttttgtgtagcagcttccgtatgtttatgtcattcactcagcattgttcaggaaaagaggatcagtaggttttacctaactttgtaactggtgggaaaatgtagatagagaaagaggtgaaataactttctcaaggtcacactgtgattcattcagaggcagatccagaaatagaaactgagtcaatgaatcaagtctaatgtcattattatttctgtttggatatacaatgttttaaggccatatagagagtaaaaactgtttataaaaaatgtgatcagatttagggcctttctttaattagattttccagttcctgtttttaataaggtgtcctcctttaatggttgaacatctggccttccttgagctggatgaagggtgattgttggccagagtgaaccagattttctctaagcagctctcatggaaactgttcttatggtggtcaaatgaatccagattgacacaggcccttgtgtctcagctgtcaactcttcatgtcatctgccactacgtttgcttctttactctcctctgctatttttttacgggtgtcttggaaattaccagaggcttggggaacactggcattgtccttagggaaatttctttttggccttaattttgcatgtatttggatcaattaattgccagctgcctttgaagcaggtgatcattatatctataagcttccataagcatcttttatttttaaaccatagaatgagggttgtcagcattacaggaagaaacagatgtttttcgctttttaccgccttccaaatgtagggagaaaatacaagtgaaaagggatttctatggcacatgtctgtgtctctttggtagatctaaaaacatttagcaatgagggagaccaaactttatcttgttttagctattaagaaactgatgatgccttaggccattgcatttaagtatttcataattaatgtgtttgaaatacatctttttcagtgtttagtagaaaaaatggcgtctgaaattcgggaggttcctttacatattaagtataacagaagcttggtactggagttttgcagttaattaaagtttagatatccaacgtgttaaatttgtgatgctaaatcgcttttgataggaatctttcccaagtcaattatgtgcttatctttttttttaaacacatggaataaaagtttaatctgttttaaagggcttaatgtcatcttcaggcacatcattgttacatcttataaaaacattagtgatgtcctcaacagctattgaaatatctcttccgtgccttgctctgtgcctgtcaatatgtgtaaagcaccgactgtactgaggtcttgatgaatacttgctcattcaccatttttggcagtgatatagacaagttgagtatccaggcttcctactggcaattaaaactagttgaattgaagctggaaaattgctaacctttctgggcagtcaaaattaattattttcaatgaggtgtgattgaatcaatgatactttatagaacttatgttgatagaagaatagctattcttgtttctgcaggttaatgttaaaatagtaatgacattacagcaactgaccttccaaatataaatgttattgtaatgaaagaagaggtaaagggaatagagaaaattgtattcctctgttcattcctgttttgtattctaagtactaacctaatgctaataaaagttagcattaaggaaccattaggaagaaacaaaaatgtactgcctgtgacttgatagttattagatatcattttagtgacagtagaaactttctaaggcttttttatcttaaaatatatggaaaatatgacctcagtcagttcggaatggtagtaaagcaaggtagtcataacatcaaaattctaagaatgagtaacaattatttctggatgctataataagatgctaaccacactagagatttattatccttttgatacctactgctccactatgggtgagaaggagggaagaatttatgtcttcttcctttgtaaagatgtacttggaagtgttgattggataggaaaattactgcctctattctgtgatccagtcaggctccaacctaccaggaacccactggaagctttattatctgttaccctagagctgcaatggactgaaaacagtcctattgttttcaggaggaatggaatactttcttgagaaaatcaagcctatattatgtttcaaaattatgcttaaaaaggcttaggcactactcagttgagtctttttttgtacttcatgcagaagggttctttgttgtagtacctggtgatagagtggacacatacaggaagaaattctgtgtcatttaaatggttgttttag

SEQ ID NO: 463236 - DNA, 1619 bp, Homo sapiens
ctccttatttaggtgatgaaagatgtggtgccccaactttaagttccacttgacgcagaatttcctgattgaggatggagcctggggctaccttgaggatggccagagccagaggaagaccacgaagccagagggtgccccgacagaggaaaagcggccggtgggttttagatcctcatttggccagagggaggcagctggatcggcttctccagagcctgctggctggaggttggctgtccgtggtggtctggttctaacccaatggcctcaggagacagtgactcacgctgtgtccacctgtgtcatcctgtggacagctggaggtccacgggaacagctgctatggcggcggacacagccccgtccagggcccatggcagccccagctggctgcccgctccctcctgtgggcagtgcttcacagcggcagcgggagcactgggtgcagcctctggaaggtctggaaggtgcttgctttggggactcggccctggtggatccccttagcctgtgcagacgggatctgaatggaaggtccgagggtctgcagatgtcagagctgtccatggctttgcctggtgtctgtctgagcgatctggcctttgtggagccccctgagccaacgctctgctcttcggaatcattgatctgtctggggatgagcaatgctgttgtcttcatcatcctcgtcttcagcagcatcaacagcaagtcacagcaccaacagtgccaacacggccgtgcacatccaaatggcttcattatgctcaacagcctggagataaccaaaattagcctcctacatacttttatgggtacctacatctctttgtaggtaggagtatatatatagtaaagtacaataccgtatattttgtatgctttaaaattatttaatatgatgaggataaaacgatgttttcttgttttgagatggaacatcttttcatagttttattgaccatgggagttttctcttttaagaattgcctattcattttctttgcccgtgttttttctcattgtattgtcttatttgtgtccattattgtaattgaattttaggatatttgaatgtaaatcttttgtttggaactgtatacctttcaggagcatggcttatgacatagcaattccattttcttaacaaaaacgaaccctatttttactttaaaagtaaacattccctctgctgtggtttgaatgtgtccctgaaagttcacatgttggaaacttcatcctccgtaacagtgttaagagccctgaagagtggattgctgatgccttctgcttcaccctctgcttgtgctccttcttccaagctgttaatttctctgaaatcttgtgtttctttacgcaggggttcacatcctgattgcttgttccactcggaagggaaggcagagggcttgcatctgaagccatgcctccttcatcggtgctgtatcgagctctaggtttgggttcttggcacttcggtgcttcccttctcactcagtagtcataatgttagcacggttgatgcattgacacgctctagtgagcagtttgcaggcatctatcatgaattgttcaaagaagaaacgcaactacctgagaagaaacgcaactacctg

SEQ ID NO: 463237 - DNA, 1783 bp, Homo sapiens
ggaaaatataatgcatgttcagaagctcctcctggaatgtttgtgaaaattgccaatttcctgtccctgcatactgattgggaaggtctgaatgaggtcgctgagccctaccccagagtctctgattctgtaggtctgtcgtgggtcctgagaatctgcattcccaatgaggccctaggggaggctgacgctgctggtccagggatcacatttttaaaaccactggtgcagggagactccaaggactactggacctcagaagagagagactgcttccagtttgaagggaacaagagttatatacggcgttactgctgggagctgagcatgtggattgcttttggccagtcccatggaagcttttccgtctctgcagctgagatggaacccctcagttcctcctccagaccaaaaggaagagcaggctccggttccagttccattctgttgcagtcttattaggcaatgccatcttgaagcccgtccatgacatcatagttgctcattcaatgaacattctgatatcttatttcctaaacattaagtagtgtgtacatatctacaaactgccctgcttcctatggttcctttgatgctgatttgcttctttaagccttccttccttccaaaccatgaatcaggtccttccagaggctaagaattaagttcacaattaaggcgactccctcactgtttcctctgctttcagagaggggaaaatacttccaggacaagtcaagaatttatcagatgctctgctttcagcagcctgaaactttcagcaggaacacgatagccgaaatcccatgccacttcttctattgaggcttccgtttaaatcagattagggtgagccacaagaaaaattcttcagagatacgagtcgtgggcgtaaaacagcagctgttgtgtagctcacacaagttcttgctaatctgctggtttttaaactcgtgatctgacttgtctgagagcatgccttgtggacttcaagccccagcatgagatccagtgataacagccttgcagagactacttccaacctccacaattgtataagccaggtccccgtaacaaatctcatactggttctgcttccctggttgaaatttgaatacagtcactctattgaccaggacgaccctgttgcagtacatggttgtctgcagtcacctggctggtagattcctccaaatctagggggaaggactaaagggcccccaagaggctatagtgatgatgtgataattaattttatgtgtcaacttgagtgggctgaaggatgcccagaaaggtggtaaaacattatttgggagggtatctatgaaggtgtttcaagaagaaattagcatcaaaatctgtagacagagtaaagaagatctgccctccccagtgtgggtaggcatcattccatcacttgatggtgcagaaaaggtaaaaaggtggaagaagggcaaattctctctctttttcagctgagacatccaccttctgcagaaaggcataggagctcccggctctcaagccttcagactctggaacttttaccagtggcctcccagttctcaggactgtggacttgatctgaattacaccactggctttcctggttttccagctgcagatggcagatcatgggacttattcccatgtgagccaattcccatattaaacctcctctcctgcctctctatatatcctatagtttctgtttttctgaagaatcctgactataccaacaacttggaaacttagaagtaacaggtaataacaatgatgctgc

SEQ ID NO: 463238 - DNA, 1013 bp, Homo sapiens
atcagaattcctgtgggggtgccccgagtagcagtcacagagaggggccttcgctaagctgctttcaatccagattagggtgagccacaagaaaaattcttcagagatacgagtcgtgggcgtaaaacagcagctgttgtgtagctcacacaagttcttgctaatctgctggtttttaaactcgtgatctgacttgtctgagagcatgccttgtggacttcaagccccagcatgagatccagtgataacagccttgcagagactacttccaacctccacaattgtataagccaggtccccgtaacaaatctcatactggttctgcttccctggttgaaatttgaatacagtcactctattgaccaggacgaccctgttgcagtacatggttgtctgcagtcacctggctggtagattcctccaaatctagggggaaggactaaagggcccccaagaggctatagtgatgatgtgataattaattttatgtgtcaacttgagtgggctgaaggatgcccagaaaggtggtaaaacattatttgggagggtatctatgaaggtgtttcaagaagaaattagcatcaaaatctgtagacagagtaaagaagatctgccctccccagtgtgggtaggcatcattccatcacttgatggtgcagaaaaggtaaaaaggtggaagaagggcaaattctctctctttttcagctgagacatccaccttctgcagaaaggcataggagctcccggctctcaagccttcagactctggaacttttaccagtggcctcccagttctcaggactgtggacttgatctgaattacaccactggctttcctggttttccagctgcagatggcagatcatgggacttattcccatgtgagccaattcccatattaaacctcctctcctgcctctctatatatcctatagtttctgtttttctgaagaatcctgactataccaacaacttggaaacttagaagtaacaggtaataacaatgatgctgc

SEQ ID NO: 463239 - DNA, 914 bp, Homo sapiens
  misc_feature (855)..(855): n is a, c, g, or t
ttgagtcggcacgagggtggagcagagctgcactgactctttcttatccatgggtagcacaagcgaaaaataaacttctgtggtgcaaagtcactgagattcaggagttgttgccaaagcggagccgagctcagtggttcccagtctggtcccagccaccacgtaagatgttcctttgctcttccttcatcttccaccatgattgtgaggcctccccagccatgctgaactgggtaaccaccacaggcccacaggctaaaattgagctggagtaagtggcaacagagagtatttattgtcccctaagagccctggcccttgtaggacatgtgaatgccagtgctcatggagaaaggtggaggaagagagccagagtgcagttcacctctgggagagcagaccagagtggcttccgtgggcacatgctggattgaagtgagaagacgtgactactaaagttgaggccccaagtctcagcttcttccccctccaaagcatgagtggaggattcacttaaggccactttgaagcccatattggaggagcattactcactctgaggatcctggcataggcagatgcatcacttgtattgaagtatattatctgctgtgatatttatgatgaaatgagtttgccagccatcgtctatcaggggatcaaacataggcacctgcctgtccaagggggtctaagtcacagtacagaagtggtttgcaaaggctggtgggatggtgtggcaggcctgtggagttgaataaaaatcctgatgtccttcctggcatgaagaatggagctgcaagctgccccaggagaagcgtgctgcctatgctttcactggactctgtgtccganactttggcgcttggaccccctcgctcccacccgctgttttcgacaaacacaatcttcca

SEQ ID NO: 463240 - DNA, 1241 bp, Homo sapiens
agttgggaaatcatatctgatttccattttaaaacaatagctgtatgagggaggggcagaggtgggatttgaacctaggcttcaccagattctctctcctaccctctctgtctccctgcctggctggcacagagttgaggctcaataattgttcattaggagggagaaggatggccggtttggcaggagaagtgaaatctgatattggaatatctcaagattatttcatggtcttgttgcatattttacacttgatggaaattactgtgcaggtaatgtggaatcccactctttggtgccaaactgtcaactgcctaagcacaggatatcctcttaataactgtgaaattgaatttgttatgaatgaagggctagggtttaatagcaccacaggggagaaagtttgaggctactgcaagggacatgagcattgagtgtggggtggcattttccaagaaatgtatataagcacagacatttcccagggatgctgaccagcttggcaaggggacctggaaaccaaatcagttaaggaatggaggaagatattgagagtgctgagtctggggcctaggtatttcttgggaccaggaactgggtaaggggtaaccaccacaggcccacaggctaaaattgagctggagtaagtggcaacagagagtatttattgtcccctaagagccctggtaagcttctgagaaattaagtgctcatttcctagcagataaaaatccactgactcacacctgcctctctgcttgtccagagaggtacagagaagtaatgacttggacttgaggaaggcccttgtaggacatgtgaatgccagtgctcatggagaaaggtggaggaagagagccagagtgcagttcacctctgggagagcagaccagagtggcttccgtgggcacatgctggattgaagtgagaagacgtgactactaaagttgaggccccaagtctcagcttcttccccctccaaagcatgagtggaggattcacttaaggccactttggggatcaaacataggcacctgcctgtccaagggggtctaagtcacagtacagaagtggtttgcaaaggctggtgggatggtgtggcaggcctgtggagttgaataaaaatcctgatgtccttcctggcatgaagaatggagctgcaagctgccccaggagaagcgtgctgcctatgctttcactggactctgtgtacagaagaaatattggtggtttgaccaaac

SEQ ID NO: 463241 - DNA, 2250 bp, Homo sapiens
cctttcttctccccagtccctggccccacctcttctgccacaaacgtcagcatggtggtatcagccggccctttgtccagcgagaaggcagagatgaacattctggaaatcaatgagaaattgcgcccccagctggcagagaagaaacagcagttcagaaacctcaaagagaaatgttttctaactcaactgtccggcttcctggccaaccagcagaacaaatacaagtatgaagagtgtaaagacctcataaaatttatgctgaggaatgagcgacagttcaaggaggagaagcttgcagagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacaatgaagatgttcaagttgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaacgggaagatgctgtacacattattccagaaaatgaaagtgatgatgaggaagaggaagaaaaagggccagtgtctcccagctcagagaagtttgttattaccgactttctgaagcctacttctgtcagctcatcaaagtcattctccatcctgctttgttccattgctggcgaggagctgcgatcctttggaggagaagggatgaatctgcaggagtctgaagaggaggaagtcccccaggagtcctgggatgaaggttattcgactccctcaattcctcctgaaatgttggcctcgtacaagtcttacagcagcacatttcactcattagaggaacagcaagtctgcatggctgttgacataggcagtgagtactccattgtgaaggtgataaagctccagttcatggcccagtctcaggccatgcccgtgccaacctggactgactgtcacgacattgaactcaaggcaggacatcggtgggatcaagtgaaaaaggaggaccaagaggcaacaggtcccaggctcagcagggagctgctggatgagaaagggcctgaagtcttgcaggactcactgtatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatggtattcgactccttcaggttatcttgaactgcctgacttaggccagccctacagcagtgctgtttactcattggaggaacagtaccttggcttggctcttgacttggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagtggccattactgagctgagagatgtcattgccacagggaggacctataggcacatgctcaacggcgtgctgatggaagtggaagagcctgaagtcttgcaggactcactggatggatgttattctactcctgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgc

SEQ ID NO: 463242 - DNA, 2236 bp, Homo sapiens
catcatctctctctcttgatcatgcatctacctttggattggcgcttggcagtttcgtgggactctctgagtagacacacggagatttgcaaagatctgttttacttagatgagtcctcagtccagtggagaatccagatgcacaaacaaacattgatgatgaaatataagtgtagtaaagaagaatgtggcaaattgtgtaggggtgaagggaaagcttccccttcactctcagaaggttccgtgaaaaattcagttcacaaaaggcagattaataggagaaaaaggatactaaaagaaactgaccaaacttacttgatcatagtttatttgatcatagtttcccatgacacaggagccttcagaatgaagattcaactccccagtggggtacaggagcttgtatatcaccttgagattacagaaagaacaggagcttggagcatggccaaaaccaggttatggtggtaaatcagattttagtgaagagacaggttatgggagggagagaaggggaggcttggctattaaaagtggtcttggtatggagataaaacctcacaggtagcagccctcagagaggataaatggacaatgtttctttcggatatttaaatgtgtcagactcttggttaatctttcctagatctggattagggaaggcctggttgcgttaatgcagattgctaatgatgcaaatttcccccacaaaagacagctttgcaggaccagttctgtttactgaccccctgacagccatcccaaaatatgtcaaagaaatatatttggggctgaaatatttttatttcctttagctgccatgggagcgtggatgagaaagcaattcatctcgaaatggagattagtaaatgggcacctatgtactatttaaaaaaatgataaagaatgtgaggaagaaaatgtccatgaacactattttaaatgccatgtcttaatatcagtttcccttgttattttcctagccagtctttgtcagggaaatagcagtcattttcctaagcctaaatttaacagacacctgataactctgtatagtacttgctgataggaaccgaagtaaacaagagtgacgcatagcaatgttgtcatttctactctaccgagtccatgtgggtatggagatagaaagaatgtgacttgattgaaaaggaatttgttgttgaatgagaggttaaactatgttcttaacttttaatcctatgtgcaaagccttttaaataatttggaaataatattacaaaaggaacaatttaacctaagttagttgtactctaccatttctttttcagagagaagaatcagtagagctacattttcttggcactccaaaatgtggatttcaaaactgttagttcagaagtgttcaacttttgctgcccactggaattatctggagagctgcaaaaggacactgatgcctgggctgcacctcctagaggtcttgatttgatcaatccaaaggaaggcctgggcagtaaatttttaaaagttccacagcatttctgatggcctcacggatcaggagtctgcaagaccaccctcaggcttcatgcactaaaaggactcacaggactcagaaaaagctgtcatactcatgtttgtggtttattagagtgaaagactacagattagagtcagcaaaaggaaaaggtgggtagggcagagtctaggagaaacaggacacaagcttccagttggcttctcccaaaggtgttgcatgaacagcacttaattatcttagcaacaatgtaacacacatgtaaatttttgcatcctatgaatctcatctgagccttggtgtccaaggatttttattggggttagtgacaaaggcatgcagcggctatgggacaacattaactactcagtctccagcccccagaggtcagtgtggttcaacaactgatgcagtgcggttcaacaacttagacgacaaaaacactcctggcaggcaggagatttcaagagagctcagaggtcacctcctggatgtcagccaaggaccagtccttttttttttgaatgtgcagggtttgagtaacccaagactgctgtgttaacctttttctggacacctatatacatatatttgtctgttctttggattctccattgaactgggtattgctgttactgtttttgccttcctagttcctcattaatgggctaaaataaatctttgacacgtttatgtttgcatatgagtcatgatttt

SEQ ID NO: 463243 - DNA, 954 bp, Homo sapiens
agcttcctcaccagctgtgaactctttgagagaagaatcagtagagctacattttcttggcactccaaaatgtggatttcaaaactgttagttcagaagtgttcaacttttgctgcccactggaattatctggagagctgcaaaaggacactgatgcctgggctgcacctcctagaggtcttgatttgatcaatccaaaggaaggcctgggcagtaaatttttaaaagttccacagcatttctgatggcctcacggatcaggagtctgcaagaccaccctcaggcttcatgcactaaaaggactcacaggactcagaaaaagctgtcatactcatgtttgtggtttattagagtgaaagactacagattagagtcagcaaaaggaaaaggtgggtagggcagagtctaggagaaacaggacacaagcttccagttggcttctcccaaaggtgttgcatgaacagcacttaattatcttagcaacaatgtaacacacatgtaaatttttgcatcctatgaatctcatctgagccttggtgtccaaggatttttattggggttagtgacaaaggcatgcagcggctatgggacaacattaactactcagtctccagcccccagaggtcagtgtggttcaacaactgatgcagtgcggttcaacaacttagacgacaaaaacactcctggcaggcaggagatttcaagagagctcagaggtcacctcctggatgtcagccaaggaccagtccttttttttttgaatgtgcagggtttgagtaacccaagactgctgtgttaacctttttctggacacctatatacatatatttgtctgttctttggattctccattgaactgggtattgctgttactgtttttgccttcctagttcctcattaatgggctaaaataaatctttgacacgtttatgtttgcatatgagtcatgatttt

SEQ ID NO: 463244 - DNA, 1505 bp, Homo sapiens
gctgccgccgcaccacctctccttctctgcctctgaccctccttctcgctgctccccctgcccagctgctcctcccacctggccatgaccaaagcccctgctggcaccctggcccagctctgagtcctgggaccctcggtcctctctcctgggccatggccaactcaggcctccagctcctgggctacttcttggccctgggtggctgggtgggcatcattgctagcacagccctgccacagtggaagcagtcttcctacgcaggcgacgccatcatcactgccgtgggcctctatgaagggctctggatgtcctgcgcctcccagagcactgggcaagtgcagtgcaagctctacgactcgctgctcgccctggacggtcacatccaatcagcgcgggccctgatggtggtggccgtgctcctgggcttcgtggccatggtcctcagcgtagttggcatgaagtgtacgcgggtgggagacagcaaccccattgccaagggccgtgttgccatcgccgggggagccctcttcatcctggcaggcctctgcactttgactgctgtctcgtggtatgccaccctggtgacccaggagttcttcaacccaagcacacctgtcaatgccaggtatgaatttggcccagccctgttcgtgggctgggcctcagctggcctggccgtgctgggcggctccttcctctgctgcacatgcccggagccagagagacccaacagcagcccacagccctatcggcctggaccctctgctgctgcccgagagtacgtctgagctccgcctgccctggccagccccccacccagtggcccccttgcccagcatccagccagcctcgcagcaccctgggcagggccactggggcataggatgggcataggtgctctgagcagcttgtcctcaacacaagcacccaccctgcaatctgagacccagatcctcagagagacaccagaggcaggacccagcccccaggcatacacacagatgcaggtccaggcacggtcttgtctgcacagcctggtgggcaccagcatgcatccctggagacaggccctcaggcaccagcccggctgtttactcactgaagagctgcttgggtgggacatttaaaaatctaagcacacttaaatatctcctagaatggggaaagaagggaaagccctggttcacctacagtgggggatctatcagatcctccagacattaaatttagataccaaatgttatacccttaaagttgctttccaagtttctctcatgtgaggacaccgtgaggtggtggtgaaggtggctttgtgcaatccatgtcagaagaggaccctcaccggaaccaaatctactgttaccttgacctggacttgccagtctccagaaccatgagaaataaatatctactgcttaagccacttagtctctggtattttgctacagcagcccaagcaggctaagacatggttccacagtccctttctagcagcagccctc

SEQ ID NO: 463245 - DNA, 760 bp, Homo sapiens
gtgagtttggggattgttgtgtccactaaccggactcagaagggacttccctgctcggctggctttcggtttctctgctcacctccggataaatcacggggtctcccgcgccgctcatggcgcctcccgtccgtctcgagcgtccctttccttcccggcgctttcctgggttgcttctggcggccctggtgttgctgctgtcctccttctccgatcaatgcaatgtcccggaatggcttccatttgccaggcctaccaacctaactgatgactttgagtttcccattgggacatatctgaactatgaatgccgccctggttattccggaagaccgttttctatcatctgcctaaaaaactcagtctggacaagtgctaaggacaagtgcaaacgtaaatcatgtcgtaatcctccagatcctgtgaatggcatggcacatgtgatcaaagacatccagttcggatcccaaattaaatattcttgtcctaaaggataccgactcattggttcctcgtctgccacatgcatcatctcaggcaacactgtcatttgggataataaaacacctgtttgtgacagtgatgacattagggagtgaggcctttggaaggtgatgagatcatgagagcagagctgtcacgaatgggattagcgtcctaataaaagaggcccagaagagctcctttgcccctcctgccatgggaagaaatgctgaatctgccagagaggttggtcctgaactccttagcctccacaact

SEQ ID NO: 463246 - DNA, 1058 bp, Homo sapiens
gtgagtttggggattgttgtgtccactaaccggactcagaagggacttccctgctcggctggctttcggtttctctgctcacctccggataaatcacggggtctcccgcgccgctcatggcgcctcccgtccgtctcgagcgtccctttccttcccggcgctttcctgggttgcttctggcggccctggtgttgctgctgtcctccttctccgatcaatgcaatgtcccggaatggcttccatttgccaggcctaccaacctaactgatgactttgagtttcccattgggacatatctgaactatgaatgccgccctggttattccggaagaccgttttctatcatctgcctaaaaaactcagtctggacaagtgctaaggacaagtgcaaacgtaaatcatgtcgtaatcctccagatcctgtgaatggcatggcacatgtgatcaaagacatccagttcggatcccaaattaaatattcttgtcctaaaggataccgactcattggttcctcgtctgccacatgcatcatctcaggcaacactgtcatttgggataataaaacacctgtttgtgacagtgagttgaaatatgcattcctatttcttttaccgatacattctaatttttctctggaataataaaaatcttaaccgaattccttctgtgcaatctgtacttcacatggctgaagacagccataatgttctcagatattcctatggggttcctggcaactctttctttaagttctttcttatcctgggatgtgtcttttctaattctaggggcctaaatacgtaaaaggcttcaaacttgattttacttcaataaacttgaaattatgttggttctaccacctccagtataataatcatcctgcttggcaaatcagtaaagattttaaaaattgatactcttcaagagaaaatgtgccttagagaaatcggataactttctaagatattaacttgcagactgaagactgaaacgcaagtccacccgactccagagacttggctttgctagtcagcatccagtcaggaaatcaaaactta

SEQ ID NO: 463247 - DNA, 426 bp, Homo sapiens
tcatctgcctaaaaaactcagtctggacaagtgctaaggacaagtgcaaacgtaagtaactctggagtgggaacccctctgttagtcaaacatctgtaagatctgattcaatttgttcaaattttgtaactgagttgcatacaacaattagtttgctaaggtgcaatacatatgagaattattcttgtagatcataccttgttactgctttgagttcctggcaccttcattacaagtttatttcatgagaaaccgtcattgcaggacatgattgagggaaaacccccattcactgggggtctcccattttcatgactaaaattaagtaatgaatgacttgggacaagaaagagaagtggattaaataactaaaagatgcgacaatcttgggccttgagatctttggattatatcagttgaattgaa

SEQ ID NO: 463248 - DNA, 365 bp, Homo sapiens
agtataattcatgtatcataaaagttaccttttcaaattacacaattcagtggtatttagtatattcataaagttgtatattacggtctgaatgtttgagtccaccccaaatccatatgttgaaatctttacccctaaggtgatgacattagggagtgaggcctttggaaggtgatgagatcatgagagcagagctgtcacgaatgggattagcgtcctaataaaagaggcccagaagagctcctttgcccctcctgccatgggaagaaatgctgaatctgccagagaggttggtcctgaactccttagcctccacaactatgagaaataaatttttgttgtgtatgagctaaccagtttatagt

SEQ ID NO: 463249 - DNA, 1012 bp, Homo sapiens
ctcactactaaccttaagaaaggaagtaaccaaaatccaatacatgagcaactgtgagttgccatcatccaccgcctttgtctggaaggaagcgcagggcctcacacgcgggatccatcggaagcccaagcattgtcaagctctgctgctgcacctgggtcagcaagatcaatgcaatgtcccggaatggcttccatttgccaggcctaccaacctaactgatgactttgagtttcccattgggacatatctgaactatgaatgccgccctggttattccggaagaccgttttctatcatctgcctaaaaaactcagtctggacaagtgctaaggacaagtgcaaacgtaaatcatgtcgtaatcctccagatcctgtgaatggcatggcacatgtgatcaaagacatccagttcggatcccaaattaaatattcttgtcctaaaggataccgactcattggttcctcgtctgccacatgcatcatctcaggcaacactgtcatttgggataataaaacacctgtttgtgacagtgagttgaaatatgcattcctatttcttttaccgatacattctaatttttctctggaataataaaaatcttaaccgaattccttctgtgcaatctgtacttcacatggctgaagacagccataatgttctcagatattcctatggggttcctggcaactctttctttaagttctttcttatcctgggatgtgtcttttctaattctaggggcctaaatacgtaaaaggcttcaaacttgattttacttcaataaacttgaaattatgttggttctaccacctccagtataataatcatcctgcttggcaaatcagtaaagattttaaaaattgatactcttcaagagaaaatgtgccttagagaaatcggataactttctaagatattaacttgcagactgaagactgaaacgcaagtccacccgactccagagacttggctttgctagtcagcatccagtcaggaaatcaaaactta

SEQ ID NO: 463250 - DNA, 1373 bp, Homo sapiens
gcagagcacttgggtatggcgggctgcaggtcccgagccgtgccctttagggaggcggctgaggcccagcgagaattcaagaactgtgcaggtaggccagtagtgctgggagacctggcgcaccctctgcagctgctggcctgggtgctaagcccctcattgcctggggccagtggcatgggctggcctctccgagtgcggggcctaccaagcctgcacccacccacccggaacttgctctggcccgcgagcgctgtgcgcagccccggttcctgccagtgcctctccctccacacctccccacaagcagagggagccagctccagcctcggccagcccagagaggggctcccacagtgcagcggcgggctgaagggctcctcaagcgctgccagagtggacaccgaggccaaggaggcacagagaggaaaatgtgttagcagccactaagaggagaggcaggggcaagcacattccaccctcattgcaacaataaaatctgaacagaacacatggcgtgcctatctgaggactctgaaaagtaaatggtagcagatggattaagaaagaagaccagaactcaaactgtcagtgaatcaacaatgttctgatgcacagatttcagtcctagcactgctgcagccatgtcaaacccagcttgagggtggagccaatacacaaaagagtacacagccaagagtattgcagggacctgggcctctggcccctggctgaagccaatcctgaagtctactctacctatagacttctggttataggagcctattaatttccttattgttcaagatagtttaagggatagctggttttggcataccacagcagctaattggcaccactctgtaaaggtgctagggaagcccagagaaagacacacctcatgaagctgagtcaagaaataaaaaaggacagaagataggtccggaagtctacagtcgacaggctgctttcccatgacaccttgaatcctaacactagcctggaaaaatggactattatcctcattgtatgtctcagaagagttcatggtttgtccatggtcacaaggcaaggaagagtcaagattgaaacccaggccttccagtgccacatcgcatgatttcccccatattctcctgaaccaggacttcttttctgtcatccttttgctcaaaaatatttaacatacgcccttgtctctggagcatgttcaaactttctagctgaggatttgaagttttccgcaaagccgctctactccaaaagatttaagctcatcattccagctcattcctccaattggaccttcgcttagacttcccttatctgtactttcttgccatttcttctccatgtgtttgagttcattcttt

SEQ ID NO: 463251 - DNA, 746 bp, Homo sapiens
agctcacattgcttcagctcatgctcggttcactgcacccactgtcctgcacccactgtccaacaagccccagtgagatgaacccggtacctcagttggaaatgcagaaatcacatgtcttctgcgtcactcacactgagagctgtagactggagctgttcctatttggccatcttggaacctgccaagtgttttttctaaagaagtggtatttatgggtggtatgtcctctttcttcatgtcaccagatgggatggctactttgtggaaaaatggagagaagagaagactacagtgatgggaccaggaaacaggatatctgtggtcagaagttgcctcttaggactaaaccagtgaaagatgggaaaatccatgatggaagcttgcttgaactctgaagaaacactggcttctttgtaatccaatttccatattaaatgacagtccagccagtaccatgaaagttgaaaatcaccatgacaatgacaagaagagaccaaaaaagggcagaaaaggggctccttgattccagggaaatcttcaaccctccttgattccaggaaaatctttatcccttcctaagaaaagcgtaagtattcctgcctttgctttcaattcccaaccccttcattaaagctatcctacatctgtaacttcctggttctcaggagccaagaagttgattggtgggccactctcccacttctccattttatgaccatcaaataaagcctgcacttctcaat

SEQ ID NO: 463252 - DNA, 859 bp, Homo sapiens
agctcacattgcttcagctcatgctcggttcactgcacccactgtcctgcacccactgtccaacaagccccagtgagatgaacccggtacctcagttggaaatgcagaaatcacatgtcttctgcgtcactcacactgagagctgtagactggagctgttcctatttggccatcttggaacctgccaagtgttttttctaaagaagtggtatttatgggtggtatgtcctctttcttcatgtcaccagatgggatggctactttgtggaaaaatggagagaagagaagactacagtgatgggaccaggaaacaggatatctgtggtcagaagttgcctcttaggactaaaccagtgaaagatgggaaaatccatgatggaagcttgcttgaactctgaagaaacactggcttctttgtaatccaatttccatattaaatgacagtccagccagtaccatgaaagttgaaaatcaccatgacaatgacaagaagagaccaaaaaagggcagaaaaggggctccttgattccagggaaatcttcaaccctccttgattccaggaaaatctttatcccttcctaagaaaagcgaggtacaagttcaatctctgaagatgatggaggaatatatctacgcttgaatccatctggagttacaactttacacctctctcttcaaagtcctctttcccaagacaggcgcccctttctagggtcattcattctaaaatctatgtgtaattccagcctatttgaactggaataggagtaatcaaccaaatcagtgttgttttcaacagtaagctctaaagatgagatatattttaataaacatgtatcttttttattatactttaagt

SEQ ID NO: 463253 - DNA, 1639 bp, Homo sapiens
acctggcaaaagtatagctcaaatgtgcctcagctaccatttcctggtggcagtcctcaaccaatgggtgccgggaattggtgaacaacgccccagccccccagcctccagagaaacaattctaagtgacatggatgatgataaccagtctatgcccacagtgattatcagctcagcaatgtaccctttactggcttttctccttccatatgtcactattcctgctccctcactcctgcttcctggaattaccttcccagaaaaacttcattcagcagcactggagccagactcagttcccggatcttgcagccgaggagcctctcaagcatccacagcccccaccagtgtggggacggtggatcctgtggtggacatccccggggatctcttcacaataaatcttgctggtgctaactctctgggtccgtgacatcttcaagagctgtaacactcatcacaaaagtccgcagctccattcttgaagtcagcgagaccaagaacccaccagaaggaaccaactccagacacaccctgacgtgggataccccatttcctgaggcatggagaggcatcaccccaaccaccctggcctgccacgctcccatcctgtgcctataaaaaccccagaccctagcaggcagacatccaggcagctggacatcaagaggagtgcatcagcagaagaacacatgggcagctggacgtcgagaggaatgcaccgacgagtaccagcacgccggcaggccaccaaccactgcagcaggccacagaccacccctgcagaatgacacggagtttggctggggcagtctgaggagagcccaggctgctgagctccagggaaaaccatctcccttctggctcccccatctgctgagagctacttcaactcaataaaaccttgcactcattctctgagcctatgtgtgatccaattcttctggtacaccaacccaagaaccccaggatacagaaagccctctgcccttgtgataaggcaggggtttaattgagctaacacaagcagcctatggatggctaaactaaaagagcaccgtgtaacacacgcccattggggcttcaggagctgtaaacattcacccctagacactgccatggggctccctgcccgtctgtagactcccctacaggcttgtgcagcggggcactgaagaagcaagtcacaccctcatctcacgccctgcgagggggacaagggaacttttcccgcttcaactgtatgcttatacttaccttgctctaaattgtctttatctgttagaatttaatggtatttaaacattggtaatagttgataacaagtataatatgttcatcaactaatgtacttgatgttgccaacatatgaaaatttgagtccttcaaatgtcatatgagtatttgcttcatggtctgaaaaacaagtttctcaggtagggagataaagggaaacattattacatttcagcctggtaatgtggcattacatgaccccggctgcctttttaggggaagtcagcaaattgttttacttcttcgtgatctgtttctcatttataaactggggctaatatgatgggtacctaagctctaatttattcctagatattgatcacaagctaagcttccataagtt

SEQ ID NO: 463254 - DNA, 1314 bp, Homo sapiens
acctggcaaaagtatagctcaaatgtgcctcagctaccatttcctggtggcagtcctcaaccaatgggtgccgggaattggtgaacaacgccccagccccccagcctccagagaaacaattctaagtgacatggatgatgataaccagtctatgcccacagtgattatcagctcagcaatgtaccctttactggcttttctccttccatatgtcactattcctgctccctcactcctgcttcctggaattaccttcccagaaaaacttcattcagcagcactggagccagactcagttcccggatcttgcagccgaggagcctctcaagcatccacagcccccaccagtgtggggacggtggatcctgtggtggacatccccggggatctcttcacaataaatcttgctggtgctaactctctgggtccgtgacatcttcaagagctgtaacactcatcacaaaagtccgcagctccattcttgaagtcagcgagaccaagaacccaccagaaggaaccaactccagacacaccctgacgtgggataccccatttcctgaggcatggagaggcatcaccccagtaagttgcccatgccctgtgctggcagcctcccttttacccccaaccatcctttgctctagcttctggccccaaatttgtccaaggagccccccattcaaatcctttccctgctgccacgtggccttccctgtcccacagcttgctctgcaagcctccaatgtctgaagatcttccagtgtcactcatggcccctttagtctcagcccagccataaacttcaatgcaaaggataagtctagattgatttcacagttcttttaacaagtggacttaaaagctagtggcaatacattccttctcctcagagttgaaggcaagttctccctgaagcctgggtgacacatgtccttttcctaagactggggaagagaattgggagtggcagccagttcggcaggaaatttgttagcaggggaagaaactcagatgggagtgaggaacttcacaggaaaagtctggaggagcatccaaggatgatcaacatttattttatgtgtgggaagcaatgcgactttactgttattgaccctttacaatatcccctgtaaatgtatgtttagggttttcttctgaaaaagaaagaaattgttactcagccagtaaatgatacttaaagagagaaagagggggaaaaaaggaaggaagggagagagaaagtgggagtagatgaaagtgagggcgagagaaagaaaaagaaaggaattgttattcagccagtaaaagatactt

SEQ ID NO: 463255 - DNA, 1116 bp, Homo sapiens
ctcgaggccactggtgcttgggggtgggaaaagagtgaccgggggcaactgagcaaaacatagaacagaaactccctctcgaatagagacccacgcacggaaggatgatacactgtgattccccgacgtgggcctgcagcaagagacgggtgctaacagcgtccgagccaatccgtgcttatcacacatgcagtcaatgaacacctcacaaatgcaaggttcacatgcagtcttcgatgaacacatcgatcgcatccagcagtatgtctgtattggaaaagtccttccatagcacccagccagcaattggcttctttcagacactattgactgcaacaaaccctagcacaaggagagggtctaacgagaaacttgttcagaggatgctgacccatccatcagtgagcacagccaacccaaaaaggcggggacgcggcagagcaggggctgagggcacacttgctgcagtgttcacggagcacacacagaaagatctgcccgagagagtccccaaaaggcacaattctacaaggtcaaccaagtggaggggaatggcagtgaaacgccaaactcctactgaaaggttgatgggtacagccttccagagacagggctgggtggcgggaacgcgggcacccagaggtccagatcagcaaaagaggccagtgactctgtctccatcagataaaattcagccacagcgggagggagcgtgtgagacccacgaaggccttgccctggacctacacctcaccctgttccagagagaattcagtggccggcaacactgccagttcccctttatttcccttgaggtcaacattttggaattttctactcacatccaccgagcgaccctcctcggccacctccacacccacactccaggcccaccactgcccttgggcatgagcaagcctgacgctgtctctcatcctggtaacaccttcttccccgcacacacctcggccacaggctaggggcagcggaaaggccctgctggaaatttccatccagggtctgtgcagggcgggtaccccagagccgcagggcagggcagatggctcctcagatcgggctggagagacatccaggaggaggatgccagttgttggg

SEQ ID NO: 463256 - DNA, 1308 bp, Homo sapiens
ctcggaagcatcagggtaacaatgggacaaatgtgggctgtggttcgttctaccttggaactttttcacactgataatgaggaggaaggagagtataacaaagtaacagtagaggttacagaccaggtttatttgccacctaaagctaaagcagaaaaggagggagaagttcatccctatccttctgcaccccctcattattattttgaagaaaatgaccctccagatctttcttttctggaggacactggagggaaagcacatttagttgattataacaaggcctgtgatgatatcagagataatctacataaagctactttgttggcacaggcgacggcaggactgagagtggataaaggaaatactctatttcctggagcttgttttaactgtgggaagcatggtcatactaaaaagaatttaaaaaaaaaatcagcaagtcaggccaccagataggtgaaaaaagaaaactgctcatcctgaaatatgtctaatgtaaaaaaggaaaactttgggctaatcagtgtcactctaagtttgataaagaagggaacccgattttgggaaactccctgaagggcccatcccaggccctgttctaaaccaggacatttccagctcaggccattccctcacccccatacattatctgtcccccaccatagcccatagtgccgcagtagatttatgctgcacaaaagctctatttttaactcacaatacattagataaactacattgtgaacaaaaatttgagccatttatctgtctctctaactgattactccagaattcagaagccattagtgagcattcttaaattatgacaatataattatttgcataattttaatgtgaatctgtttttgataacaggattcaattggagacactgtttgttttatcaaggctttaactcgaatggcagctacaaccagaccactttaaggaattgaggttgactttatagcaccaatacaaagccccttataatgactggcttggtgtcttgtctacaagggtcctttatattcactgtccttctggtaagaagtaaagaatgtcactttctgacgggcctaggaacctcaagatatttggggaccttgagaagagaggactacacccattcataaaagtattacaggagagctggcaagatgtctgagtaggaagagctctgacctgcagcacctagtgagatcaacacagaaggcaggtggttcatgcatttccaactgagcctccactggtgatacccaggcaaacagggtctggagtggacctccagcaaactcgagcaaa

SEQ ID NO: 463257 - DNA, 1472 bp, Homo sapiens
agcaacgatccagatggtggctgtgctctgtctgcgtgggtcccagagtgagaagctgaggtgccggccttgttgaacagggagggctgctctctgctctggagatggcactgtgctctcatgtccacattgtggaaggcggaagggcgagagaggctgggtgacacctcttcttgccttagaaacacgagcgagtggttctgaacagccgcggtcttgcatgcctgcccctcagcaacggccctgctccaaaccggtgttacagtgatctgattattgtaattgatgacattaggaataaggaatccacacagaataatacaggtgcctgtcatgccagagtggttttattcattgttagagaagttcataaagttgaaagaaagcatctacatgggctagaacagcaaaaagcatgttttagtcctttcttaatttgtgaataaaatgatgaattccagaagcctattttcactgacaattgaaatcagccctgtacacccctgcacctgctctctacccctgggagttctgctctgtcttccagtctctgcgggaagctcccgccctggccagccctaggctccctgctgtccccaggccccagcttctgtttattcttccatgctggcctcatgcaatttctcccttggaccctctccccagtctggctgcagagccagtcccttttgggtgtgaccactgataatagacatagggatctggaaactgtcattcatctttctagaaaccagattctctttttagggggtagctgtaaactctatggatttctgctgtccattttacaattaaatataggatatctatcatttcttgagtgtgacaatgtgcagaagccagcattgcccttggagggccccagcagcgtgttcggtgcatgtctgccccagaacttgggtgatgattcccagtgtcaatggtcaatgagcattgtcagggatggaggcagagatcatcctactcagtctgactgaggtgggcatgtgcaggaaaaagacccaggccaactcactacctcccagaagtgggacaatgatgggctggggttctggaggcaaaggatgctggtatgaacagtccctttggaaagcccttcctggcttctgttttataactccaaacaataggccctgccaaatatatttttctaacatcacaagcttgttgcaaagtcagttttatggatgcactaaacctgccttttaaattatcatcaagtataataaaatggcagaaaatcatcaattttccgagaatgtgagtaaagtgaaagttagttacatgttggcatgtgggctgcagtccagctgtgtctataatcggaattaagccctgcaagctttgtgggaacagctgttttctgatggaacagccaggcttatattttatttggaggaggccccagtgcctgtcgtttccctctttgtgttcatgagttctcatcattt

SEQ ID NO: 463258 - DNA, 853 bp, Homo sapiens
aagagcatccttactgattcagaatgcttggtaaactgaatacagaagaagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccagaaattgagacaacttgaagaaacaaaagacgatcccgagaatagattatcgaaaatttccctagagtcattcaataaatttaacagcaatactgtgattttattagaaaaagagaagaactctctgaacaaggttgaaggacagaaggaagaaaaagaaaaaaatgaagagacatctttgagtagttcagataggcctggggtagacaacttggaat

SEQ ID NO: 463259 - DNA, 1025 bp, Homo sapiens
aagagcatccttactgattcagaatgcttggtaaactgaatacagaagaagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccaggtaacaaccagcgaacttgctggccctgcaggttcctctctctgggaagccgctgattatacctttcactgtgctcggcccccaccctctttgattttatgttttttcttcatgtctctcctgagatctaattttctggtacatacagaagattgtctatgcacatccatttgttttctggtgtaatcttcatgacattgcagtgcagtctgtaaggattttatttctgaatccagcatgtctaaaacagcctccaattgagttatctcaataatgaaggaatgactataaagataactgttcttaattatatactctggcaagttaaatcatccagtgagctgtggatggagttttccaggctctctgctaacgtcatgctgtgtagc

SEQ ID NO: 463260 - DNA, 2779 bp, Homo sapiens
acagaccaggtgcagtttgagaagtgtggcaagagggtggatcggctggatcagcgtcgttccaagctgcgcgtggctgggggccatccgggcaactcaccctggacagtcagcttggggaatcggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcggggggtctctagtgaaggagcagtggatactgactgcccggcagtgcttctcctcctggtgagcctcccttgtgtttggggacccagtctcatcccaccttcccctttccccaggcaagctaacaagtgagccttggggcaatggactgagagtcacaaatgacctagcagagcttctctcccagccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagagatctgtgaccctgaaccagcgtgtggccctgatctgcctgccgcctgaatgatatgtggtgcctccagggaccaagtgtgagattgcaggccggggtgagaccaaaggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaaccgagtatgcgcaaggtcgcgctggccagccgtcttcacacgtgtctctgtgtttgtggactggattcacaaggtcatgagactgggttaggcccagccttgacgccatatgctttggggaggacaaaacttgtaagtacagtcaaggacaagacttgtactcaaggctgagatttaataaaattcatatttttactacttcaccaaggactttcttaaatgaaaatggtttttccccctacaagtaaacagtaataaagaagagaattattcctatattgagaagtgcaaacattattggaaaagagagtctcactagcataattgtgcattatcttcctcttatatcgccggcctccctgcacccccatgcccacctcctcctcgcgcctccatgccgcctcccaccgctccagctccttgcagctgcgagtccagtcactggtcacctttcgtatctcctcactcagagcctggctggccaaacctgcctggtccagctgttctcagagcatggcattcacctgggccaggctggcactcctgaatggggcacaggggatcagtaggcgctcgcccagggggccatgctgcgagccctggccctccctgctgctcctcctccagccagatgagggcactctccaggtcttggctgtgctctgcgtcctgggtgacagagaggttaaagcatcaggctgggcaggtggagggcagggcctgcctctgccccaccctggcacccaccctcagctgctgctgctccagctctccggatctctccaacagctgctccagctccgagaacctcttcttgtactggagaatctggggattgggagctgatggtgagccccaggggtgggggcagggcaaagtgaacacgtgggagggaaagagcaggaatgggtggccctgaccttgccctgcagccgctgcacaagctgggcctgccgctgctggccctccaggtaggcctgcagcttgcgccactaggaggcctgctcctcctgcagctgcctccgcaactccacgctctggagtaccagccccctgggctcttgcatctccagctcaccagattccagccacagagcctgctccagctgcagggaagggccctggggcatttccgccaagacaggtgagactgcggttctgacctgcgggcctccgtgcatatgcgctagggcacctgggggccggcagagccgttcccctacgcaaagtaagcgtgttttgtctacaacccaacggggacactgagagccccaaaggccctgctttcttcccagagaacagcgcccatctgcataatttctacctggctctatgaggtaagtatgagagcttgggcctctgccccgacacagcctcatacgcctcactctttacacacacggtcacttgccccgcgcactcccgagccctttccagccctgacacacagctgggattctcacttccgatcagcggtcctgaacccgctcccagggcacgggaactccttcgtggtgaagcagcaagtggcgaagcagcagcctctgcgctgcctcatctacatagaagtcgccctgtccgtgatgtcaccgacagtgccttgcccagtccccgtctgcctttctgccactcaaccgaccaatctgctgccagagccgccaaggggaagtgacgtctgcctctccctttttccctcccgcccctgcgtctgttctctcccaaagaagctggtccttagcctgtgttaaggagcaacctttcggtggccagatggagccggggcatccttcttcaaataatggcttttaattc

SEQ ID NO: 463261 - DNA, 2652 bp, Homo sapiens
acagaccaggtgcagtttgagaagtgtggcaagagggtggatcggctggatcagcgtcgttccaagctgcgcgtggctgggggccatccgggcaactcaccctggacagtcagcttggggaatcggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcggggggtctctagtgaaggagcagtggatactgactgcccggcagtgcttctcctcctgccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagagatctgtgaccctgaaccagcgtgtggccctgatctgcctgccgcctgaatgatatgtggtgcctccagggaccaagtgtgagattgcaggccggggtgagaccaaaggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaaccgagtatgcgcaaggtcgcgctggccagccgtcttcacacgtgtctctgtgtttgtggactggattcacaaggtcatgagactgggttaggcccagccttgacgccatatgctttggggaggacaaaacttgtaagtacagtcaaggacaagacttgtactcaaggctgagatttaataaaattcatatttttactacttcaccaaggactttcttaaatgaaaatggtttttccccctacaagtaaacagtaataaagaagagaattattcctatattgagaagtgcaaacattattggaaaagagagtctcactagcataattgtgcattatcttcctcttatatcgccggcctccctgcacccccatgcccacctcctcctcgcgcctccatgccgcctcccaccgctccagctccttgcagctgcgagtccagtcactggtcacctttcgtatctcctcactcagagcctggctggccaaacctgcctggtccagctgttctcagagcatggcattcacctgggccaggctggcactcctgaatggggcacaggggatcagtaggcgctcgcccagggggccatgctgcgagccctggccctccctgctgctcctcctccagccagatgagggcactctccaggtcttggctgtgctctgcgtcctgggtgacagagaggttaaagcatcaggctgggcaggtggagggcagggcctgcctctgccccaccctggcacccaccctcagctgctgctgctccagctctccggatctctccaacagctgctccagctccgagaacctcttcttgtactggagaatctggggattgggagctgatggtgagccccaggggtgggggcagggcaaagtgaacacgtgggagggaaagagcaggaatgggtggccctgaccttgccctgcagccgctgcacaagctgggcctgccgctgctggccctccaggtaggcctgcagcttgcgccactaggaggcctgctcctcctgcagctgcctccgcaactccacgctctggagtaccagccccctgggctcttgcatctccagctcaccagattccagccacagagcctgctccagctgcagggaagggccctggggcatttccgccaagacaggtgagactgcggttctgacctgcgggcctccgtgcatatgcgctagggcacctgggggccggcagagccgttcccctacgcaaagtaagcgtgttttgtctacaacccaacggggacactgagagccccaaaggccctgctttcttcccagagaacagcgcccatctgcataatttctacctggctctatgaggtaagtatgagagcttgggcctctgccccgacacagcctcatacgcctcactctttacacacacggtcacttgccccgcgcactcccgagccctttccagccctgacacacagctgggattctcacttccgatcagcggtcctgaacccgctcccagggcacgggaactccttcgtggtgaagcagcaagtggcgaagcagcagcctctgcgctgcctcatctacatagaagtcgccctgtccgtgatgtcaccgacagtgccttgcccagtccccgtctgcctttctgccactcaaccgaccaatctgctgccagagccgccaaggggaagtgacgtctgcctctccctttttccctcccgcccctgcgtctgttctctcccaaagaagctggtccttagcctgtgttaaggagcaacctttcggtggccagatggagccggggcatccttcttcaaataatggcttttaattc

SEQ ID NO: 463262 - DNA, 2603 bp, Homo sapiens
acagaccaggtgcagtttgagaagtgtggcaagagggtggatcggctggatcagcgtcgttccaagctgcgcgtggctgggggccatccgggcaactcaccctggacagtcagcttggggaatcggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcggggggtctctagtgaaggagcagtggatactgactgcccggcagtgcttctcctcctgaacccacaacatggagagccaggcctacagcgggtcccagtagccaagatgctgtgtgggccctcaggctcccagcttgtcctgctcaagctggagagatctgtgaccctgaaccagcgtgtggccctgatctgcctgccgcctgaatgatatgtggtgcctccagggaccaagtgtgagattgcaggccggggtgagaccaaaggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaaccgagtatgcgcaaggtcgcgctggccagccgtcttcacacgtgtctctgtgtttgtggactggattcacaaggtcatgagactgggttaggcccagccttgacgccatatgctttggggaggacaaaacttgtaagtacagtcaaggacaagacttgtactcaaggctgagatttaataaaattcatatttttactacttcaccaaggactttcttaaatgaaaatggtttttccccctacaagtaaacagtaataaagaagagaattattcctatattgagaagtgcaaacattattggaaaagagagtctcactagcataattgtgcattatcttcctcttatatcgccggcctccctgcacccccatgcccacctcctcctcgcgcctccatgccgcctcccaccgctccagctccttgcagctgcgagtccagtcactggtcacctttcgtatctcctcactcagagcctggctggccaaacctgcctggtccagctgttctcagagcatggcattcacctgggccaggctggcactcctgaatggggcacaggggatcagtaggcgctcgcccagggggccatgctgcgagccctggccctccctgctgctcctcctccagccagatgagggcactctccaggtcttggctgtgctctgcgtcctgggtgacagagaggttaaagcatcaggctgggcaggtggagggcagggcctgcctctgccccaccctggcacccaccctcagctgctgctgctccagctctccggatctctccaacagctgctccagctccgagaacctcttcttgtactggagaatctggggattgggagctgatggtgagccccaggggtgggggcagggcaaagtgaacacgtgggagggaaagagcaggaatgggtggccctgaccttgccctgcagccgctgcacaagctgggcctgccgctgctggccctccaggtaggcctgcagcttgcgccactaggaggcctgctcctcctgcagctgcctccgcaactccacgctctggagtaccagccccctgggctcttgcatctccagctcaccagattccagccacagagcctgctccagctgcagggaagggccctggggcatttccgccaagacaggtgagactgcggttctgacctgcgggcctccgtgcatatgcgctagggcacctgggggccggcagagccgttcccctacgcaaagtaagcgtgttttgtctacaacccaacggggacactgagagccccaaaggccctgctttcttcccagagaacagcgcccatctgcataatttctacctggctctatgaggtaagtatgagagcttgggcctctgccccgacacagcctcatacgcctcactctttacacacacggtcacttgccccgcgcactcccgagccctttccagccctgacacacagctgggattctcacttccgatcagcggtcctgaacccgctcccagggcacgggaactccttcgtggtgaagcagcaagtggcgaagcagcagcctctgcgctgcctcatctacatagaagtcgccctgtccgtgatgtcaccgacagtgccttgcccagtccccgtctgcctttctgccactcaaccgaccaatctgctgccagagccgccaaggggaagtgacgtctgcctctccctttttccctcccgcccctgcgtctgttctctcccaaagaagctggtccttagcctgtgttaaggagcaacctttcggtggccagatggagccggggcatccttcttcaaataatggcttttaattc

SEQ ID NO: 463263 - DNA, 1538 bp, Homo sapiens
acagaccaggtgcagtttgagaagtgtggcaagagggtggatcggctggatcagcgtcgttccaagctgcgcgtggctgggggccatccgggcaactcaccctggacagtcagcttggggaatcggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcggggggtctctagtgaaggagcagtggatactgactgcccggcagtgcttctcctcctggtgagcctcccttgtgtttggggacccagtctcatcccaccttcccctttccccaggcaagctaacaagtgagccttggggcaatggactgagagtcacaaatgacctagcagagcttctctcccagccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagagatctgtgaccctgaaccagcgtgtggccctgatctgcctgccgcctgaatgatatgtggtgcctccagggaccaagtgtgagattgcaggccggggtgagaccaaaggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaaccgagtatgcgcaaggtcgcgctggccagccgtcttcacacgtgtctctgtgtttgtggactggattcacaaggtcatgagactgggttaggcccagccttgacgccatatgctttggggaggacaaaacttgtaagtacagtcaaggacaagacttgtactcaaggctgagatttaataaaattcatatttttactacttcaccaaaaaaaaaaaaaaaaaaaaaaaaaaaaaaaaaaacaaacaaacagaaaaaaaaaaacgacacgaccaaaaaaagacaagaaagaacaaaacaaaaaagcaaacaagtgaaagaaaaaaacagacagacacagcgaccgaaaaggaagaagaaaacaagaacagaaaaaaaagggtggagagaggcacgcggagcaggagaggaaggggatgaaaaacaaacgaagaagaagaggagaggggggcgcgcagagaagagaagaagcacaaagaggaggaggcgaggccgagagagggagcaacggggcgaagagtgaaagtggggagagacgcaacaaaaaaaggagcgggggggggaggagagaag

SEQ ID NO: 463264 - DNA, 1150 bp, Homo sapiens
tgggcccaggtagatgaggcctggagcctggctggccgggccatgctgctggaggtgcagggcacaccccctgggttctgcactgacttccacagccacctctttcttgcctgcttcatgcttgtgctcacacagagctccatcttcagcctcctgtccatggccatcaacaggtacctggccagccacagtcggctcaggcataaaagtttagtcactgggacccaaacaagaggggttactgctgtcctctgggtccttgcctttggcactggactgaccccattcctggagtggaacagtaaagacagtacctctaataactgcatggagccctgggatggaaccatgaatgaaagctgctgccttgtgaagtgtctctttcagaatgcggtacccatgagttacatggtatatttcagttttggggggaccaccctccagtgggagatatacacagccaagtcgctggctgtgatggtggggatgtttgctctgtgctcgctaccagtgcgcaccatggactgtgtcactctttttcagctagctcaggctaaagataagcccaagtgggcaaggaagatgaccattctcttgtcacatgcaaatttgattgtcaatcccattgtctataaccactggaacagagaatcctgctatacttttcataaaattatttacagaaaactacctgaggggaagaaattggaaggatgagatccgtcttctaccaaattcccctttccagagctagggagtgaatttcgcttctctccagcgttcaagtttggccaagttcttggaacctaaaacatgaacttttcactaagcaaaattatataactatgtgtacatattaggtgaaataaaaataaaacattttaaaaattaaattaaattaattaaatagaaattccaatattctgcccatcctagcagttctcctgcacgtccccttttggaggctatggctctaaagttgtattagagaaagaagtcagcatatgttatgcttttaattagtcctttgggacgtgagttatgggacaaaccttcccttggcttagggtgagctccagtaagtcagatacagaaagaaaaatattgcattatctcacttaaaaaaaaaaaagaaaaacttgaatatata

SEQ ID NO: 463265 - DNA, 719 bp, Homo sapiens
aaactattttactctgaaacactgtgaactattataaagcaaatatgttttaacttagaggcaatgaaacaataaaagttgcctgtactaaaaatgtgtatttgtttctaagaaggcagccaggaaaattaaaagtataattcttcaatcaagaaactgccacattaatttgaggaaatgatagtctcctaagttcttaagtagaattgtcaacacgtaataattttaagctccgttcttttccatatacagaaaactacctgaggggaagaaattggaaggatgagatccgtcttctaccaaattcccctttccagagctagggagtgaatttcgcttctctccagcgttcaagtttggccaagttcttggaacctaaaacatgaacttttcactaagcaaaattatataactatgtgtacatattaggtgaaataaaaataaaacattttaaaaattaaattaaattaattaaatagaaattccaatattctgcccatcctagcagttctcctgcacgtccccttttggaggctatggctctaaagttgtattagagaaagaagtcagcatatgttatgcttttaattagtcctttgggacgtgagttatgggacaaaccttcccttggcttagggtgagctccagtaagtcagatacagaaagaaaaatattgcattatctcacttaaaaaaaaaaaagaaaaacttgaatatata

SEQ ID NO: 463266 - DNA, 1571 bp, Homo sapiens
attgacaaaagattaaaaatttgtttatatactgttggtgaagcatggatttacagtaccattgtgcctggaaggtgtttgtgtcccccattaaacctattggaacagcaggcccgcggggttcactctggaatggctgcaatgctgacgttggaggacatgttaaagctcacctagctctacctcatcttacagaagcaaggcccagtggcttgcttcaggccccgcattttgatagcctcggagccaggaagtttgtggtgattttttgcggcagctgcaggaaacagaaaatgcactgcctagatggaccctctgactccccaccacccaggctggagcggcagaggctgccaggaagagccagaaaacaggtcactgaccagctaatacaggccaaggctgctgggaggccaggaatatggccatgaggagcacagcacgatgttccctctatcacgtgtgcatattctagtggaggaagactgacagtaagtaggaacactctactggtaaggggagaaatgcctcaaatgagcatgtgcacaacttcagtaaacatgctgtgcatgtggcccctcccaagtgcccgcaggccaccacacaagtggacagccctggacagcccgcccctagggaagaatcaagggaggagaaacagaagccctggaactgtgctagcatataaaaccccaagtcaagggctgaatggcacacttggatctctcaagtcacctgcttggcccccttccaagtgtatttacttccatttgttcctgctctaaaactttttaataaactttcactcctgctctaaaacttgcctcggtctctccctctgccttaaaactacttctgcccccgcagccgaattctttcctctgagagggcaagaatcaagttgctgcgcacccctgcagattcactgctgctaacaatggggctggttttctggcctgtggaacgtgggctaaagggatgagcagccctgcctggctcggtcctaaaacctgccataccatcctccccctgttttcttcccgtctgcttgttggatgcaggggacccagggtggtactccaaggccctgaaagacagtggagctacttgggaggagcccaggtcccgaatgccttagtggagcagaatgtctgctacactcaactcgtattggactctgaaggcaaaactcacctttgttgtgttgagccactaagttttgggggacatctgaaacaggctgtgctgattaatacggagcggccaggagggcatgggaaatgatcagttttgtgggctgggggagaggcagtgggatttggtggaagtgtttccatgagggggcagagaagagcctcctggagatagaaaggtgaagtggaaagtgctatcctaaattgagaaaagggagccagtgtgtgtgcaccctcttatatttgtaaattagagttaacacttctggtggggccctctgtaaactgtaaatacggataataatgaaggtttgtattgcatacacacttttctaagtgcttcagatggatgatctcatttaaccttcataacatccc

SEQ ID NO: 463267 - DNA, 1530 bp, Homo sapiens
cagtttttaattccctctccccacaattcgtcggtagcccccagcaaaagctgattctgtagtccttataattactacttcctgtcagcctttcagatgcctgagatatttcacctcccaataaatttccttcagttggtatcctgtgcccacttcgtggttggtgaaagttttaataattgcactactgcttatgtggggggctatccatacttccacctaccatcagaaaatccaggtgacaccaagacacacttggagtttttgcaccagagatttaggtacttcagccacgtctatttccaaaccagaaataactcagacgtagcctcagcagcactagagatccacattagttacactggcttaggatttaaatgttcacaggcatcaatcatcatattaatgtttcagtgccgttcaatcccctgtcaatcattgagtaacttgcccaaaatcctgtgtggaaactcattactgttaaaggtgttatttttggatggaagcaaatgattgtagcacctctaatgctgtatgcacagcctctcaggcaggtggtgttccacgtccgtgttctcccttccagttcactgtgccttgaaaaatttttttacataaattatcctatatccaaaagcttatgtttaacagttttaatatttctatggttatatgttatgcatttttcagtattccattcctattgattagttaataaccataggcattttatagaaataagagtaggaattcataaacaactgtcctcatagtgggcttaattttctgatgaaaatatggcatttatatgctttcagcatacaatttaagatttcattttaagtccattctaattcagtgaatagtcaggggaaggtaatgtctgcttttccaaagaattgaaaggttcattacatttctcaatttgtcacaatttttattaaaatcctattacttgtttcttctttatcacttgatgaattgacgaaaatacaaattcagtaggcaaatatgatatccagtatttttgataatcttattagagtagtaagcaataaaataatgagtgacaggaacatcgccgagaccacaaagaaggtatgtgataactcaggccagtctgaaatactttcattctctatgttttatttcttgttatgccaaataaagacctgctattttacatttatccttaacttattaaatgtaatactacccagaaatttgattcctaggtatttaccagagcgtagagtgtattgaaaacttatgtatggactggagacaattttagcataagattgaagaaagtataaaaaataataggttattgaattagaacagtgattgaagaatttgaaaaatgttctattttctggtgttaataatatagttctaatggaaaaaaaatgcagtttttttttggcaagatggcggactggaggcatcgttagcatgccttttccacttcgaaagacaaaactgtgtgtaaaggttcatgctgtgaacttttttccaagaagcaacacc

SEQ ID NO: 463268 - DNA, 686 bp, Homo sapiens
gtgggcagacatcagctgagtttgacccagttctcctttctgctctaacaggacaacactgagttcaatgcctcagaattgctgggttctccctgccccagcacccaaagaggctctctgcaccaggccactgctgccaggggtgggagaggggtggcgtcagcaactcaggactgtttctttctacctcttcagtgcctttttcagcactttctacctttctacctttttcagcactaagaagttaaaaccaggagagcacctgcatctcatctggaccaaaaggaatggacacaactgtctggatgagctgtggcacaggcattctgccaagaagaggaagctggcagaagaggccttgcaagccaaatggactaagacaccccacccttgtgaaggcgacagaggactagaaataatgaacaaatctgcactgagcataacccatgatgcatagtactgcagaacagtgctgtacagtgctcttcagggcctcacaggaggtgcagatgggtgccgttgacaacacagagagaagagagaacctaaacaatgaaacaagtcccctgcccacgtgctgtcagacactggagaaaagaacaaaaccaaagaaaagccactgagcaaacacaatggccttgtcttctacctttcttgtggcacaatgcaggactggacagcactgt

SEQ ID NO: 463269 - DNA, 2179 bp, Homo sapiens
actgcatatgtcttggaatccttgacccagttccgaggactggagaggggatagaaccttgtgtccaaggaggtccttcaggagacctgggatgagtggtgcttccccaaaacagactcatggacattaaacatcatcagaatggcacaagagggcaaagaagaaaacagcctcataccacggtgcagaggctcctgacctgggggctgccagtctcctgtagctggttcctgtggcgccagccgggcgagtttcctgtcactgctctcctgctgggggcaggcgctggggggctcctggccataggtctctttcagctcctggtgaaccccatgaacatctacgaagaacagaagattatgttcttgtacagcttggtgggttagtgctgggcaaaagccaggaacactcaagcggcctgtggaacacagcgccgtcctgcatgcccaggaaggaaagggagattagaagaattagaggaaaagggacaaaagtcttaagtcactaatgctattataattccactgtggatgcctgcgtgtagcaggcactcacaccctggctgtcccagcttgggggccatgggctgggggacctcccctcacatccgctgtgccagcctcctactagtacccaagatgctgggcaaggaaggcaggctctttgtcctgggatacgccttggctgccatctatgtgggtgagtatgtgggggccaggccagtagccaatctgcgacacaatctcaacaacgtgatcgcatcgctgggctgcaccgtggagctgcagatcaacaacacccgcgcagcttggcgcatctccacagcccccttacgggccatgttcaaggacctgctgagtagcaaagaattgctgagagcagagactcggaacatctccgccacttttgaggacctggatgcccaggtgaatagtgagacgggctacacgcctgaggataccatggactcaggggagacagcccagggcagggaggcccgccaagccccagcctccagactccacctgtcgacacagaagatgtatgagctgaagaccaagctgcgttgctcctatgtggtgaaccaggccatactcagctgccgtcgttggtttgaccgcaagcatgaacagtgcatgaagcacatctgggtcccactcctcacccacctgctctgcctgcctatgaagttcaagttcttctgtggcattgccaaggtgatggaggtttggtgccgcaatcgcatcccagtggaaggcaactttgggcagacctacgactccctcaaccagtctattcgtggcctggatggggaattttcagccaatattgacttcaaggaagagaagcaggctggggtgctggggctcaacacaagctgggagcgcgtgagcaccgaggtgcgggactacgtgtaccgccaggaggcccggctggagtgggccctggggctgctgcacgtgctgctctcctgcactttcctgctggtcctgcatgcgtgagccatagtccccaccccagcagcccctcctctgccccggactggagccctgccctgagggaggctgtaaggatggaaccctagcacctatcctcacctctgaatctgaatattatttacctttgtctttgtttacacaaagttaaaggaaaagtggacattttgtcagaagaacattacccatgttcccactgccttaaaaggccaaccgtcttcattcatccacctccttccagcctttatcccaatactgattttttttttttacgtttagctttgacttttgattttttcttgcccttcatattccccttggctctgactttgtgccatttttatctttccattttgctttcattttctcctgcctgctgcgttggcagcgactttccctccatttagaacaaagtcctcaaccccacccagcccagtgtccagctgggctgccccgggccttgctctgctctagctcccctgctggtctctggaccctctatttcccatctccactcccaaacacctgagatgggcagggcttgggtgagggctgccacagggctgttgctctgtctgcccctatgtggggggcctagagtgactgcaagtgagtgggtatgtgtgtatctagggccccatgggaagacaaagatgaaggagctctattcctgcccccaataa

SEQ ID NO: 463270 - DNA, 1163 bp, Homo sapiens
caccagccagtcagcggagcctcctcacctccgttgccagcgaaggcgctcgttaggccttgggaagaggcgaccggaggcgatgcccgcgaatttgttaggggggggagagaccgtggtcacgaagggggttctcccagagtgaagcttcttcatcgcactctagagttgctgattcctgtgatttcctccatgtgggaaacggtgtttgtgctagaagaggctgcgctctttacctgacataagggggttcaagactgacatcgcctcacgcccacccgaaaacgtttacatggcttgtctctttttttttctgtcctaaagtcgcctcatcttcacatcccctcattttttcttccacactcgagagtgtctctctctctcattaaaagctccaccaaatatttgaaatatctcaaccagaaagactgcaataaatacattatttcattcgtggaagctacagaccagctaggttgagagttgcttgatattttctgctaaacgagtcacgcaatgcacgcgtttctaacgtgcagcaagacgattagtcgactcagcctctccgggactgttctaaactataaaaagggttaccactcaggaagccaccccatacccccatccctgcttaaacctgtacaacaccaaggaacataccatggtgaagactggcagacagacttaacccagatgccaccttacagggaactacaagatttgctagtatttataggcactttcaacaggtggatagaagctttccccacaaggacaggaaaagtactggaagtgtctaaattcttaaagaaatcattccaagatttggattaccaaaaggtttgcaaggtgacaactgacctcacttcacagctaagaagtcacaagattggcagcttccccaattactgctgtgaagaacatcactattgtagaacctaagattggcctcttgagatgtcttttcaggcttttgcatttctgactgctggaaggcaccatctggcccgaaaatcaaccagtcccttagcccccacccagaagctgactccatgcaggaggaccattttccacgcccctgtgatttcatccccaacaatcagcaccacgcaagccctagccccctccccaccaaactatctttgaaaaaccccttacctcca

SEQ ID NO: 463271 - DNA, 3795 bp, Homo sapiens
ttataaagattgcatgaactcgaatgaaggaatatattctcctggaattaaaagtagcagcctcaaggagtatcccccctgcaaaacagctgacctggggagcccctgcaaggaaccccacaagacatttgtttatgatctagattcccacgttgatgcggacgatgacccttccaccttagcattgctccaagcagttccaaaccagagctgcaggccacatggcagtaaattaacccacagtgtttccgacagtctgtttggctgggagacaaacagaaaacactttctggaaggcacatcctcagtttatcccaaggaaaggcctgaaaagctgacaagttgcgccagcagctgtcccttagagatgaagctgtgcccaagtgtgcagacgcctcaggtacagagggagaggggcccacagggccaaggccatggccgcatggctctcaacctccagctttcagacactgatgacaatgaaacgtttgatgagctgcacatagagagcagtgatgagaaaagtccttcagacgtgtcattggctgccgacaccgataagtccgtggagaacctggatgtccttgtggggtttggaaaatctctatgtgggtctcctgaagaggaggaaaaacaagtgcccatcccttcagagactaggccaaagacttttagtttcattaagcagcaaagagttgtaaaaaggacttcttcagaagaatgtgtgactgtgatatttgatgcggaagacggtgagcccattgaattcagctctcaccagactggggttgtcactgttaccagaaatgagatttccatcaattcaactcctgctggacccaaggcagaacatactgagcttttacctcagggaattgcttgtttacagccaagagctgctgcaagagactatactttctttaaaaggtctgaagaggacactgagaaaaacattccaaaagataatgtagataatgttcccagggtgtccactgaatctttcagctccaggacagtgacacaaaatcctcagcagcaaaagctggtcaaaccaacacacaatatatcatgccagagtaattccaggtcttcggcacccatgggcatctatcaaaagcaaaatctgacaaaaatacctcccaggggcaagtcttcacctcagaaatcaaaactaatggagcccgaagccaccacactactcccttcatctggcctggtgactcttgaaaaatcaccagccttagctcctgggaaactctcacgattcatgaagactgagagctcagggcccctctttgaattacgatcagatccacacattccaaaacattccgcccaacttccgcacagctccaggatgcccagcaggagggactgggtccagtgccccaagagtcagactccagggtcacggtcaaggcctgccattgagtctagtgacagtggagagccccccacgagggatgaacactgtggctctgggccggaggcaggggtgaaatccccttcccctccgccccctccaggcaggtccgtctccctgctggccaggcccagctatgactattcaccagcaccttcatccaccaagtccgaaaccagggtccccagtgaaacagcaaggaccccattcaaatccccgctgctgaaaggaatttctgctccagttatttcttctaatccggccacgacagaagtgcagaggaagaaaccttctgtggccttcaaaaagcctatcttcactcaccctatgccctccccagaagcagtcattcaaacccgatgccctgctcatgccccctccagctccttcaccgtaatggctctggggcctccaaaggtctctccgaagagaggtgtccccaaaacctctcctcgccaaacacttgggaccccacaaagggacataggattacagactcccaggatctctccttcaacccatgagccactggaaatgacgtcctccaaaagtgtatctccagggagaaaaggacaattgaatgatagcgcctccacaccccccaagccttccttcttaggggtaaatgagtcaccatcatctcaggtcagcagttcctcatcatcctcatcacccgccaaaagccataacagccctcatggttgtcaaagtgctcatgagaaaggactgaaaactcgccttccagtgggactcaaagtgctcatgaagtctccccagctgctcaggaaaagttccaccgtgccagggaaacatgaaaaagacagtttaaatgaagcctccaaaagttccgtggctgtgaacaagtctaagccagaggactccaagaatccagcaagcatggagatcacagcgggtgaaagaaatgtgaccctaccggattcacaagcacagggcagtttagctgatgggcttcccctggaaacagcactacaagagccattggaaagtagcatccctgggagtgatggaagggatggggtagataatagatccatgagaagatccctttcctccagcaaaccacacctaaaaccagctctgggtatgaatggcgccaaagcccgcagccacagcttcagtacacactcaggagacaagccttctacgccccccatcgaagggtcaggcaaagtccgcactcagatcattaccaataccgccgagagaggcaattctcttacccggcagaactcttccacggaaagctctcccaacaaggccccttctgctcccatgttggagagtctccccagtgttgggaggccctcggggcacccctcctccgggaagggctccctggggagctcaggcagcttcagcagtcagcatgggagcccaagtaagttgcctttgaggatccctccaaagtctgagggactcctcatcccacctggaaaggaagaccagcaggccttcacccagggagagtgccccagtgccaatgtggctgtacttggggaaccaggcagtgaccgccgcagttgcccacccaccccaacagactgccctgaagccctgcagagcccagggaggactcagcatccaagcacttttgaaacaagcagtacatccaagctagaaacttctggaaggcatccagatgcctctgcaaccgcgactgatgctgtgagttcagaagcccccctctcacccacaatcgaagaaaaggtcatgttgtgcattcaggaaaatgtggaaaagggccaagtgcaaacaaagcccacctctgtggaagcaaagcagaagcctgggccttcttttgccagctggtttggttttcggaagagtagacttccagctctgagtagcaggaaaatggacatctccaaaaccaaagtagaaaagaaagatgcaaaagtcttggggtttggaaacagacaactaaaatcagaaagaaaaaaagagaaaaagaagcctgaactacagtgtgagacagaaaatgagcttatcaaggacaccaagtcagcagataatccagatggcggtttacaaagcaaaaataatcggagaacaccacaagacatttacaaccaactgaagattgaaccaaggaatagacacagccctgttgcatggctcctgtctcatcggcagctctatcagtactcaaggaaaccacaagaaaaacatgaaaatcaaagccgatatggaagtaccaaaagactccctgatgtcccctgcattataaaaccacaaattgtaagcatatctaaggctgcccttgtggtgtcactgaaaggaggaagagagaatgaatgtgtgaaaatgtgcaatatgctggaaattcaatccagctgatggaaaactttgat

SEQ ID NO: 463272 - DNA, 1522 bp, Homo sapiens
ccaactggctgatgactgagcaggcacaggacctgtctgctaaccccacttccctgcagcccccagtgaatttggatccatttgcctgtttcccggggcagggccctaggctggttcctctgcacaaagggaagtcgctgaggagggccctgaaggagcgcaggctcctggaggacttcctgaggaatcaccattatgcagtcagcaggaagcactccagctctggggtggtggccagcgagtctctgaccaactacctggattgtcagtactttgggaagatctacatcgggacccttccccagaagttcaccttggtgtttgatacaggctccccggatatctgggtgccctctgtctactgcaacagtgatgcctgtcgtgaaaaaccaccaacgcttcgatccgtccaagtcctccacccacagaacatgggcaagtccctgtccatccagtatggcacaggcagcatgcggggcttgctgggctatgacactgtcaccgacctagtggaggtcatgattctcttgcaggtctccaacattgtggacccccaccagactgtgggtctgagcacccaggaacctggcgacgtcttcacctactccgagtttgatgggatcctggggctggcctatccctctcttgcctctgagtacgcgctgcgccttggtttcaggaatgaccaggggagcatgctcacgctgagggccattgatctgtcgtactacacaggctccctgcactggatacccatgactgcaagaatactggcagttcactgtggacagtttgacatcgactgcgggcgcctgagcagcattcccacggctgtcttcgagatccacggcaagaagtaccccctgccaccctccgcctataccagccaggaccagggcttctgcaccagtggtttccagggtgactatagttcccagcagtggatcctggggaatgtcttcatctgggagtattacagtgtctttgacaggaccaataaccgtgtggggctggcgaaggctgtctgattgcatcactggccacggacctcaatgtgaccaaacacacacgcgcacatagatgagatgtgcaggcagatggttcccaataaacaccgcatttctgcaaagcctgacttcccttgttgtcactggggctgaagctctgcgccgttgtgggggtggatgtgactgccaggtggtgtgtgggcacagcaggaactacatggtgggaagggttggtgggtggaggctacctggagggcaatgactatttcaagctcaggtcagggaagaccaaggcgtgccttacctacctgtccttcactctagagctttctgggcaaagggcacaagaggggagaccctcgcacgataagacccatttgttcctggggaatgagagatgggggagggacagagtggaggcttctttccctgtcctttggggaatcccaattctactccctcattctgggagtttggaggactgagcagcctcctttcctaggagggcagtcctt

SEQ ID NO: 463273 - DNA, 788 bp, Homo sapiens
ggcaacatcctcaacatccagcaggccattggagccactgcgggccagtacaatgagtttgacatcgactgcgggcgcctgagcagcattcccacggctgtcttcgagatccacggcaagaagtaccccctgccaccctccgcctataccagccaggaccagggcttctgcaccagtggtttccagggtgactatagttcccagcagtggatcctggggaatgtcttcatctgggagtattacagtgtctttgacaggaccaataaccgtgtggggctggcgaaggctgtctgattgcatcactggccacggacctcaatgtgaccaaacacacacgcgcacatagatgagatgtgcaggcagatggttcccaataaacaccgcatttctgcaaagcctgacttcccttgttgtcactggggctgaagctctgcgccgttgtgggggtggatgtgactgccaggtggtgtgtgggcacagcaggaactacatggtgggaagggttggtgggtggaggctacctggagggcaatgactatttcaagctcaggtcagggaagaccaaggcgtgccttacctacctgtccttcactctagagctttctgggcaaagggcacaagaggggagaccctcgcacgataagacccatttgttcctggggaatgagagatgggggagggacagagtggaggcttctttccctgtcctttggggaatcccaattctactccctcattctgggagtttggaggactgagcagcctcctttcctaggagggcagtcctt

SEQ ID NO: 463274 - DNA, 3110 bp, Homo sapiens
ctgggaatacaggtgtgagccaccgtaactggctgacacacaaaaaaattggaaatgccgttgggagatttctgagactcttcaatcaaacccaggccttcagggagcacccaggttgcaagtgaacagagtgaaattgttctctgaagtttcctaatctgcctgaagtctggacccactgaagaagaaaacaatggctcctggtcctttccctgagttttcattaactgaactcatatggcaggaagaccgaagtctgtcaacacacctgggcaagcttttgtcacaaactattgtctgctctgcaggctcaacagactctgttccaggccattgtgtgttcttcaagaccactgaattcccctaaagatcacttagcacccctctgaaatcattcatacttctccatctccctctcccctagaaagaagtgtacagaaccatctgtaccccatcgtgtggtggggtgaccactctgtgattcacccccttgcatgctaatacatttcagtgccacaactccttttgcaagttgacttttcagtaaaccttcagagggtaagagaagtttttccttgacccctacaccagaaatccagaatttagcataaaatcctctactttttttttttttttaactaaaaacacttcgaggccgggcatggtggctcatgcctgtaatcccaacaccttggccctcgtcgccgtcccagccctcgaggaatctgcgccccaggcgaagctgtcctcggaggttcgggagcgtcggagtgacttcccgatcctttcccctgggacccgagggatccctccccccaagtgccgggtcctccccgcggctccccaggggctcctccggccgccctcgctgactcagcgtaatccgagccgcggagggcggcggggttggcggagcccgcccggggttaatcgccgagctttgaacgccccctcccgccccgcccgcctccagcagccgccccgcccctgcggagaagtcccgggctggcgccggcggccacagcggagcagctggagcgatcgaggctgcagcgcggccgccgggcgcagcatgactgccgtcggcgtgcaggtagccggcgcctggcggggcgctgacccggggtgctgccccgccgtgggaggttgggggtgggaggacggagggaggggcgtacccaccgcgagcgccggcgtcgggctgggggtgcgagcgccccccgtgcccgccccctgttgcaaacctgggtccggaggaggctgggcggggagcaacctcggggggcctgcctgcctcacatagctgctcccgaggcgcggactccggctgcttctgctcgcggccttgcaagcacccgaggctcccaaacttcatttggaaagatttttcttctctttggtgtcaccagtgacttactggcccagaggcctttgggccaaaggcagccccgccggtccttctttgaatccttcatccggaccctcatcatcacgtgtgtggccctggctgtggtcctgtcctcggtctccatttgtgatgggcactggctcctggctgaggaccgcctcttcgggctctggcacttctgcaccaccaccaaccagacgatctgcttcagagacctgggccaggcccatgtgcccgggctggccgtgggcatgggcctggtacgcagcgtgggcgccttggccgtggtggccgccatttttggcctggagttcctcatggtgtcccagttgtgcgaggacaaacactcacagtgcaagtgggtcatgggttccatcctcctcctggtgtctttcgtcctctcctccggcgggctcctgggttttgtgatcctcctcaggaaccaagtcacactcatcggcttcaccctaatgttttggtgcgaattcactgcctccttcctcctcttcctgaacgccatcagcggccttcacatcaacagcatcacccatccctgggaatgaccgtggaaattttaggccccctccagggacatcagattccacaagaaaatatggtcaaaatgggacttttccagcatgtggcctctggtggggctgggttggacaagggccttgaaacggctgcctgtttgccgataacttgtgggtggtcagccagaaatggcccgggggcctctgcacctggtctgcagggccagaggccaggagggtgcctcagtgccaccaactgcacaggcttagccagatgttgattttagaggaagaaaaaaacattttaaaactccttcttgaattttcttccctggactggaatacagttggaagcacaggggtaactggtacctgagctagctgcacagccaaggatagttcatgcctgtttcattgacacgtgctgggataggggctgcagaatccctggggctcccagggttgttaagaatggatcattcttccagctaagggtccaatcagtgcctaggactttcttccaccagctcaaagggccttcgtatgtatgtccctggcttcagctttggtcatgccaaagaggcagagttcaggattccctcagaatgccctgcacacagtaggtttccaaaccatttgactcggtttgcctccctgcccgttgtttaaaccttacaaaccctggataaccccatcttctagcagctggctgtgcctctgggagctctgcctatcagaaccctaccttaaggtgggtttccttccgagaagagttcttgagcaagctctcccaggagggcccacctgactgctaatacacagccctccccaaggcccgtgtgtgcatgtgtctgtcttttgtgagggttagacagcctcagggcaccatttttaatcccagaacacatttcaaagagcacgtatctagacctgctggactctgcagggggtgagggggaacagcgagagcttgggtaatgattaacacccatgctggggatgcatggaggtgaagggggccaggaaccagtggagatttccatccttgccagcacgtctgtacttctgttcattaaagtgctccctttctagtcctttttctgcccagaagtaggtgatgttattgccctcagcccatttcattctacactgactccttcccattccct

SEQ ID NO: 463275 - DNA, 1112 bp, Homo sapiens
aatcatggcagacgccgcgagcgaaatagaaagtgggtgctgagaccgtatatgggagcagggccactggattgtggccaggaagggctctctcaaagagctcttggtgatcaattggagggacactcacgaaatcatctcaagcacagacaggagacagtggactacatgataaagcagcgggaagattttgaaccctttgtagaagatgacattccttttgagaagcatgtggccagtttggcaaagcctggtacttttgctggcaatgatgcaattgtagcctttgcaagaaatcatcagttgaatgtagtgattcatcaacttaatgcccctttgtggcagattcgtggtacagagaaaagcagcgtgagggagttacacatcgcatatcggtatggagagcactacgacagtgttcggaggatcaatgacaactcagaggcacctgcacatctccagacggatgtgagtgaggcctcggatttctcccgtattccccgccctacaggaaacagattgagagctgtatatctggcgctaaaaaccagtaatgtttttgtagaaagttggcattgagaatctgtgggcctgattttaaaaatattttttatttcttagtttaggttctcagttttaatgaaatgtctttctttggaagatgcagaagagaatcttgagcccagtggtcgagtgctgaagcagtgtggccctttgtgggaggagggtggcagtggtgccagaatctttggaaatcagggcttaaatgaaggcaggaccgaaaacaataaggcacaggccagccctagtgaagaaaacaaagcaaataaaaaccagctcgcaaagtgtggaaaatctggggaatgcataaagctacatcaagaagcagaatgacctcacttatcctgtttggtgtatgccgtgacagttggaaggaaatacaccctgaaattgtcctcagtgtacaaatgaaaagcctccttttcccacctaacattactgtacatgtgggctcttcccatgtttatccatgttttttataaatgccatgatctgcaatgaacacctttgtgtataaatctttggtttttgcattattttcttgaataaag

SEQ ID NO: 463276 - DNA, 1085 bp, Homo sapiens
ctctctgttttccagttgaagaaatagaagaacatagaggctgaatgttctattcagaggcatccagccaaacagctgcagagccaagagcagcatcccagggccagaggggcaaggccagtgaggtgaaaaggcagggctgtacacaggaggagagacggaacagctggccgagagcagcccgtggggagggggtggacaggctggctgctgcccagatccaggggcctcttcagagacatggtgcacagatgattgcttgtgggaccctcctggatagcacctctagtcttggcttggggagcttcagagggggtgtcgagtgcctggacctaagtcatactcaacttccctccaacacgcagctcccaccctccagctctcgttctactcagctcttcctccaggtgcattctgtgcctggcagcaccagagcagggggcagcaagagagaccatggtgggagcccctggcccgtccaccgcctggagtgcaaactggacacccagaagctagctgggcctgagctggacatttagtgccagaagattctcaaaggggtccctgattcagaaaaataagaaccactccacagagggactgctgagattctgagcgtcgcaagccttctggagttctaaatggtgctcctggcagtcccctctgtgggtctctatgctgcagaggcaaagccatgtgtcctcatcccgccctgcacctggcagtgtgactgagaggggaagccaggatggggttcctgttggatcccacatgtgtttcctccctggcttgtggaagaaaatgtgttctccaaagtgctgtgctcttcctgagtaattggaggcagatgctctgttagaatcgtttcctttggctcgctgtccagaggctctgggtgtctccgaggatggatgctagctggctcaacatctccagcatcccgttactggggcatctggctggcccaccactgttcctccagaaggttgtatggacatgagtaagtattcctctctctgcgcctgttctaccttctttcaaagacaacattagaattcctgaatttataaagtgaggaaatgaag

SEQ ID NO: 463277 - DNA, 3199 bp, Homo sapiens
cagctcacagacaggctcacaggaatatgtgatgcaagaagggggttgagcgagttgactgggctgaccagagctgggtacagttttaactgtgaagattttctggaggaggcggatctgcagcagattatcccctgaggaggaaggggctgggaggtgaaggggctggggagagaatcccttgggagcagtctctctgtctcttactctgtgagctgtgtcgttccctcctgtccttcccttccctctgtcctcttctgattgccctgcagggtgtctgccctggtgccctgctctttgagctcggcaggttcaaggatgcccctactctgaccccacaacagtcacattcccctggcatcccttttggcccttccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttgtcaactccccgttatctgctcccctgagcccatcctctacaggcacctgcccccgccttccaggtccaaccctgagacctgcctgcccagcctccatgccccccaccaaggacaaccttgtccccagctaccctgcaggctcccccagcgtggcggctgcctgtagccaggcagagtgcatgggcgggagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaaggtactggagctacctctgttccctgaaggaaagggagtttgagtccctgggtcacagcctaacatgccgagcagcaagtcaaaagcccattaacgagaaagtgcctgcccactgcaacggagccgccagcacctcctcccctccagatccgggccccaggctgctgccgctttttataactttatattatttttttttaagaaaaaaagctctttaaaatacctcaagactgtctccctgttctgttgctgctatgaaaatataaaaacagaaacatagaaaaggaaggaaaaaaaataacaaaatgagtgtccttactgtccccagccctaccctgggaggctgagatgataggcagccagactccagctcccatagcttgcctgcaaaagtctcttatgctcattattattattattgtcatcttgtcattttcaatagtgtgaaaaatgtttgtgtcactggggtagtctttccagacaggatgatgaggcgtgtggctctgaatgagtaaggcttcctgagtcttgacaccagagacgactatggtcccattgggaagagaaactcgagagggggagctgcacttctggctctttctaggatccttgccccgagggtctgggaattggcttgtgacccttttctggtccttcagcaaccctaggcatccatccctccctgaattattgcctgcttttcttcagctgttcctgcagcctcattttctcagccacttagggagcttgagctgggttggtcattgctgttgggatattcctgttttctattggacagccttccttccctgcctgtgggtttgcctttaaggaaggggtagaacctttcccagggaggcctccttgggttgaaccaccccttttttggaggcaggaagggaaaaggcatcatcacttgcagaactggtggtgtgggaggccacaggagtgtgggaggccttggtccttcaggatcacctggctcctcagggctgagcagctgctgaggaggcggcagggctgggagtgccctagtttttccatttatctcgctggggaccactcccgtgcagatgcgagaggagacttgcatttccctcctttggtccaccaggttcaaggcactatattttggcgatgtcctttcctattctccttgctcttaggcatggaggaagcttgttccctgaacaagacaaaatgaggtgacaggagacagtgcacagccagggaaatccagtactactagaaatcggctccaaacacttgtttcacagtcttggttcagcgtaccaagtgtgtgatttggggtttcactgaaatcgtttgccacaaaagtaatttccacaggctgcttgggatttaggcccttgtagacagacacacagatacaaatgaaggtgggctgggaactgttcggtccccttctgcctccgggctctcgcgggagcgggcctctccggggcactcgcgtttcccccccagcccccagagggcgctgtgggccactccgccgcactgccggcggcgtccccggggaggagcctctcctgcagccgccaccgcctccgcgatcgcaaacccggaagacgtgttcgggcagctggagtgtacgggcccgcgggccacggccatgcagcccctggaggctcgtggaataggatcagtcccctcctcctccaagtgctttattggcattcacat

SEQ ID NO: 463278 - DNA, 567 bp, Homo sapiens
cagctcacagacaggctcacaggaatatgtgatgcaagaagggggttgagcgagttgactgggctgaccagagctgggtacagttttaactgtgaagattttctggaggaggcggatctgcagcagattatcccctgaggaggaaggggctgggaggtgaaggggctggggagagaatcccttgggagcagtctctctgtctcttactctgtgagctgtgtcgttccctcctgtccttcccttccctctgtcctcttctgattgccctgcagggtgtctgccctggtgccctgctctttgagctcggcaggttcaaggatgcccctactctgaccccacaacagtcacattcccctggcatcccttttggcccttccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccacccccttttccagagcaagcgatcctctagagta

SEQ ID NO: 463279 - DNA, 1955 bp, Homo sapiens
gaatttgccttcgaggccaagaattcggcacgaggagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaagtcaaaagcccattaacgagaaagtgcctgcccactgcaacggagccgccagcacctcctcccctccagatccgggccccaggctgctgccgctttttataactttatattatttttttttaagaaaaaaagctctttaaaatacctcaagactgtctccctgttctgttgctgctatgaaaatataaaaacagaaacatagaaaaggaaggaaaaaaaataacaaaatgagtgtccttactgtccccagccctaccctgggaggctgagatgataggcagccagactccagctcccatagcttgcctgcaaaagtctcttatgctcattattattattattgtcatcttgtcattttcaatagtgtgaaaaatgtttgtgtcactggggtagtctttccagacaggatgatgaggcgtgtggctctgaatgagtaaggcttcctgagtcttgacaccagagacgactatggtcccattgggaagagaaactcgagagggggagctgcacttctggctctttctaggatccttgccccgagggtctgggaattggcttgtgacccttttctggtccttcagcaaccctaggcatccatccctccctgaattattgcctgcttttcttcagctgttcctgcagcctcattttctcagccacttagggagcttgagctgggttggtcattgctgttgggatattcctgttttctattggacagccttccttccctgcctgtgggtttgcctttaaggaaggggtagaacctttcccagggaggcctccttgggttgaaccaccccttttttggaggcaggaagggaaaaggcatcatcacttgcagaactggtggtgtgggaggccacaggagtgtgggaggccttggtccttcaggatcacctggctcctcagggctgagcagctgctgaggaggcggcagggctgggagtgccctagtttttccatttatctcgctggggaccactcccgtgcagatgcgagaggagacttgcatttccctcctttggtccaccaggttcaaggcactatattttggcgatgtcctttcctattctccttgctcttaggcatggaggaagcttgttccctgaacaagacaaaatgaggtgacaggagacagtgcacagccagggaaatccagtactactagaaatcggctccaaacacttgtttcacagtcttggttcagcgtaccaagtgtgtgatttggggtttcactgaaatcgtttgccacaaaagtaatttccacaggctgcttgggatttaggcccttgtagacagacacacagatacaaatgaaggtgggctgggaactgttcggtccccttctgcctccgggctctcgcgggagcgggcctctccggggcactcgcgtttcccccccagcccccagagggcgctgtgggccactccgccgcactgccggcggcgtccccggggaggagcctctcctgcagccgccaccgcctccgcgatcgcaaacccggaagacgtgttcgggcagctggagtgtacgggcccgcgggccacggccatgcagcccctggaggctcgtggaataggatcagtcccctcctcctccaagtgctttattggcattcacat

SEQ ID NO: 463280 - DNA, 2574 bp, Homo sapiens
gcgtccgcggcggtgatggcggtgcgtgaacgcgcggcggcagcaatggccgctctggagcggcgggtgccgagtctcgatgacttcgcgggacagagctggagctcgtgggtggagcgggccgacctgcccgcggctgacggggctgagctggaggagagtagcaaaaacacgaagaagttggatgccatgaccctcattaaagaagacatgtccatcttcgggcactgccctgcccatgatgacttctacttggttgtgtgtaaccactgcagccaagtggtgaagcctcaagctttccagaagcactgcgaaagaagacatgggcccctcagcaagctttatggccgggccccaccccacctccagcccctgccagctctcagaaatgccatgtagtgaatgggcagggcccagcttgtagggccccaggttccacgaaaacctcctccagggagaagggccaggggtcccggagccgtggccaccagcctcctgagaagacccagaaggacaacctctgccttttcgtgcctgtggtgaatctggagaagatgtccagtctcccgaagcctgatggacatggaatcagggtggccccaccctctgcttttctcagccagccagggggcctcaccaaggactcccctggaaaaactcccatggctcccccttctaaagaacctcctggcagagagaacatcgagatcatccccagtgaggggtccagtcactgggctgaaggcagccctcctgaaaaggagcccagtgggaccaggctgccccctaaaacccaccggaagatggctcggaaggagtgcgacctcaacaggcagtgtggggtaataaatccagagaccaaaaagatctgtacccgcctgttgacctgcaaggtaacccccttcccagcccggccctggcctttgaggagaagtgctctacactgaagtcaaaagcccattaacgagaaagtgcctgcccactgcaacggagccgccagcacctcctcccctccagatccgggccccaggctgctgccgctttttataactttatattatttttttttaagaaaaaaagctctttaaaatacctcaagactgtctccctgttctgttgctgctatgaaaatataaaaacagaaacatagaaaaggaaggaaaaaaaataacaaaatgagtgtccttactgtccccagccctaccctgggaggctgagatgataggcagccagactccagctcccatagcttgcctgcaaaagtctcttatgctcattattattattattgtcatcttgtcattttcaatagtgtgaaaaatgtttgtgtcactggggtagtctttccagacaggatgatgaggcgtgtggctctgaatgagtaaggcttcctgagtcttgacaccagagacgactatggtcccattgggaagagaaactcgagagggggagctgcacttctggctctttctaggatccttgccccgagggtctgggaattggcttgtgacccttttctggtccttcagcaaccctaggcatccatccctccctgaattattgcctgcttttcttcagctgttcctgcagcctcattttctcagccacttagggagcttgagctgggttggtcattgctgttgggatattcctgttttctattggacagccttccttccctgcctgtgggtttgcctttaaggaaggggtagaacctttcccagggaggcctccttgggttgaaccaccccttttttggaggcaggaagggaaaaggcatcatcacttgcagaactggtggtgtgggaggccacaggagtgtgggaggccttggtccttcaggatcacctggctcctcagggctgagcagctgctgaggaggcggcagggctgggagtgccctagtttttccatttatctcgctggggaccactcccgtgcagatgcgagaggagacttgcatttccctcctttggtccaccaggttcaaggcactatattttggcgatgtcctttcctattctccttgctcttaggcatggaggaagcttgttccctgaacaagacaaaatgaggtgacaggagacagtgcacagccagggaaatccagtactactagaaatcggctccaaacacttgtttcacagtcttggttcagcgtaccaagtgtgtgatttggggtttcactgaaatcgtttgccacaaaagtaatttccacaggctgcttgggatttaggcccttgtagacagacacacagatacaaatgaaggtgggctgggaactgttcggtccccttctgcctccgggctctcgcgggagcgggcctctccggggcactcgcgtttcccccccagcccccagagggcgctgtgggccactccgccgcactgccggcggcgtccccggggaggagcctctcctgcagccgccaccgcctccgcgatcgcaaacccggaagacgtgttcgggcagctggagtgtacgggcccgcgggccacggccatgcagcccctggaggctcgtggaataggatcagtcccctcctcctccaagtgctttattggcattcacat

SEQ ID NO: 463281 - DNA, 2478 bp, Homo sapiens
gcgtccgcggcggtgatggcggtgcgtgaacgcgcggcggcagcaatggccgctctggagcggcgggtgccgagtctcgatgacttcgcgggacagagctggagctcgtgggtggagcgggccgacctgcccgcggctgacggggctgagctggaggagagtagcaaaaacacgaagaagttggatgccatgaccctcattaaagaagacatgtccatcttcgggcactgccctgcccatgatgacttctacttggttgtgtgtaaccactgcagccaagtggtgaagcctcaagctttccagaagcactgcgaaagaagacatgggcccctcagcaagctttatggccgggccccaccccacctccagcccctgccagctctcagaaatgccatgtagtgaatgggcagggcccagcttgtagggccccaggttccacgaaaacctcctccagggagaagggccaggggtcccggagccgtggccaccagcctcctgagaagacccagaaggacaacctctgccagccagggggcctcaccaaggactcccctggaaaaactcccatggctcccccttctaaagaacctcctggcagagagaacatcgagatcatccccagtgaggggtccagtcactgggctgaaggcagccctcctgaaaaggagcccagtgggaccaggctgccccctaaaacccaccggaagatggctcggaaggagtgcgacctcaacaggcagtgtggggtaataaatccagagaccaaaaagatctgtacccgcctgttgacctgcaaggtaacccccttcccagcccggccctggcctttgaggagaagtgctctacactgaagtcaaaagcccattaacgagaaagtgcctgcccactgcaacggagccgccagcacctcctcccctccagatccgggccccaggctgctgccgctttttataactttatattatttttttttaagaaaaaaagctctttaaaatacctcaagactgtctccctgttctgttgctgctatgaaaatataaaaacagaaacatagaaaaggaaggaaaaaaaataacaaaatgagtgtccttactgtccccagccctaccctgggaggctgagatgataggcagccagactccagctcccatagcttgcctgcaaaagtctcttatgctcattattattattattgtcatcttgtcattttcaatagtgtgaaaaatgtttgtgtcactggggtagtctttccagacaggatgatgaggcgtgtggctctgaatgagtaaggcttcctgagtcttgacaccagagacgactatggtcccattgggaagagaaactcgagagggggagctgcacttctggctctttctaggatccttgccccgagggtctgggaattggcttgtgacccttttctggtccttcagcaaccctaggcatccatccctccctgaattattgcctgcttttcttcagctgttcctgcagcctcattttctcagccacttagggagcttgagctgggttggtcattgctgttgggatattcctgttttctattggacagccttccttccctgcctgtgggtttgcctttaaggaaggggtagaacctttcccagggaggcctccttgggttgaaccaccccttttttggaggcaggaagggaaaaggcatcatcacttgcagaactggtggtgtgggaggccacaggagtgtgggaggccttggtccttcaggatcacctggctcctcagggctgagcagctgctgaggaggcggcagggctgggagtgccctagtttttccatttatctcgctggggaccactcccgtgcagatgcgagaggagacttgcatttccctcctttggtccaccaggttcaaggcactatattttggcgatgtcctttcctattctccttgctcttaggcatggaggaagcttgttccctgaacaagacaaaatgaggtgacaggagacagtgcacagccagggaaatccagtactactagaaatcggctccaaacacttgtttcacagtcttggttcagcgtaccaagtgtgtgatttggggtttcactgaaatcgtttgccacaaaagtaatttccacaggctgcttgggatttaggcccttgtagacagacacacagatacaaatgaaggtgggctgggaactgttcggtccccttctgcctccgggctctcgcgggagcgggcctctccggggcactcgcgtttcccccccagcccccagagggcgctgtgggccactccgccgcactgccggcggcgtccccggggaggagcctctcctgcagccgccaccgcctccgcgatcgcaaacccggaagacgtgttcgggcagctggagtgtacgggcccgcgggccacggccatgcagcccctggaggctcgtggaataggatcagtcccctcctcctccaagtgctttattggcattcacat

SEQ ID NO: 463282 - DNA, 769 bp, Homo sapiens
gggcatttgagaatggacccactgaaaggttccccaagtggtcctagcaccaggagcttgtcacggagtgtgggcttcatactgttgagctgcaggccctgcttggggcttctggaaaggggacaacctctgggttgtcttctgggaagaacagtctctggtaaggagaggctggagactctctaaaactggccctgacccttctgagctgtgtttctcctctaggggctgagctggaggagagtagcaaaaacacgaagaagttggatgccatgaccctcattaaagaaggtgggagtcgacacacattagggctgggacccagggcagacaggaccacgctccacttttccaccacactacagaaggaggtggctgcttgaagcagctgtctggggaccctcattttgataggtccgagtcggccggttgttctggctcctgtgacctgtcgttggagatcataatcataggtgattgcccactcacctgaaagcgtataccctttgggactgcttagatcgaactctggaagctggaagcattcagcatggagcttgttatatcagcggggaggtgaagtgccttctgagtgtggggtgggagtgctctccgatcttccagagaaaccctgggatcttcagccccagtgacatgggcttctgtcattgcagacatgtccatcttcgggcactgccctgcccatgatgacttctacttggttgtgtgtaaccactgcagccaagtggtgaagcctcaagctttccag

SEQ ID NO: 463283 - DNA, 776 bp, Homo sapiens
cacccctccacccctgcttttgctataatcaaagggctacttctttctgaattggctgtgaccctcattccaggtactggagctacctctgttccctgaaggaaagggagtttgagtccctgggtcacagcctaacatgccgagcagcaaggtgggtgggctggtctcactggtttttcctctgggcatcagggccttgaagggcaggcacacaaccccatgtccacttatgcacatgtgcccacctccaggtgtgcaggtgacaggcaagttctccagggtttccagtaaagcctgcagccagttttatttgcctcttctggtgggagccctggtgtagtgtgctatgtgctctccatatgatctctgccaggagggacttactggaggtgggacgggggtgctctcctgggttagatgtgggcctaatcataaaccctgtgtgttctccagcttcactacccaggctgcccctggtgagctggcattcatcttcccccttgctcagttttactcaccaggccagcagaaggaaatcaagctttagcctctgtagtgcacacagttcactgggtaggacagctggtaggcccccaccctgaccctttctctcgcctcttgtcttcctgcagtcaaaagcccattaacgagaaagtgcctgcccactgcaacggagccgccagcacctcctcccctccagatccgggccccaggctgctgccgctttttataactttatattatttttttttaagaaaaaaagctctttaaaatac

SEQ ID NO: 463284 - DNA, 3121 bp, Homo sapiens
cagctcacagacaggctcacaggaatatgtgatgcaagaagggggttgagcgagttgactgggctgaccagagctgggtacagttttaactgtgaagattttctggaggaggcggatctgcagcagattatcccctgaggaggaaggggctgggaggtgaaggggctggggagagaatcccttgggagcagtctctctgtctcttactctgtgagctgtgtcgttccctcctgtccttcccttccctctgtcctcttctgattgccctgcagggtgtctgccctggtgccctgctctttgagctcggcaggttcaaggatgcccctactctgaccccacaacagtcacattcccctggcatcccttttggcccttccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttgtcaactccccgttatctgctcccctgagcccatcctctacaggcacctgcccccgccttccaggtccaaccctgagacctgcctgcccagcctccatgccccccaccaaggacaaccttgtccccagctaccctgcaggctcccccagcgtggcggctgcctgtagccaggcagagtgcatgggcgggagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaagtcaaaagcccattaacgagaaagtgcctgcccactgcaacggagccgccagcacctcctcccctccagatccgggccccaggctgctgccgctttttataactttatattatttttttttaagaaaaaaagctctttaaaatacctcaagactgtctccctgttctgttgctgctatgaaaatataaaaacagaaacatagaaaaggaaggaaaaaaaataacaaaatgagtgtccttactgtccccagccctaccctgggaggctgagatgataggcagccagactccagctcccatagcttgcctgcaaaagtctcttatgctcattattattattattgtcatcttgtcattttcaatagtgtgaaaaatgtttgtgtcactggggtagtctttccagacaggatgatgaggcgtgtggctctgaatgagtaaggcttcctgagtcttgacaccagagacgactatggtcccattgggaagagaaactcgagagggggagctgcacttctggctctttctaggatccttgccccgagggtctgggaattggcttgtgacccttttctggtccttcagcaaccctaggcatccatccctccctgaattattgcctgcttttcttcagctgttcctgcagcctcattttctcagccacttagggagcttgagctgggttggtcattgctgttgggatattcctgttttctattggacagccttccttccctgcctgtgggtttgcctttaaggaaggggtagaacctttcccagggaggcctccttgggttgaaccaccccttttttggaggcaggaagggaaaaggcatcatcacttgcagaactggtggtgtgggaggccacaggagtgtgggaggccttggtccttcaggatcacctggctcctcagggctgagcagctgctgaggaggcggcagggctgggagtgccctagtttttccatttatctcgctggggaccactcccgtgcagatgcgagaggagacttgcatttccctcctttggtccaccaggttcaaggcactatattttggcgatgtcctttcctattctccttgctcttaggcatggaggaagcttgttccctgaacaagacaaaatgaggtgacaggagacagtgcacagccagggaaatccagtactactagaaatcggctccaaacacttgtttcacagtcttggttcagcgtaccaagtgtgtgatttggggtttcactgaaatcgtttgccacaaaagtaatttccacaggctgcttgggatttaggcccttgtagacagacacacagatacaaatgaaggtgggctgggaactgttcggtccccttctgcctccgggctctcgcgggagcgggcctctccggggcactcgcgtttcccccccagcccccagagggcgctgtgggccactccgccgcactgccggcggcgtccccggggaggagcctctcctgcagccgccaccgcctccgcgatcgcaaacccggaagacgtgttcgggcagctggagtgtacgggcccgcgggccacggccatgcagcccctggaggctcgtggaataggatcagtcccctcctcctccaagtgctttattggcattcacat

SEQ ID NO: 463285 - DNA, 2050 bp, Homo sapiens
cagctcacagacaggctcacaggaatatgtgatgcaagaagggggttgagcgagttgactgggctgaccagagctgggtacagttttaactgtgaagattttctggaggaggcggatctgcagcagattatcccctgaggaggaaggggctgggaggtgaaggggctggggagagaatcccttgggagcagtctctctgtctcttactctgtgagctgtgtcgttccctcctgtccttcccttccctctgtcctcttctgattgccctgcagggtgtctgccctggtgccctgctctttgagctcggcaggttcaaggatgcccctactctgaccccacaacagtcacattcccctggcatcccttttggcccttccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttgtcaactccccgttatctgctcccctgagcccatcctctacaggcacctgcccccgccttccaggtccaaccctgagacctgcctgcccagcctccatgccccccaccaaggacaaccttgtccccagctaccctgcaggctcccccagcgtggcggctgcctgtagccaggcagagtgcatgggcgggagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaagtcaaaagcccattaacgagaaagtgcctgcccactgcaacggagccgccagcacctcctcccctccagatccgggccccaggctgctgccgctttttataactttatattatttttttttaagaaaaaaagctctttaaaatacaaaaaaaaaaaaaaaaaaaaaaaaaaaaaaaaaaaaacaaaaaaacaaacaagacaaaaaaaaacaaagaagaacaacaaaaaaacagagggggggggcgcgcgcactacaaaacccaccgccggcggggcgcacacataatgacggcgcgccccccccacgttcctctgaaaaaccagggagggccccccataagggacaccctaattaacaacacacgcgacgcggggcggcccgcggctctaaccaaaccgaccagggaagccggggagcaaaaccgcgcgccaccgggcgggcacttctgggaagcaacgaaccccacaaccatcgcgggagcaaaacaaaaaggaggggcacaacacaccccccccaagagataaaacaaccacaagagggagaaaataaacaga

SEQ ID NO: 463286 - DNA, 2615 bp, Homo sapiens
cagctcacagacaggctcacaggaatatgtgatgcaagaagggggttgagcgagttgactgggctgaccagagctgggtacagttttaactgtgaagattttctggaggaggcggatctgcagcagattatcccctgaggaggaaggggctgggaggtgaaggggctggggagagaatcccttgggagcagtctctctgtctcttactctgtgagctgtgtcgttccctcctgtccttcccttccctctgtcctcttctgattgccctgcagggtgtctgccctggtgccctgctctttgagctcggcaggttcaaggatgcccctactctgaccccacaacagtcacattcccctggcatcccttttggcccttccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttgtcaactccccgttatctgctcccctgagcccatcctctacaggcacctgcccccgccttccaggtccaaccctgagacctgcctgcccagcctccatgccccccaccaaggacaaccttgtccccagctaccctgcaggctcccccagcgtggcggctgcctgtagccaggcagagtgcatgggcgggagccaggctatcacctcaccactgcctgccaacacgccatccccgtccttcagcaagctgccgccttccaaggccagcaagtcatccaaaggcaaggacggggtggaggtggaggccccttctcgaaagcggaagttatccccaggctgctgccgctttttataactttatattatttttttttaagaaaaaaagctctttaaaatacctcaagactgtctccctgttctgttgctgctatgaaaatataaaaacagaaacatagaaaaggaaggaaaaaaaataacaaaatgagtgtccttactgtccccagccctaccctgggaggctgagatgataggcagccagactccagctcccatagcttgcctgcaaaagtctcttatgctcattattattattattgtcatcttgtcattttcaatagtgtgaaaaatgtttgtgtcactggggtagtctttccagacaggatgatgaggcgtgtggctctgaatgagtaaggcttcctgagtcttgacaccagagacgactatggtcccattgggaagagaaactcgagagggggagctgcacttctggctctttctaggatccttgccccgagggtctgggaattggcttgtgacccttttctggtccttcagcaaccctaggcatccatccctccctgaattattgcctgcttttcttcagctgttcctgcagcctcattttctcagccacttagggagcttgagctgggttggtcattgctgttgggatattcctgttttctattggacagccttccttccctgcctgtgggtttgcctttaaggaaggggtagaacctttcccagggaggcctccttgggttgaaccaccccttttttggaggcaggaagggaaaaggcatcatcacttgcagaactggtggtgtgggaggccacaggagtgtgggaggccttggtccttcaggatcacctggctcctcagggctgagcagctgctgaggaggcggcagggctgggagtgccctagtttttccatttatctcgctggggaccactcccgtgcagatgcgagaggagacttgcatttccctcctttggtccaccaggttcaaggcactatattttggcgatgtcctttcctattctccttgctcttaggcatggaggaagcttgttccctgaacaagacaaaatgaggtgacaggagacagtgcacagccagggaaatccagtactactagaaatcggctccaaacacttgtttcacagtcttggttcagcgtaccaagtgtgtgatttggggtttcactgaaatcgtttgccacaaaagtaatttccacaggctgcttgggatttaggcccttgtagacagacacacagatacaaatgaaggtgggctgggaactgttcggtccccttctgcctccgggctctcgcgggagcgggcctctccggggcactcgcgtttcccccccagcccccagagggcgctgtgggccactccgccgcactgccggcggcgtccccggggaggagcctctcctgcagccgccaccgcctccgcgatcgcaaacccggaagacgtgttcgggcagctggagtgtacgggcccgcgggccacggccatgcagcccctggaggctcgtggaataggatcagtcccctcctcctccaagtgctttattggcattcacat

SEQ ID NO: 463287 - DNA, 871 bp, Homo sapiens
tatctgtatgtttgtatccgtatggatgtgggtcctgtttcccactggctgtttctctggagaactctggttcctgccctctgttttgttgtttgtggctctaagtcacggtgtgctccaggtgccagagtcgctgctggccaaggatcccggaagagacacagctcgggatgaatccctggaaccaaaagtctgtccagcccacacctacgtccaggggcagtgtccgcaaagttccagttctgctcggacttcctccgtagcagcatcacacaagtgttcagctcgagatgtgcaccgattcctttccaaccttcgtctccataaaggacgtactgcccagccacctacatcccagtgaatccatctcttctctagtcggtatctgctgggatgcgtctagaacaatctccctgaagacgtcatttcggtatggcctggactcgaagcaggcctgtgagtggggtgcatgctctgctctctgtggctgtgtcaacttcaaacttctttatgtttggacacagaaaaactacatcattagtgaaataaaacaagggacagacagatgcgtctttttctcaggaggtcgtgtttgattgactaaaacagcaaggaaacttttattgggtctggcctcctgtgcattctacacaatgtgggccgtttttgtcacagcccggggtgttcaccatctttatttctacaagagctccctttgtgttctgccctccacttgcctgggtgctcacaggggaggctgagggtgcagcatgggtccttcctgccctgtctctgcattcacactataaaaggcactcacagagccaccaccacagccccaaactgcaatcatgaaataacacctgcactg

SEQ ID NO: 463288 - DNA, 714 bp, Homo sapiens
ttcatgtctttgttgtatttttattgcaaatttactacatgcttatagttaaaaagtaaaataaatgagtatatagcaacaaggaaagaggctggtgattccagccatgccccttgcacttcgctttggggatctggtgatatttcgaatgctcagcactctagtaaggggaggggacatcaaggcagcatcatgctcattgcaacttccttcttcctttttttctcatcggtggtggcagcccccacccacagcagtttctggcagtttcagaggagggtcaaacacatcacggggcgaagtgccttcttctcatattacggatatggctgctactgtgggcttggggataaagggatccccgtggatgacactgacaggacagctgcccccaccctgcaaaaaagcctgggctagcctgctggaggatgagagcccacctggatcagttgtctcagctgatttcagacacgtgagagagagctcagcgagactcagcttgtagctgactacagatgtgtgagggaacctggctgagaccaaaacaactgtccagctgagcccaggctaaactgccaacatgcagaattgtgagctaaataaaggctgctgttctaagtcactgggttttgaaatgatgggcccttgatggtatgcaagccccatttgtttggcattgatgccctgattcttggagagctgagatgggagtgt

SEQ ID NO: 463289 - DNA, 561 bp, Homo sapiens
agctctagctggcaacaaagccaccactttccttgcccctctgcgtcctcagtttttatgatgtcattcttagcttttcttatcaagaggcagaatctgttttccccatcccatgaatctgaactggtcttgtggcttagtttggtcaatagaatgttgtgggagggatggtttaccagttttgagctaggcctcaggaggtctagggcatgtctactctctcttaggacagctgcccccaccctgcaaaaaagcctgggctagcctgctggaggatgagagcccacctggatcagttgtctcagctgatttcagacacgtgagagagagctcagcgagactcagcttgtagctgactacagatgtgtgagggaacctggctgagaccaaaacaactgtccagctgagcccaggctaaactgccaacatgcagaattgtgagctaaataaaggctgctgttctaagtcactgggttttgaaatgatgggcccttgatggtatgcaagccccatttgtttggcattgatgccctgattcttggagagctgagatgggagtgt

SEQ ID NO: 463290 - DNA, 1212 bp, Homo sapiens
atagtagcttcctggattttccttggactcaagaaacacatctccacttcttacaggaaagactttcagcttttccccattcactatgatgttagctgtggcattaaggaagtgtatgctgctgtgggtcgaagagaggaaaatgcagactgtagggtctctgacagaattcctggggagaactgatatgacctccaggagggtaaaaacagtagaaggggaaaagaggccacatacatttcagaaaatgatgtcagatgctgtaggaagtttaaaacatgaagactggaaaacagaaaacttcagctatatgtccccaaatcacagagtctccgtgggagagagactaaaattagacttccttgatctcctattacattctttcataagatcacttgccgatcaaaaaaatacctttattatgcaaacagttgtctaccacaaagactccatctttccaccatcccaagttacctcacatgctcctggtcagacagatcatcctacattcaaatgaatgtagataaaaatgtctctgatatattcttttcttgaattcttgtatttggacaaacaattgtttgaccatgggaagatacactcccaacatgtaggtggcctcaccagaaggtaaaaactgaagaaaaaaatcattcaaactcccatatactagatctttctcatttaatcttgaggtttccatgttgagaggagtgaaaggagatttctgtacccattagccaagattgtctgaaacaaatcccaggaagatgttttgaaagaagaatacataagccttatgactcagttctcagtagcttcttcagtatctttcttttaaaatatcattttaaagtcttgcattatagcactaaaaaagctaaaagaatgctaaaattgcactaaatccaaccacgccagcaagcctgctcaattcatttcttcagacatcactccgaaattgccagagtggtttcccactgacagacttcatcgctgtactgcacatctcttcactacaaatggggagatgagacagagacaaaaagagaaatggatttactgtgctggggaagttaagcacacactgggttggaatttcatttccactgaattagaagctctggctcagcacggatgacacagtgatgctcctttaataacacaaaataaataaaacatggaaaaggttttccagtttgttttggggga

SEQ ID NO: 463291 - DNA, 1522 bp, Homo sapiens
tgcagcagctgcgacacgcagtggcaggcagccagtgtcctggcatgactaccactatgagcccccatgcctgctatggccaagtccacccccagctgagccccagcaccatcagtggggccctcaaccagcccgatgggggtggctacagcagctttggcctagtgcagccccggcctcccctcgagcccagccccactggccgccaccgtggggtacgtgctgtgagcagagctggcctacgccggcacaggccatgccatggctgccatgccgtccagtcaggaaacagcagaggctgtgccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagccttttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccaga

SEQ ID NO: 463292 - DNA, 1084 bp, Homo sapiens
agataggggcaatatgaggaccaagggaattaatgtagctgcagtcagagcacagtatgctctggggcagggacccccaaccactgggctgtggagtggtaccagtccgtggcctgttgggaactgggctgcacagcaagagactgcaaactctattgtgaactgctcatgtgagggatctaggatgtgcgctccttatgagaatctaatgcctgatgatctgaggtggaacagtgtcatcccgaaaccatccccacacctcatctgtggaaaaattgtcttccacaaaaccaaacatagaattaagctctggttttatgattatgtgtacactaaaaatactcataaagtattttttaatgctttaaagaatttccttcagcactttaacctcaggaaaggtcgggatgagaaggatgccttgtctgttatgctgtattcatgccagagaacaggaactcaagccagccactaaattcaggactgaagcaaaggattaatgcatttttcagactattagcccctagaaagttaatcctactttgaagacctctaatttcccagtcctcagccatagctgattggaccaggaataggtgtctgaatgaataaaccactgactctcagaaatttgaactgaaagagacagagctacttgagctgaagagtcatatggaggctccatggaagtagtggttttcagcaaagcataagataatcaaacatcagatacccttggaggagagaatgacaaatggatagatgtacagagtgaaatgaagtcataagaaagagagatgcagagatggcattatgtgaagacattaaccttggttaccaaattaaatatccaggccctggacagccaactacatttgcctcatcttttttttttttttcattgacaaataaaaaatatgttaggccgggtgcggtggctcacacctgtaatcccagcactttgggaagccaaggagggtggatcgcctgagatgacctctccatctttaagctcactgattctttcttctgcttgattgaatctcctgttaaagttctctatggaaatgtttagttcagtcat

SEQ ID NO: 463293 - DNA, 578 bp, Homo sapiens
cacacagatatttttgttgtagtttcctttaaaggaataagcagctaataaagatgggttctatttatagtagtgaataaatatatttaaacatttaaaatttggtttctaaatttctatgtcttattctaatcactgatttgtaatgttatttattgtttcttttttcctacttaggtgaaatctattcttgaaagaagtaaagaggagctgtcccgaacagtgaagtgtcgtaatgcggccctgaaagagagtcagaagttgaaagaagacctcgaggctgtggaggacagggaaaacaagaaggtgggaaactttcagcgacaattggcagaagctaaagaagacaactgcaaagtcacaatcatgttggagaatgtgctggcttctcacagtaagatgcaaggtgctctggagaaagtacaaatagagcttgggcggagggattcagagattgcaggcctcaagaaagaaaggtacctgtggttttttttccctgtcattggtattgctggattgtactaaggagcagtgtcaagtcaataaatgaagtcactttatgtagcttcctttacaaa

SEQ ID NO: 463294 - DNA, 2652 bp, Homo sapiens
caacttttctggggatcagcttttctttttctcaacaataacttaagaaaccacctaaaaataaaatatactttaattattcccactagcatcctactgtgtctgcttgtctgctttccatgctctttcctgggagtaatgagatccacaagcagaagagtaaccagaaaggatcaaatgtctttgtgttgtttcattttctgttaggtgggaaactttcagcgacaattggcagaagctaaagaagacaactgcaaagtcacaatcatgttggagaatgtgctggcttctcacagtaagatgcaaggtgctctggagaaagtacaaatagagcttgggcggagggattcagagattgcaggcctcaagaaagaaagggatctcaatcaacagagggtgcagaagctggaagctgaagtggaccagtggcaggccaggatgcttgtcatggaggaccagcacaacagtgagattgaatctctacaaaaagctctaggtgtagctagagaagacaacaggaaacttgctatgagtctggaacaagctctccagacaaataatcatctgcaaacaaagctagatcacattcaagagcaattggaaagcaaagaacttgagcgacagaatttggaaaccttcaagtaagagcattatagttgcagtaaaattagggaagcacctctggaggaacatgaggttgcaagtgacagagaagagcttatagcatgataatcacagagtaattgtgtgtgccagcctctacttctttctttatatgatcttatttaatttaattgttatttgtattctatgaagtaagctatacacacactgttcagatgatgaacctgaggcttaaggtagttaattgctccagatcactcagctagtaagtactgaagctgatatttggacagatgcctgactccaaagtcatgctcttaaaatgcaaatgatgaatatacatttgcattctttattccaaaaaagattttgttctttagtgataaaaatcatgaaaaccacttggtctattgctccataaatctgcttaatcagatattattattgcctcactaactctcctttttaaaagaagatccaaagatgataaaatataaggacaaaactaagtaagcttctcttaatggaaagtaaaaatgtttcaattttctcccttgtgttttaagctgaagaaagcccttgatgaagctaacttcagatcagtggaagtgtcccggaccaaccgagagctgcgacagaaacttgcagagctagaaaaaatactagaaagtaacaaggagaaaataaagaatcaaaagacccaaattaagctccacttgtcagctaaggcgaataatgctcagaatatagaaaggatgaaggttgtatgggaaacctcttctcacttcctggataccctgtgaggatgtagtcagtcaatggtgtctagggaagacaggttttagaaccctaccagccccatgtattctctgggaattatagccagttgtctttggggagactttttcagtggagtcactgctgtgtaaatgtttgatttctcatttgctgccagtgtcacattccggctccctatctgtcccttccgtgttgattgtactggactttgctcttttgggatcagtgggctagatgggaaagaaagctcagcaggaactggtaactttgggtctcatattggattctttctgtcatcctataggcaaaaagagcaagccagtttttccactgatcatctttttatgttattttccaattacttttagcaaatagaaaaagaattgaagcaaatggagctaattaaggatcaatatcagaaaaagaactatgaacagtctttgagtatccagagatttgtgtgtgaaatgactaacctgcagaaagagatgcagatgttggctaagagccaatatgatgcctcagtgcggaataaacagcaagagctgcacctagaagcagagcggaaaataaggcaggagctagagaatcggtgccaggaattggaagaaactgtcagacacctgaagaaatgtaaagaggcaacagagaatacgctgaaagaagccagtgtggaatcagaacagataacagctaatctggaagaagctcatcgctggtttaagcacaggtttgatggtctacaacttgaggtgacaaaaaaccggttgcagaggccttctggggaagacaggtggcaggaaaaggtgtgttttctttccaacaggaccaagatgtaaaacatgatgtcatgtccaaccaatctgttctgcatcgatgggagagaaaacagaatcttaggcccatgcccaagaagtatcattctgaggtacagaggaagtgatgtccttgacaagggagcttctttatgtgtagctacactccatgattccaagagcccagcagccggggctggcctgtttctagagtcataagaacatgaagtctttgatgtgggctgaagattttggacctgagtttatcactttatgaactcttatatcagtacaaaactacccctttttttgtcccttttcacattttccacccaataaatttgtgttaatttgttgtatgataggagatggtgttgcataattcttgtctgtttttctaataagtatattttat

SEQ ID NO: 463295 - DNA, 2641 bp, Homo sapiens
  misc_feature (2331)..(2331): n is a, c, g, or t
  misc_feature (2341)..(2341): n is a, c, g, or t
cacacagatatttttgttgtagtttcctttaaaggaataagcagctaataaagatgggttctatttatagtagtgaataaatatatttaaacatttaaaatttggtttctaaatttctatgtcttattctaatcactgatttgtaatgttatttattgtttcttttttcctacttaggtgaaatctattcttgaaagaagtaaagaggagctgtcccgaacagtgaagtgtcgtaatgcggccctgaaagagagtcagaagttgaaagaagacctcgaggctgtggaggacagggaaaacaagaaggtgggaaactttcagcgacaattggcagaagctaaagaagacaactgcaaagtcacaatcatgttggagaatgtgctggcttctcacagtaagatgcaaggtgctctggagaaagtacaaatagagcttgggcggagggattcagagattgcaggcctcaagaaagaaagggatctcaatcaacagagggtgcagaagctggaagctgaagtggaccagtggcaggccaggatgcttgtcatggaggaccagcacaacagtgagattgaatctctacaaaaagctctaggtgtagctagagaagacaacaggaaacttgctatgagtctggaacaagctctccagacaaataatcatctgcaaacaaagctagatcacattcaagagcaattggaaagcaaagaacttgagcgacagaatttggaaaccttcaagtaagagcattatagttgcagtaaaattagggaagcacctctggaggaacatgaggttgcaagtgacagagaagagcttatagcatgataatcacagagtaattgtgtgtgccagcctctacttctttctttatatgatcttatttaatttaattgttatttgtattctatgaagtaagctatacacacactgttcagatgatgaacctgaggcttaaggtagttaattgctccagatcactcagctagtaagtactgaagctgatatttggacagatgcctgactccaaagtcatgctcttaaaatgcaaatgatgaatatacatttgcattctttattccaaaaaagattttgttctttagtgataaaaatcatgaaaaccacttggtctattgctccataaatctgcttaatcagatattattattgcctcactaactctcctttttaaaagaagatccaaagatgataaaatataaggacaaaactaagtaagcttctcttaatggaaagtaaaaatgtttcaattttctcccttgtgttttaagctgaagaaagcccttgatgaagctaacttcagatcagtggaagtgtcccggaccaaccgagagctgcgacagaaacttgcagagctagaaaaaatactagaaagtaacaaggagaaaataaagaatcaaaagacccaaattaagctccacttgtcagctaaggcgaataatgctcagaatatagaaaggatgaaggttgtatgggaaacctcttctcacttcctggataccctgtgaggatgtagtcagtcaatggtgtctagggaagacaggttttagaaccctaccagccccatgtattctctgggaattatagccagttgtctttggggagactttttcagtggagtcactgctgtgtaaatgtttgatttctcatttgctgccagtgtcacattccggctccctatctgtcccttccgtgttgattgtactggactttgctcttttgggatcagtgggctagatgggaaagaaagctcagcaggaactggtaactttgggtctcatattggattctttctgtcatcctataggcaaaaagagcaagccagtttttccactgatcatctttttatgttattttccaattacttttagcaaatagaaaaagaattgaagcaaatggagctaattaaggatcaatatcagaaaaagaactatgaacagtctttgagtatccagagatttgtgtgtgaaatgactaacctgcagaaagagatgcagatgttggctaagagccaatatgatgcctcagtgcggaataaacagcaagagctgcacctagaagcagagcggaaaataaggcaggagctagagaatcggtgccaggaattggaagaaactgtcagacacctgaagaaatgtaaagaggcaacagagaatacgctgaaagaagccagtgtggaatcagaacagataacagctaatctggaagaagctcatcgctggtttaagcacaggtttgatggtctacaacttgaggtgacaaaaaaccggttgcagaggccttctggggaagacaggtggcaggaaaaggacnaagatgtaanacatggatgttgatgtccttgacaagggagcttctttatgtgtagctacactccatgattccaagagcccagcagccggggctggcctgtttctagagtcataagaacatgaagtctttgatgtgggctgaagattttggacctgagtttatcactttatgaactcttatatcagtacaaaactacccctttttttgtcccttttcacattttccacccaataaatttgtgttaatttgttgtatgataggagatggtgttgcataattcttgtctgtttttctaataagtatattttat

SEQ ID NO: 463296 - DNA, 1575 bp, Homo sapiens
agcggccgctcgcgatctagaacctctcctttttaaaagaagatccaaagatgataaaatataaggacaaaactaagtaagcttctcttaatggaaagtaaaaatgtttcaattttctcccttgtgttttaagctgaagaaagcccttgatgaagctaacttcagatcagtggaagtgtcccggaccaaccgagagctgcgacagaaacttgcagagctagaaaaaatactagaaagtaacaaggagaaaataaagaatcaaaagacccaaattaagctccacttgtcagctaaggcgaataatgctcagaatatagaaaggatgaaggttgtatgggaaacctcttctcacttcctggataccctgtgaggatgtagtcagtcaatggtgtctagggaagacaggttttagaaccctaccagccccatgtattctctgggaattatagccagttgtctttggggagactttttcagtggagtcactgctgtgtaaatgtttgatttctcatttgctgccagtgtcacattccggctccctatctgtcccttccgtgttgattgtactggactttgctcttttgggatcagtgggctagatgggaaagaaagctcagcaggaactggtaactttgggtctcatattggattctttctgtcatcctataggcaaaaagagcaagccagtttttccactgatcatctttttatgttattttccaattacttttagcaaatagaaaaagaattgaagcaaatggagctaattaaggatcaatatcagaaaaagaactatgaacagtctttgagtatccagagatttgtgtgtgaaatgactaacctgcagaaagagatgcagatgttggctaagagccaatatgatgcctcagtgcggaataaacagcaagagctgcacctagaagcagagcggaaaataaggcaggagctagagaatcggtgccaggaattggaagaaactgtcagacacctgaagaaatgtaaagaggcaacagagaatacgctgaaagaagccagtgtggaatcagaacagataacagctaatctggaagaagctcatcgctggtttaagcacaggtttgatggtctacaacttgaggtgacaaaaaaccggttgcagaggccttctggggaagacaggtggcaggaaaaggaccaagatgtaaaacatgatgtcatgtccaaccaatctgttctgcatcgatgggagagaaaacagaatcttaggcccatgcccaagaagtatcattctgaggtacagaggaagtgatgtccttgacaagggagcttctttatgtgtagctacactccatgattccaagagcccagcagccggggctggcctgtttctagagtcataagaacatgaagtctttgatgtgggctgaagattttggacctgagtttatcactttatgaactcttatatcagtacaaaactacccctttttttgtcccttttcacattttccacccaataaatttgtgttaatttgttgtatgataggagatggtgttgcataattcttgtctgtttttctaataagtatattttat

SEQ ID NO: 463297 - DNA, 206 bp, Homo sapiens
  misc_feature (34)..(34): n is a, c, g, or t
  misc_feature (44)..(44): n is a, c, g, or t
ccttctggggaagacaggtggcaggaaaaggacnaagatgtaanacatggatgtcttaagcaattttctacttgttgcttctcagatttctaattaccgaagttctctcatcatctcgatactctctcttttaatctttagtttctttagactaatgctaggaaaccaattaatttcttttttttacaaagttccacctgtcacaa

SEQ ID NO: 463298 - DNA, 2542 bp, Homo sapiens
  misc_feature (2232)..(2232): n is a, c, g, or t
  misc_feature (2242)..(2242): n is a, c, g, or t
caacttttctggggatcagcttttctttttctcaacaataacttaagaaaccacctaaaaataaaatatactttaattattcccactagcatcctactgtgtctgcttgtctgctttccatgctctttcctgggagtaatgagatccacaagcagaagagtaaccagaaaggatcaaatgtctttgtgttgtttcattttctgttaggtgggaaactttcagcgacaattggcagaagctaaagaagacaactgcaaagtcacaatcatgttggagaatgtgctggcttctcacagtaagatgcaaggtgctctggagaaagtacaaatagagcttgggcggagggattcagagattgcaggcctcaagaaagaaagggatctcaatcaacagagggtgcagaagctggaagctgaagtggaccagtggcaggccaggatgcttgtcatggaggaccagcacaacagtgagattgaatctctacaaaaagctctaggtgtagctagagaagacaacaggaaacttgctatgagtctggaacaagctctccagacaaataatcatctgcaaacaaagctagatcacattcaagagcaattggaaagcaaagaacttgagcgacagaatttggaaaccttcaagtaagagcattatagttgcagtaaaattagggaagcacctctggaggaacatgaggttgcaagtgacagagaagagcttatagcatgataatcacagagtaattgtgtgtgccagcctctacttctttctttatatgatcttatttaatttaattgttatttgtattctatgaagtaagctatacacacactgttcagatgatgaacctgaggcttaaggtagttaattgctccagatcactcagctagtaagtactgaagctgatatttggacagatgcctgactccaaagtcatgctcttaaaatgcaaatgatgaatatacatttgcattctttattccaaaaaagattttgttctttagtgataaaaatcatgaaaaccacttggtctattgctccataaatctgcttaatcagatattattattgcctcactaactctcctttttaaaagaagatccaaagatgataaaatataaggacaaaactaagtaagcttctcttaatggaaagtaaaaatgtttcaattttctcccttgtgttttaagctgaagaaagcccttgatgaagctaacttcagatcagtggaagtgtcccggaccaaccgagagctgcgacagaaacttgcagagctagaaaaaatactagaaagtaacaaggagaaaataaagaatcaaaagacccaaattaagctccacttgtcagctaaggcgaataatgctcagaatatagaaaggatgaaggttgtatgggaaacctcttctcacttcctggataccctgtgaggatgtagtcagtcaatggtgtctagggaagacaggttttagaaccctaccagccccatgtattctctgggaattatagccagttgtctttggggagactttttcagtggagtcactgctgtgtaaatgtttgatttctcatttgctgccagtgtcacattccggctccctatctgtcccttccgtgttgattgtactggactttgctcttttgggatcagtgggctagatgggaaagaaagctcagcaggaactggtaactttgggtctcatattggattctttctgtcatcctataggcaaaaagagcaagccagtttttccactgatcatctttttatgttattttccaattacttttagcaaatagaaaaagaattgaagcaaatggagctaattaaggatcaatatcagaaaaagaactatgaacagtctttgagtatccagagatttgtgtgtgaaatgactaacctgcagaaagagatgcagatgttggctaagagccaatatgatgcctcagtgcggaataaacagcaagagctgcacctagaagcagagcggaaaataaggcaggagctagagaatcggtgccaggaattggaagaaactgtcagacacctgaagaaatgtaaagaggcaacagagaatacgctgaaagaagccagtgtggaatcagaacagataacagctaatctggaagaagctcatcgctggtttaagcacaggtttgatggtctacaacttgaggtgacaaaaaaccggttgcagaggccttctggggaagacaggtggcaggaaaaggacnaagatgtaanacatggatgttgatgtccttgacaagggagcttctttatgtgtagctacactccatgattccaagagcccagcagccggggctggcctgtttctagagtcataagaacatgaagtctttgatgtgggctgaagattttggacctgagtttatcactttatgaactcttatatcagtacaaaactacccctttttttgtcccttttcacattttccacccaataaatttgtgttaatttgttgtatgataggagatggtgttgcataattcttgtctgtttttctaataagtatattttat

SEQ ID NO: 463299 - DNA, 2632 bp, Homo sapiens
caacttttctggggatcagcttttctttttctcaacaataacttaagaaaccacctaaaaataaaatatactttaattattcccactagcatcctactgtgtctgcttgtctgctttccatgctctttcctgggagtaatgagatccacaagcagaagagtaaccagaaaggatcaaatgtctttgtgttgtttcattttctgttaggtgggaaactttcagcgacaattggcagaagctaaagaagacaactgcaaagtcacaatcatgttggagaatgtgctggcttctcacagtaagatgcaaggtgctctggagaaagtacaaatagagcttgggcggagggattcagagattgcaggcctcaagaaagaaagggatctcaatcaacagagggtgcagaagctggaagctgaagtggaccagtggcaggccaggatgcttgtcatggaggaccagcacaacagtgagattgaatctctacaaaaagctctaggtgtagctagagaagacaacaggaaacttgctatgagtctggaacaagctctccagacaaataatcatctgcaaacaaagctagatcacattcaagagcaattggaaagcaaagaacttgagcgacagaatttggaaaccttcaagtaagagcattatagttgcagtaaaattagggaagcacctctggaggaacatgaggttgcaagtgacagagaagagcttatagcatgataatcacagagtaattgtgtgtgccagcctctacttctttctttatatgatcttatttaatttaattgttatttgtattctatgaagtaagctatacacacactgttcagatgatgaacctgaggcttaaggtagttaattgctccagatcactcagctagtaagtactgaagctgatatttggacagatgcctgactccaaagtcatgctcttaaaatgcaaatgatgaatatacatttgcattctttattccaaaaaagattttgttctttagtgataaaaatcatgaaaaccacttggtctattgctccataaatctgcttaatcagatattattattgcctcactaactctcctttttaaaagaagatccaaagatgataaaatataaggacaaaactaagtaagcttctcttaatggaaagtaaaaatgtttcaattttctcccttgtgttttaagctgaagaaagcccttgatgaagctaacttcagatcagtggaagtgtcccggaccaaccgagagctgcgacagaaacttgcagagctagaaaaaatactagaaagtaacaaggagaaaataaagaatcaaaagacccaaattaagctccacttgtcagctaaggcgaataatgctcagaatatagaaaggatgaaggttgtatgggaaacctcttctcacttcctggataccctgtgaggatgtagtcagtcaatggtgtctagggaagacaggttttagaaccctaccagccccatgtattctctgggaattatagccagttgtctttggggagactttttcagtggagtcactgctgtgtaaatgtttgatttctcatttgctgccagtgtcacattccggctccctatctgtcccttccgtgttgattgtactggactttgctcttttgggatcagtgggctagatgggaaagaaagctcagcaggaactggtaactttgggtctcatattggattctttctgtcatcctataggcaaaaagagcaagccagtttttccactgatcatctttttatgttattttccaattacttttagcaaatagaaaaagaattgaagcaaatggagctaattaaggatcaatatcagaaaaagaactatgaacagtctttgagtatccagagatttgtgtgtgaaatgactaacctgcagaaagagatgcagatgttggctaagagccaatatgatgcctcagtgcggaataaacagcaagagctgcacctagaagcagagcggaaaataaggcaggagctagagaatcggtgccaggaattggaagaaactgtcagacacctgaagaaatgtaaagaggcaacagagaatacgctgaaagaagccagtgtggaatcagaacagataacagctaatctggaagaagctcatcgctggtttaagcacaggtttgatggtctacaacttgaggtgacaaaaaaccggttgcagaggccttctggggaagacaggtggcaggaaaaggaccaagatgtaaaacatgatgtcatgtccaaccaatctgttctgcatcgatgggagagaaaacagaatcttaggcccatgcccaagaagtatcattctgaggtacagaggaagtgatgtccttgacaagggagcttctttatgtgtagctacactccatgattccaagagcccagcagccggggctggcctgtttctagagtcataagaacatgaagtctttgatgtgggctgaagattttggacctgagtttatcactttatgaactcttatatcagtacaaaactacccctttttttgtcccttttcacattttccacccaataaatttgtgttaatttgttgtatgataggagatggtgttgcataattcttgtctgtttttctaataagtatattttat

SEQ ID NO: 463300 - DNA, 259 bp, Homo sapiens
tagaacaaataaaaattcttcccttcactcagggttcttgtaaaagaaacgcagaaggagaattgaaacagacagaagaggagaagacacagaagagaagacaaggtgaagacggaggcagagatgggagtgatgtggccacacgccaagaaatcccaagaatgccatgaaccgtcagatgctggaagagctcctggcgcccagcatgctactttctgtctctatgaatttgaacacactaagtacttcatataaatga

SEQ ID NO: 463301 - DNA, 504 bp, Homo sapiens
tgctgagagggcaggggcttgaatgctgctgtggggctcacacagagcctacttctgccagagaggagtgaccagccagttccagcaggcctttccctccagttcccatgcttgcttgcttgcccacattgtttcaggagcagtggccagcgacaggctgagtgaaaagagccacttcagctcctgcccacaaagggtgtcaagggaaaaatcttgtttgaaaagtaaggcggaaaacaacagtctcttcctggtgtgtcctaaatccaatgacaagggttcttgtaaaagaaacgcagaaggagaattgaaacagacagaagaggagaagacacagaagagaagacaaggtgaagacggaggcagagatgggagtgatgtggccacacgccaagaaatcccaagaatgccatgaaccgtcagatgctggaagagctcctggcgcccagcatgctactttctgtctctatgaatttgaacacactaagtacttcatataaatga

SEQ ID NO: 463302 - DNA, 1525 bp, Homo sapiens
tgttgatcagaaccttcctagggtctccttatgctctaaatagtttggtgtgccagaatatggccctagctagaagtttcctaaagcctgaattgcagaggttttgtgttagtcatcttaaggaggctacctgtggtccccaagtcatgcccaatggagagatctggcaactgtccatttcctgcctcttcatctcccttgcagacaccactcagtcaaccttgtattcatttggctatttggtccagcagcctgaggctggaagataaatggaagccatgggtttctacctaggaagaacttgattaaaggggatcctcactctcccccactcccgcacttaatgtctgcacctgcggggagtcacggttagttctcgactttggccagttgaggccttctgactctcaaagaggcttcactctctctcagctctttgctattttcgccttcgggtcctgtggctcctacagcggggagacaggagcaatggttcgctgcaacaacgaagccaaggacgtgagctccatcatcgttgcatttggctatcccttcaggttgcaccggatccaatatgagatgcccctctgcgatgaagagtccagctccaagaccatgcacctcatgggggacttctctgcacccgccgagttcttcgtgacccttggcatcttttccttcttctataccatggctgccctagttatctacctgcgcttccacaacctctacacagagaacaaacgcttcccgctggtggacttctgtgtgactgtctccttcaccttcttctggctggtagctgcagctgcctggggcaagggcctgaccgatgtcaagggggccacacgaccatccagcttgacagcagccatgtcagtgtgccatggagaggaagcagtgtgcagtgccggggccacgccctctatgggcctggccaacatctccgtgctctttggctttatcaacttcttcctgtgggccgggaactgttggtttgtgttcaaggagaccccgtggcatggacagggccagggccaggaccaggaccaggaccaggaccagggccagggtcccagccaggagagtgcagctgagcagggagcagtggagaagcagcatcagctgttggaaacctgggcagccctctcagtggcttcctatcctccttcttgctggagccatgaatggcaggagctcagtgcttcttgtgcagtgcctggacccaggtatcttacttggggtcttacttgtacccttacagtctctgagaaccagcctctgctgcagtctctatcccctctcaagtccagggcaggccgatgctattggtgcttcttcactttgagacccagttccatatttgtctttagtgtatatcctcttcctgatacctccttcagtccctctctgggccccaaggctgagaatcagtgttaactgggagagccttgatttaggctacggcctcactctctatggccaccctaagaggaaaggctacttcacctcattacctccagag

SEQ ID NO: 463303 - DNA, 1440 bp, Homo sapiens
ggcggccgcagcctctgagagcacgaacagcagcgcccccgcgtcccagccagccagccagccagactggactccggcccaccgacggccgctcgcgctccggccccgctcgcctgctctgccccggacctgcagctccccgctcccccgccgtgtccgccgcctcccggccagagagccaagcccccacgccgcgcccagcgctcgccgcgccagcatgtcctcgaccgagagcgcccggccgcacggcggacaagtcgccgcgccagcaggtggaccgcctactcgtggggctgcgctggcggcggctggaggagccgctgggcttcatcaaagttctccagtggctctttgctattttcgccttcgggtcctgtggctcctacagcggggagacaggagcaatggttcgctgcaacaacgaagccaaggacgtgagctccatcatcgttgcatttggctatcccttcaggttgcaccggatccaatatgagatgcccctctgcgatgaagagtccagctccaagaccatgcacctcatgggggacttctctgcacccgccgagttcttcgtgacccttggcatcttttccttcttctataccatggctgccctagttatctacctgcgcttccacaacctctacacagagaacaaacgcttcccgctggtggacttctgtgtgactgtctccttcaccttcttctggctggtagctgcagctgcctggggcaagggcctgaccgatgtcaagggggccacacgaccatccagcttgacagcagccatgtcagtgtgccatggagaggaagcagtgtgcagtgccggggccacgccctctatgggcctggccaacatctccgtgctctttggctttatcaacttcttcctgtgggccgggaactgttggtttgtgttcaaggagaccccgtggcatggacagggccagggccaggaccaggaccaggaccaggaccagggccagggtcccagccaggagagtgcagctgagcagggagcagtggagaagcagcatcagctgttggaaacctgggcagccctctcagtggcttcctatcctccttcttgctggagccatgaatggcaggagctcagtgcttcttgtgcagtgcctggacccaggtatcttacttggggtcttacttgtacccttacagtctctgagaaccagcctctgctgcagtctctatcccctctcaagtccagggcaggccgatgctattggtgcttcttcactttgagacccagttccatatttgtctttagtgtatatcctcttcctgatacctccttcagtccctctctgggccccaaggctgagaatcagtgttaactgggagagccttgatttaggctacggcctcactctctatggccaccctaagaggaaaggctacttcacctcattacctccagag

SEQ ID NO: 463304 - DNA, 862 bp, Homo sapiens
tccttgtttgtctatcccactgcattgagggtaaccaatgaatgagaattcctttttctctccacatccttaccaacatttgtgttttcaatgttctggatttgggccattctgatagaataccagtgaagaaaccaatccttcctcttcatatcccagtgtcaggtcaaaggggggaaggaagctatggacctgtgaatgtaaggagtcagattctaaagcccccaatacaagtgggaataggccacacctctctaactctgatttcatttgttcctcttactttttctcaaggggcaggaataccttccaagcaggtccaagttcaaccactagacctgtacttcgcaagccttcagaggattcctgctttcagcccgcaagctttttcagctgaagcccccagtatcatggaacagaatcagattatttccactgagtccttttcaatttcttaacccacaggatttatgagcattatgaagtcattatggctttctgccactaggctgagagtggaccacatatacagaaataaaaaactattaatagaaaaatatattgcaaacatctaatcctcaaaccccattcaagttttgccaactaccctccatcctatcaaatattccttataccaaaaagatccagttcaaaaataagtgttgcatttattttttaacctcttttgatctggaatagctcctcacaccgtctttcatgactttagtgctttggaagactacagatgtttaggctcatctgaaatttccctgccgtcacctgggaatcaaccatttcttcagggagtcctagtttcttttagcggtcacatgtttttgttatgtctatggagacttctatt

SEQ ID NO: 463305 - DNA, 500 bp, Homo sapiens
ggttcctaggtgacctctctctgacttcatgggccatggaacaggctgtctctgtggtaatctcaacaatgctcaaggcagtcagtgcctggcaactttggacttaagagtatccgttctagaggctggaagtccaagatcaaagtgccagcaacaggccttgggagggcctgcctcctggttcatagatggccatcgtctccctatgtcttcacacggtggaaggggcaaggaaggcttccccacacacctgccctttactctgcggagcccagcttcctactgcagtaaactctcacatggccaagaagtttctcagagctctcccagagccagcataggggctgcttacaaaaagcccttggaagctgcttcactgtggaatccactcccgctccttgctactgcctacaggacaagcagccctccttttttgtcctgccactgtctggctgccccctaaccctctactaattaaagccaccatttgctatttgttt

SEQ ID NO: 463306 - DNA, 1035 bp, Homo sapiens
ggccaccagctccctgttgacatgtgcttcccccgccccccaccccgtgtcctgcgcaagtaccagaacaaacaggacagcacaggtggctcatggtccttggatggagtttctgttttcctggccagctcccagaggccttgctgcctgcgagaagtcactgacagagctcccccagcccctgcccccatgcttggccatggatcctaccagcaaggaggcttcactgtgagggaaaccagagccgggcatgctgctgcagctccagccagccgggcccgtgcctctgccagggaatgtgcttgtctgtatccctgcagccgtgttgaacgcagtccaatggcagactccccttgcctctgcggtgcttggcatgtggatgatttccaggtgaatatgcagcagaggcagccccgtgcctggtgcagggtggaggcatcccaggccgggctttgccaacatctgtggcagccacttcaaagagttccagctgctgctgaagacgacttggcaaaggacatgggctttacagtggacatcattgtccagtgtgggaagcctggccccactcagaccctgctcaccctgctaccgacccagctgccatcttcctcagactccagcaggccctccactcctagcacacaggccggattgaatcttcaggaaagaagagcacacccagggtgggacctgaccttcccaaggtcacacaactgcggagcagcagatctgggtcctggatccccaaactctgatgagatgcaggccgcttcttgcccacacagcagcgtgagctgctgtcctgcggtttgaaggaccatctaggtggcctcgcagactgacctccaggaagaccagatggcatcctgctccacacgtttactcttggtgactttggatcacttggttaatttctttaggctttatttcccttatctgtgcaatgagattggtgatgttgtgtttaatggagatggtgatgataacagtagtaaaacacattaaagagcctggccacgataaatggtcatc

SEQ ID NO: 463307 - DNA, 2465 bp, Homo sapiens
atgtatctcccagaactattttgggaacccaacaggatctcaccatgaagtgtaacgaggaggaaaaatctcttagctctgaggccttttccaaggtttcactgaccaatctgcgtagatctgcagtcccagatctttcttcagacctgggcatgaatatttttaaaaagttcaagagccgcaaagaagaccgagagaggaaaggctccattccattccaccacacaggcaagaggaggccacggagaatgggagtgcccttcctgcttcacgaggaccacctggatgtgtcccccacgcgcagcacattctcctttggaagtttctctgggctgggagaagacaggcgaggaattgagaaaggaggctggcaaaccaccattttagggaaattgacccggcgaggcagttcagatgcagccactgagatggagagtctgagcgccaggcattcccactcccatcacaccctggtaagcgacctgccggacccctccaacagccatggagaaaacaccgtcaaggaagtgcgatctcagatctccaccatcacagttgcgaccttcaataccactttggcgtcattcaacgtaggctatgcagactttttcaatgagcatatgaggaaactctgcaaccaggtgcctatcccggagatgccacatgaacctctggcatgtgctaacctacctcgaagcctcacagactcctgcataaactacagctacctagaggacacagaacatattgacgggaccaataactttgtccacaagaatggaatgcttgatctttctgtagttctgaaggctgtttatcttgtccttaatcatgacatcagctctcgtatctgtgacgtggcgctaaacattgtggaatgcttgcttcaacttggtgtggtgccctgtgtagaaaagaatagaaagaagagtgaaaacaaggaaaatgagaccttggaaaagaggccaagtgagggagctttccaattcaaaggagtatctggaagttccacctgtggattcggaggccctgctgttagtggagctggagatggtggaggagaagaaggaggaggtggagatggaggaggtggaggaggtgatggaggaggaggtggaggaggtggaggcggcccttatgagaagaatgataagaaccaagagaaggatgaaagtacacctgtaagcaaccataggcttgctctaacaatgctcatcaaaatagtgaagtctttgggatgtgcctatggttgtggtgaaggacaccgagggctctctggagatcgtctgagacaccaggcccagaactgcctcactaagctatacaagctagataagatgcagttccgacaaaccatgagggactatgtgaacaaggactctctcaataatgtagtggacttcttgcatgctttgctaggattttgtatggagccggtcactgacaacaaggctgggtttggaaataacttcaccacagtggacaacaaatccacagcccaaaatgtggaaggcattatcgtcagcgccatgtttaaatccctcatcacacgctgcgcttcaaccacacatgaattgcacagccctgagaatctgctggtccagtttatcaaagaggctcatgggaatgtcttcaggagagtggccctcagcgctctgcttgacagtgccgagaagttagcaccagggaaaaaggtggaggagaatgaacaggaatctaagcctgcaggcagtaaaagcgatgaacaaatgcaaggagccaacttggggcggaaagatttctggcgtaagatgttcaagtcccagagtgcagcaagtgacaccagcagccagtctgaacaggacacttcagaatgcacgactgcccactcagggaccacctctgaccgacgtgcccgctcacgatcccgcagaatttccctccgaaagaagcttaaactccccataggcctggcagatggtgtggaggacctcctggacattagctctgtggaccgactctctttcatcaggcaaagctccaaggtcaaattcactagtgctgtgaagctttctgaaggtgggccaggaagtggcatggaaaatggaagagatgaagaggagaatttcttcaagcgtcttggttgccacagttttgatgatcatctctctcccaaccaagatggtggaaaaagcaaaaacgtggtgaatcttggagcaatccgacaaggcatgaaacgcttccaatttctgttaaactgctgtgagccagggacaattcctgatgcctccatcctagcagctgccttggatctactcagtgtggttttctattacccatcttctgaagcctacttctgtcaatttgtccatgtgatctcggtccagttctgtgcccttgatggagagacgctgcgatcatttggagaagaggcaccctgacatttcgggtcttcagcattttttcgttgattctttctcatcttc

SEQ ID NO: 463308 - DNA, 1882 bp, Homo sapiens
gaaaggcacaacctttcatagagaccaccagtctgtgtagcgagggcaccagtctgtgtagcgagggctacacagatggcgaggggggggccctacactgaaactgagtcccagccccaggaagggagaaggaggacggaccagctggcagcctgggagaggtcacaggtcagtggccggaccccagtcgtagccatcttcatcggggactccgcatcgcggactcgtgtaaactttttcttcagggcttccggttcacagggctggagccgggagctcatcatccgcatccgtgtagggccccccgctagccgtctgtgtagcgctcgccatcagtgtacgcgccgccctcgccttccgtctcctccagtagtcgctgttaacacggctgtcgcagctgaggtcagcagagctgtcggccaggccgcggtgagggttgtcctccaaggagccatccagcttatcttccgccgtccagatgggccgcgtctgctgctctcgaatgatagccttgaactcctggtaccaggtgtcactcgtgccattcagagggatggtggctgtgaagaggtggctgctctgcttccgcagcttctgggcttgtgcgtagaggcggcgggtactgcggcaggaggcaggcgccagccaacttagctccttctaaattgtcctcatacatccagtgattttcagatcattttcattcaaagactgattgagaaaatctcagaagattaaagagaataaaggatctgacttgaaatatttgtgattttgttttattttggtttggttattttctaaatataaaatgaaatatttaaaggttcacataatagaagtatgaattatgtctattttctccctttataatatagaaaatattttccaaacactgaatatgtttgaatttcagagctactaagaaataaagtccaataagcatatgtaaattatgcagattttaacatcaataaagcaaattgaaacaaaatcttgctcagcagaattattaatgtaaagaagggagtaactacttgcacaaactgatttaactgtgtggcacacatttcctgtaaggccaattggacagtctcccaaaggctttacaaagggttacagaaaagatgttcctaaaacagtgcatatcacaaagttgattataaaaatccagatttagaaactaccaaagttgccaaaagtaatagtatcggttaaatacgtgatggaaaatagaatataattaccattttaaaaaaacagtggaaaaaaattattactataaaaatttgctatatgatcccattttcaaactagacatgtaaagcttagattaggttacagagggatgagaagggatctaaaatgagaaatagttgcaacctgagagttactttttgttcctcaattctattttactagctgaatatattgtttacaaaataataaagttagaccctagtgcctcatctattgtctggtgttaaggtagcagccctagaagaggagctcctattaaatataggtgtcatttttgttctgtatgcacttctttctattccatacaatttcctgagggatgtgaaaataaacatacttaagagatttcacaagaacagtactactttaaggtgatatgctgtaatttgaccccacctgctaacatttttcctccaaaagatatcagaacttttcttattgtgtcactgagacttatatttatatattgagcttttaatctataattgtgactgtgtccagagcatacatacaatacatagtataaatgtatttaagcggaacactaatcaatttttgttaattataacatttgaacttcactgaagctttataccacatattacagaaataaaactagaag

SEQ ID NO: 463309 - DNA, 831 bp, Homo sapiens
tatacataaataacccattatatattatgaaacagaaagttcttcagcaggctagtagcgcaaagcctaatcaacacttctgtgaggaagttagcagccttccttctgacctgactgcttccgcttctggtggtggcagcgctgtcaagcctcattactggaaagttcatcttgttaaatttccacttagagcaggggatgtgttagaagatagctcagactctgtggccattatgacatcaaactcagacagtgacattccaagtggtagtcaaggagttttgtttctagcttcattgaaaaatgtgaacattggctgggcacggtggctcacacctgtaatcccagcactttgggaggccgaggtggctggatcatttgaggtcaggagtttgagaccagcctggccaacatggtttcatggcatgatatggctcaatccacagacaaaggctgctgagcccagaacagcttattggacgagcccctatgagaagcagaaatgtatagaagcaaactgaacccaaggaaagattggtgatactttgggagggatgacagaggaaggggaaacacactgtccatccctgtcccagcaaggagccagctcccattcggcagtccctctgaacatctaggtagcttcccccttctttctgtccagttgtgagcagccaccaactatgatgcccctcttccagcaggctttgctttcacatcacaaagcatcatcctgagaaacaattacagttctttttagagttctggttccttcataggtacctattgtcctaataaatggaattccttggaacacaaaagcatttattt

SEQ ID NO: 463310 - DNA, 3130 bp, Homo sapiens
ctgctggcatacactgctaaaggagatttactttttttttttttttttttttgagacagggcctcactctataagtatggagggtgttttggtgccagtgcacattcatgatctccaatcccaactcaccctcaggaaagcttctcaagatgtctgtggctccagcagcccagaagaggaggaaataaatgcctctggggcagctgtgataggcttgaaagagcaactgacacttggagctgaattttcatttcactgtgttgaatatttgaatgcttctcccttggaaaaacagggagaaagtggccagcccctccaaatttacaagagggaaaaaccaaacaactccattaaaaagtgggcaaaggacacgaacagatacttttcaaaagaaggtatagatgtggacaacaatcatatgaaggaaagctcaacatcattgattattggagaagttcaagtaaaaaccacagcgaagaagaggaggaaataaatgcctctggggcagctgtgtactactatcttcatttcaagtatccttgaaaagactttctccattgaattgcctttgtacctttgtcaaaaatcaactgaccagccttatagcacgttaagaagtaacttatatgatgttattaacacaaaggatgggggaaggaatgaagctatattggagtaaacaatgacaccagacagttatgtgaagaaatgaagaataccaggaatattaaatatgtgaatgtaaaagaccctaatatattttcctttctcctcttaactttataaaaagaaaattatttaaagtaataattacaacactatattactgggtttaaatatataaacatatatgacaataatagcataaaggtggaggaaaggaataaagctctattggagcaatttctatattttttagaatcaagttagtattaagctgagagaaattgtgataaactaagacgcaatagtaatctctagagtcatcactacgaaactcaagaaactatagtaaaaaaaaatacattaattaaaatggtgtactagaaaatacctatttaatagaaaagaaggtgataaaggagggtgagaggaagtaaaaagacatgtgatatatagaaaacaaatagctaaatggcaggcatgaatccaaccataccaatgttaattttaaatttgaataaacactcaaaagggcagagattgtcagattggatataaaaacaagatccaactatatgctatctacaaaagatacacttcagattcagagacaacaattttggaaaactgtcaactatttctataccattctctttcctttccttctgtgattccaattatgtgtaatgttgaacttatttgatactataccagaagactctgatgttattttttaaaattattttttctctttttacttcagtttggtttcttgtgacctgttttcaagttttctagtgctttcttctgtcacatctcatctaattgagtgaccgcaactcctaagtatattgtgactttattttcaggataagggagatcttgaaggcatctcgaaagttgcaaggtgatccagatttgccgatgtcttttactttggccatagtggagtctgattctacaatagtctattataaacttactgatggatttatgctgccagaccctcagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaagattggcaaactttttctataaagggccagaaagtaactattttaggtttttaaacctactgtctctgtcataacttgtcaacactgctgtatgaagcacaaaagcagccatagacaatacataaacaatacgggcgtggctttgttccagtaaaactttgtttacaaatgtggtgccatagtttgtcatccctgggtctaggaaatagtcaataaacagatatatacaaatgatacataatgtacttattaaaaattagtaatgaatattattaaaaacatgaaaatattaccttaagtaaaaattgcaagacggaaaagtgtataagtgggtgtaatcatggctgaaataacagaccaagcatatgataaaaagataacaaagtaaatcaaattactaactggttatagtgggataggaggcagaaaatggatgactttgtcttttctcaatgtttttatttgtattttataataaaaatgttttaaaattaaaaggtgtcttgaaatctgtattagttatctatcattgcaaaataatattaccacaaatgtagcaacttaaaa

SEQ ID NO: 463311 - DNA, 3016 bp, Homo sapiens
ttgctggatttcccgcgccttctatccctgcagattgagctctggccttcaccccgggcctcttaacttcaggtccgcccaagtgccctcctctcagcaggcggaggctcacagctctgtcgggagtagggagggctgaccgcattgtggtgcaaagtgacaagtcgagtgttgacttggggactgcgatgaccggccaccaggaagggaaccaggtatgctctggggtcccgggcggcgccctggcagcggacgttcccgcaggtagtgcgcgacttttgccccaggaagaagtcgctgctgcctgcagggtggccttggagaggctcgggcctccattgagactgctcacttccttttctccgggaccacggctcttcagctttttccgccctaggctcccgcgcctcctcagttccccatgggagagttatttgaaggctccccggagatgggatttggcccaccaatcctagcaagtcaaggcccgcccggctaggcgcagagaggcggcctccctcccgctaccccgggtggggtagggaccccctttccccagagaccctctagcacctgagtgttgatgatcattactttaaattaaaagtctcttttctcctttccgtctaagcctcaacttagtttcagagaatgaagcgtgaaagctcttttatggagattaccgatgcttcatttattcccgcgaatggcaaacacagcccgggaaaaaccgagcgagcgagctccttgtctcggatcctcggccgtctccgtgttcacaagctcacttggctgtgagacgccgtcggggaaagcccctgcgtggcttccctggggaagggaattgcgcgttcgctagtgccgcagtccgcgagcatccctgggcgagacagcggtgcttttgatgtgcctgcgtttttgatggccgcattctcttgaaatgtggttgtgcggagcagtcccagatacctttcagaagtgtggccttgggtttggaatggagcatgtaaggacaggatacagagtgacttgctgccttctgggtgtcatataaagtggatgaagccagaggggcaccctgctgaaatgactccccggtctatttttggtgtagctctaccatggaaccatccgttttcacttttccatggcccctgccagctctcgcaaatttgcacacatgtttacacagttgtaaacctcaggactggccctgagggctcctggctgctgaagcacagcagagctacccctggagccttgaaaaatccaaattccagatccaaatttgagtttggctcggcctgccgaactcaaatctccaaagaggcagccctggcacagatttcacaaggatcaggcaataatgaatcgattaataaagacagcagtcatttatcaagcctttattatgggcaggcctacacctgcattgttacaaagcaggtggacggttgtggggttatccagaaaaatgtcattttaacccactgtgaaagacagagggcttctaaatttggcccaagtcatccagtctgggccgtgtggccacaatgatgattttcactcagccaattcaaaatactcctcttctcaagctcagacccactttggggctcccaaggtaaaaatcaaaaaaactggctctaagacaatgggaccccgagcggtgtggaattctaagcccaggcttgccttaaagctacaatatggatttaatttatatgcaaatgcaagcaataaaaaggcagacactgtagaaattatagggtccccccctccttttcttaggagatgctcaaccctttctctcctcttccaactaagacctaattattattggttcctgccacctcccccctctccctcctgcccactctggcccgctgggctctcctgttgaccagtagaacgcaaaactgatcaaagccagccggaagccttaagtaggccaaaatgggggctaaattatgctaatagaggagctaaatatactttaatcctgttataatacaagtgcagagaaggtacctttgcaggagaaagagaacccacaggctgcaacggaagagactctagaatttaattccggctctaccgcttactggcattgtgtttgggggcaaattcttaactttttcacacagtcgtaaggatcagatgggatgatacctgggaagttcttgacatggcactcatgtcagccagggaagtacctactgagagtaacctcttactactattggacttagtcctagtaagaccattgttacttttatattagcagatgaaaagtccctttttatagttttaatacttattgatttcagcaagaaataaaatgcaactatctgtctgaagccagttctgagggatcctactcccccatcattttttcctgccaaaggcaagggcattggcattgtaaaacctggcttcagtattgatgctaagtttcccagtcctgaaggcaatctaagcctctcacattctcctcatctctggttctgcttttcctttaaaatatcttcctcaagctctggggcaagaccttcctaactctaaggggaaaataaaaaactgtaaatgtcccattgaccaccgatactttctatttctcacttgagtggaaagcctccccaccaaagagtcttgaggactgagtcatcttttttgttctttgcgacaagtcataaaatggttttaattatatggtgtttttccaagtaaacaaccagactgaaagagaaaatatttaatttttgttgaattaagttgggaacaatctcagcaccatgactgccgacgaggccggcaaatggggcttctgatactgtccttgttgtggtgcatgttttcccttagcggtagcaacaaggaaataggaaccaggccagagagatgcaagaaaaacgtaaaacgcaacttcaatacgggattccagattccaactgaaacccaggagttattttggtaacagttttgccaggggaaaaatattcaaagatctttgttt

SEQ ID NO: 463312 - DNA, 3230 bp, Homo sapiens
ttgctggatttcccgcgccttctatccctgcagattgagctctggccttcaccccgggcctcttaacttcaggtccgcccaagtgccctcctctcagcaggcggaggctcacagctctgtcgggagtagggagggctgaccgcattgtggtgcaaagtgacaagtcgagtgttgacttggggactgcgatgtaagtgagggaccctgggtgttggtggaggggagaatggagggattattgcccactcccccctccgccgtgccaaattcagccagaagttaacaaagtttgcttttcgggattgaacccgtcttgggttctccgaccgcccagggcttggggttagggaaaggaggcgcagagtcctttgtgcccatcgcatgcaaactttggccccaaacaggaccggccaccaggaagggaaccaggtatgctctggggtcccgggcggcgccctggcagcggacgttcccgcaggtagtgcgcgacttttgccccaggaagaagtcgctgctgcctgcagggtggccttggagaggctcgggcctccattgagactgctcacttccttttctccgggaccacggctcttcagctttttccgccctaggctcccgcgcctcctcagttccccatgggagagttatttgaaggctccccggagatgggatttggcccaccaatcctagcaagtcaaggcccgcccggctaggcgcagagaggcggcctccctcccgctaccccgggtggggtagggaccccctttccccagagaccctctagcacctgagtgttgatgatcattactttaaattaaaagtctcttttctcctttccgtctaagcctcaacttagtttcagagaatgaagcgtgaaagctcttttatggagattaccgatgcttcatttattcccgcgaatggcaaacacagcccgggaaaaaccgagcgagcgagctccttgtctcggatcctcggccgtctccgtgttcacaagctcacttggctgtgagacgccgtcggggaaagcccctgcgtggcttccctggggaagggaattgcgcgttcgctagtgccgcagtccgcgagcatccctgggcgagacagcggtgcttttgatgtgcctgcgtttttgatggccgcattctcttgaaatgtggttgtgcggagcagtcccagatacctttcagaagtgtggccttgggtttggaatggagcatgtaaggacaggatacagagtgacttgctgccttctgggtgtcatataaagtggatgaagccagaggggcaccctgctgaaatgactccccggtctatttttggtgtagctctaccatggaaccatccgttttcacttttccatggcccctgccagctctcgcaaatttgcacacatgtttacacagttgtaaacctcaggactggccctgagggctcctggctgctgaagcacagcagagctacccctggagccttgaaaaatccaaattccagatccaaatttgagtttggctcggcctgccgaactcaaatctccaaagaggcagccctggcacagatttcacaaggatcaggcaataatgaatcgattaataaagacagcagtcatttatcaagcctttattatgggcaggcctacacctgcattgttacaaagcaggtggacggttgtggggttatccagaaaaatgtcattttaacccactgtgaaagacagagggcttctaaatttggcccaagtcatccagtctgggccgtgtggccacaatgatgattttcactcagccaattcaaaatactcctcttctcaagctcagacccactttggggctcccaaggtaaaaatcaaaaaaactggctctaagacaatgggaccccgagcggtgtggaattctaagcccaggcttgccttaaagctacaatatggatttaatttatatgcaaatgcaagcaataaaaaggcagacactgtagaaattatagggtccccccctccttttcttaggagatgctcaaccctttctctcctcttccaactaagacctaattattattggttcctgccacctcccccctctccctcctgcccactctggcccgctgggctctcctgttgaccagtagaacgcaaaactgatcaaagccagccggaagccttaagtaggccaaaatgggggctaaattatgctaatagaggagctaaatatactttaatcctgttataatacaagtgcagagaaggtacctttgcaggagaaagagaacccacaggctgcaacggaagagactctagaatttaattccggctctaccgcttactggcattgtgtttgggggcaaattcttaactttttcacacagtcgtaaggatcagatgggatgatacctgggaagttcttgacatggcactcatgtcagccagggaagtacctactgagagtaacctcttactactattggacttagtcctagtaagaccattgttacttttatattagcagatgaaaagtccctttttatagttttaatacttattgatttcagcaagaaataaaatgcaactatctgtctgaagccagttctgagggatcctactcccccatcattttttcctgccaaaggcaagggcattggcattgtaaaacctggcttcagtattgatgctaagtttcccagtcctgaaggcaatctaagcctctcacattctcctcatctctggttctgcttttcctttaaaatatcttcctcaagctctggggcaagaccttcctaactctaaggggaaaataaaaaactgtaaatgtcccattgaccaccgatactttctatttctcacttgagtggaaagcctccccaccaaagagtcttgaggactgagtcatcttttttgttctttgcgacaagtcataaaatggttttaattatatggtgtttttccaagtaaacaaccagactgaaagagaaaatatttaatttttgttgaattaagttgggaacaatctcagcaccatgactgccgacgaggccggcaaatggggcttctgatactgtccttgttgtggtgcatgttttcccttagcggtagcaacaaggaaataggaaccaggccagagagatgcaagaaaaacgtaaaacgcaacttcaatacgggattccagattccaactgaaacccaggagttattttggtaacagttttgccaggggaaaaatattcaaagatctttgttt

SEQ ID NO: 463313 - DNA, 1742 bp, Homo sapiens
gccagcaggatgcagattatccaaccctgatgatcctgagatgagaccaaactgctgctgaggatgacagccgtgctctggtcactccagaggctgaccagtctgcgcatggctgaaccttgaggagacaacaagccctgctctagtcacacaccggcagctgactagtctatgcacagccgaagcttgaggactcatcaagcaagagaacatggaggaaattcacatctttataatactaaatcacctcatttataaataaggtgactactgctgatgtggtggaaatttctgattttttaatgttgactttgtagccagcaatcttattgaactattttattcattctaatagtttactaataattctgcttcattttctatgtagctaatcaaaacaaatgtgcctctttgagaaactatatagcaccaaggttaaaaggtgaaatctggaagccataaaaactagtttcaaaactgtagttaattcctctacttcctttccagattacaaatttaatatccaattttcttgcctgagactagactcctctactgaagactcattttataacattccttatcttcccatcatcaccagcccatctacaacacaaaggaagaaatcctttgccctattgcctcctgctgccataaaattatatattatgggatagcagagtctttttttttttttttttttttttttttgagacagagtcttgctttgtcacccaagctggggtgcagtggcgccatcttggctcactacaacctccgcctcccgggttcaagcaattctcatgcctcagcctcggagtagctgggattacagcttcatgatggtaaaaaattccaccacctttgcccagaaaaaagtgattcacatcctgatatcactgtgtactcagggaaatagctccccacaaggcattgcattagggagaaactatgattcttgccagattagagctcctggcgcagtcagccaacattgttccatgctagcccctggacatttgtatcatacaacagcacataatttcacccgcagcagtggaaaagatgaagtcattcgacatcagctgtcactctacacagctatcttggggttctacctacagcggatcaggaaaactccacgacgagcattcggggacgcctggagccctgcccaactatctccgggctctggctgcagccctgactgcgccggaagtttcctgaggaagcaccatggagttcacccctgtgccctcagtcatgaccccgccgcgagcagcccgggacttacctgctttgctggctacttccctgcgcgccccgatcccgaagctgtgggtggcccgcccgggtacttttctcgtgggtcagagacacagtgtgtagtggttatcacgttcgcctcacacgcgaaaggtccccggttcgaaaccgggcggaaacaaagtggctctggctctggctccggctccggcctcttcggccgagactgcgatggctgggagcatcggtggactcacgtctccaaaaaccgagctccccaagtgagcaattcctatcctttttaagggcttacagctctaagggggacccctttctgcagcagagagctattctctttctttcgtctattaaacttccactctcaacctcactctttgtgtgtctgcatccttattcttggtggctgtgagacaacgaacctcggatgttactccagataacaaggccgtttcagt

SEQ ID NO: 463314 - DNA, 474 bp, Homo sapiens
gccagcaggatgcagattatccaaccctgatgatcctgagatgagaccaaactgctgctgaggatgacagccgtgctctggtcactccagaggctgaccagtctgcgcatggctgaaccttgaggagacaacaagccctgctctagtcacacaccggcagctgactagtctatgcacagccgaagcttgaggactcatcaagcaagtaaatgtagttaaaaatcttaagactaatagttttcctgtaatattgttttcctattgttctgtcactgtattcaacctttttcccagtaaggacctcttttgtccttgctggatatgaatatgctgtacattgttttgttgttgctaccccccccataaccatgctagaagaaacatctatataaggtgtccccactgggaccattactagccctacaggagaaacctggaccatccctgtttattctgcccagccccggtgggacc

SEQ ID NO: 463315 - DNA, 234 bp, Homo sapiens
attatccatggacttatgcattcatataaattttacaatcagttgtcaagttatataagccattctgttgatatattgatatcgcatgggtcttgcaggagaacatggaggaaattcacatctttataatactaaatcacctcatttataaataaggtaaatctcttcacttaattagttctcaacttgcccttgaataattttaagtgtttctcaatacaaaggttatgtgca

SEQ ID NO: 463316 - DNA, 1500 bp, Homo sapiens
ttattttctcataggcgctaggtgactactgctgatgtggtggaaatttctgattttttaatgttgactttgtagccagcaatcttattgaactattttattcattctaatagtttactaataattctgcttcattttctatgtagctaatcaaaacaaatgtgcctctttgagaaactatatagcaccaaggttaaaaggtgaaatctggaagccataaaaactagtttcaaaactgtagttaattcctctacttcctttccagattacaaatttaatatccaattttcttgcctgagactagactcctctactgaagactcattttataacattccttatcttcccatcatcaccagcccatctacaacacaaaggaagaaatcctttgccctattgcctcctgctgccataaaattatatattatgggatagcagagtctttttttttttttttttttttttttttgagacagagtcttgctttgtcacccaagctggggtgcagtggcgccatcttggctcactacaacctccgcctcccgggttcaagcaattctcatgcctcagcctcggagtagctgggattacagcttcatgatggtaaaaaattccaccacctttgcccagaaaaaagtgattcacatcctgatatcactgtgtactcagggaaatagctccccacaaggcattgcattagggagaaactatgattcttgccagattagagctcctggcgcagtcagccaacattgttccatgctagcccctggacatttgtatcatacaacagcacataatttcacccgcagcagtggaaaagatgaagtcattcgacatcagctgtcactctacacagctatcttggggttctacctacagcggatcaggaaaactccacgacgagcattcggggacgcctggagccctgcccaactatctccgggctctggctgcagccctgactgcgccggaagtttcctgaggaagcaccatggagttcacccctgtgccctcagtcatgaccccgccgcgagcagcccgggacttacctgctttgctggctacttccctgcgcgccccgatcccgaagctgtgggtggcccgcccgggtacttttctcgtgggtcagagacacagtgtgtagtggttatcacgttcgcctcacacgcgaaaggtccccggttcgaaaccgggcggaaacaaagtggctctggctctggctccggctccggcctcttcggccgagactgcgatggctgggagcatcggtggactcacgtctccaaaaaccgagctccccaagtgagcaattcctatcctttttaagggcttacagctctaagggggacccctttctgcagcagagagctattctctttctttcgtctattaaacttccactctcaacctcactctttgtgtgtctgcatccttattcttggtggctgtgagacaacgaacctcggatgttactccagataacaaggccgtttcagt

SEQ ID NO: 463317 - DNA, 656 bp, Homo sapiens
attagtcatatgctgcaatccctaatcagatctctttacacagagtcctgtaggctctccgctcaggcagttctcttaagaaatgatgaactgctctattggcagccgccacagggtgagaagctcaatcaagttcacaaagaagaggcattaggctggcaagcagagctggtgggatttacctttgacgtagtgagctccttgaagctacaacaatgccatatgcatcctgtcacagtgtctggtagaagctgcaaagccttctgggagcctcatatcatctcccgtgggcagctgtcttgtgtccctgggcagaatcactcttcaagaaagcatcagcaagcatcacaggaggctgaagcacgagaatcacttatctgtataagaaatagtgtcaagatgaattgttgtgtcctcaagggtagcaagctctccctcattccttctcagatatcttgcattaccctattttactaacgaaaaaatattctctaatttaagcacaatggcatattttattttcctaatgaactactttctgtgattttggactatcccattgctgaaatgttttatctgatttttgatgctctaatgatcccaataaattataaacattttgcattaaatgaactcttttgtggacactctaatcc

SEQ ID NO: 463318 - DNA, 596 bp, Homo sapiens
agagactctgagccagaatcacccagctaaactgctcctgaattcctgtccacagaaattgtgagatagtaagtatttggtatttatttttagagagagagtcttgctatgcggcccaggttggtctcaaactcctgggcacaagtgatcctcctgcctcagcctcccgagtagctgagactacagatttacgtcaccatgtccagctaatattaataaatgtttgttattttaagctgctaagttttagggtaatttgttaggaagcaataggtaactaaaatatgcattaatagttaaaccattttgaaaaagattatagtttttaattcccattattgggccaaaggagatttctgtctcatgagtagctgattttacaaggttaataactctatttttaaaatattgatatgctggccgggtgcagtgcttgcacttgtaatcctagcactttgggaggccgaggtgccaggatcacttgagctcaagagttggagaccagcctgggcaacagagtgagcccttgtctctattttcaataaaaataaatatatatataattttaaaaataaaataaaatattgatatgctat

SEQ ID NO: 463319 - DNA, 2926 bp, Homo sapiens
gagtgctcaaaatgattattttattaacaaataataataataacatggagatttaagaacgtccactgccggaaactagaccaacagctaaaggaatggatgctttcattatacgccatggtgtggttctcctttcaacaggaattagagcttcatcctcctcccctggaaggtgcactgaatttcgtgacttgcttttgatgaacagaatgtggtaaaagtgacagtgtgtgacctctgagattgagtcataaaaggcatggtggcatcttccttgctctctctctgattacctgctctggaggaagctggctgctatgtcataaaaacacttaagcagcccaatggaggaggccatgcttgaggaaccaaggcccctgccatagctgtgtgagtgaaccatcttggaactggatcttcaagttccaaacaagcttttggatgactgcagccctggaggacatcttgactgtaacctcctaagagactctgagccagaatcacccagctaaactgctcctgaattcctgtccacagaaattgtgagatatgtctttgcagatatagttagtcaagatgaagtcctaatggattaggatgggcccaaatttcaaggccttatgccatgagaagacccagagacacacacaagaggaaggccatgtaacagtgaagtcagaggttggagtgatggagctgtaagccaagaaaggccaaggattgctggcaaccaccagaggctggaagaggcaaggaaggttcttccctagaaccttcagagggtgcatggccctgctggcactttggttttagactcctggcttgcagaacacaaggaaataaatttctgttgctttaaaccacccagtttgtgatactttgttgaggcagcccaaggtgagttcatcctaactggaaaataactcgtctgcctccctcattctgagttcaggtacccaggtagctccccttcttggggctgggacctttctcgctgagctcagcatcccaatctgtgaggatgatctatccgtgagtcctccaatgtgctggcctcctcatgacgccagactggctcctcttccctccccccacgcctcatccccaaagaaatctaaactccgtggcgtctgaaactctctgcgcctgggtccccaaggtctccgcctggatccaagacttttgtgaccaaagcgggatcgggtaggggggcggcagtacctctttgcaggcatgaagctccggtcccgttccctgggtcacctggaaggcggtcccagcccagagcagcagccgccacagccggggtatgcgcctctcagtgctgcggctgctgcttctgctggcagaaggcggaaaaaaaggggagggaggtacacaggcggaggatgcaagaggccaggctcgcttcagtcacctccctgcggctacgccaacaccgcccatccttcctcctccctctgtcctctcctcctacccacgtcgccttgacaaccgcctcctctctggctccgcgcgggtggggcagggaccacgcgcgcctctgcagctcacctgcgggtcgccatggcagccgccgccgctggtgcgcgcggcgtgggcgcgggagagcgcgcgcccggggtgcgcaaccggcccaacaggcaggcccggggctcgtgtgaagaacacagtggaagcatcctccaagccagccaacaaatttccgttttctactgccctttcgggccaggggttattttatgagcatctccgatgttgcacacgtggcgtgtgaaccgagagaaagaagatggagagatcaccctccagacgtcgtcgcctggaagaggccccaaaattgccatataagaacccaacacaccttgctcagcagcaggaaccctggagtcggctcaactcaacccccacaattacttccatgaggcgggatgcctactattttgatcccgagataccaaaggatgacctggacttccgcttagcagccttgtacaaccaccacactgggacattcaagaacaaaagtgagatactgttaaaccagaaaaccacgcaggatacctataggtaagtggtagaggcagagcctctccagcctaaacatgctgccatccagtcatataaggtaaaatgtcacctggaaaatgataatcactaggtactcatttgtatacaaatttctgtatttttacatctgtgtctataatatagtttctgtattttcactgtctaagatgaacagaaatctcccaagattgtgctcatctgtataaacaaaatctttggttaatcccacagaggtaaaaagagtctttggctgctttattcttgagatcacattcaactaccttgccttcctcacctttctctgattgatttcactctccacttttcttccctatgccttcttctagaaccaagatccaattccctggagaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaagatgaaaaactagtcctttggggtatatttgcaacttggaaaatcatatcttgctgatgaagatttaggacacaacagcagtctttggtaggatacagatattcatattttgtaaactgaagtcactccaaccatacagagccatccattcaacactgccagcaaacctttatgtgccaggaactgagctaagtgttgaggaaacaaaaatggacatgagctaccttgtattttcagaagct

SEQ ID NO: 463320 - DNA, 3826 bp, Homo sapiens
gtgggcctggcctctcccaccgcaggaggaaagagcagggggaagcccccggcgcccgccgcctccgagagccacggtgtcctcgggccgggcaggccgcccgcccgctcggcgccccgagccgtgagaaccccaccctgccgggcgtgggcgacggccggccgggggcgcacggagcagccgtcgcggggcctcgccgcggcctccagcgccccagtcacggggaatgcagtggtccccgacccctggcgcctctgcgtgtctgggctgggcttcctcgctcgcctgctccacggccccgacgctcctgggccgagccggccggggccccctcatggcggccaagtggttcaaggagttccccctgaacctgaagaccgtgtcggagcgggccaagcccgggggcggcggcggcaaattgcgcaagaactcggaggcgggcggcgctgggccgggtcctggcaagggccgcaagaactcggcggccgagctggggagcggcagggccggcgtcggccccaaggacagccggctgtcccgcgacagcctgcagggtctgattcaggccgccgcgggcaagggccgcaaaaactcccgggccacggaggaggagccccaccggggtgcaaccaagagctcgggctgcagcacctacatcaacaggctcatcaaggtggacactcaggagaagaacgggaagagcaactaccccagcagcagtagctccagctccagctcctcttcctccgcgtcctcttccccttcctccctggggcccgagctggacaagggcaagattattaagcagcaagagacggtcatcattttagaagactatgctgacccttatgatgccaaacggacaaagggtcaaagggatgcagagagagtcggagagaacgacggttacatggaaccatatgatgcacagcaaatgataacaggtttgtaagcaggctctacagaatagagactgaaatctcacactcagacacacttgaaatgccgtttgcaaaaccactgtaaacttcacccgtaagtgaggcacctttccactcaaccaagaatgttgtcttcagaagtcagaattgtccaacatggaataaatgtaataataatcgctagcatttaatatttgagtgtgtattaagttccatgctctgttttaaacaatttctgaaaataaattcatttaggaatacaaaattaatatattcagttggcaaataaattcaaatttattaaaaatccaaattactaactttctaaactagtgatctaagtatactttggtcttaactttaaaaaagttgtactcgtggattttaaagtttcttcatttagaatatatatcacaaagcaccttctcaatcagtgtagagactctacctcttattctacccgtaggttacaagctggacagaataacaggaagtgagtttatcggaagctagaaataaaagatttgctgctgggcttttgttttttgttttttaaaccttttacttttttattcagtttgctccttgtgtacctgattgtcaagtccaagttcggaaatttcccgtctttcttgagaaatgagagttttttttacttgtttcagcatttctgaagatggaaaggattttaatgaacacagttgaactgtggagtggttaaatctgtgttgccattctttgcattgccttttttctaccggtgaaatgggaattacaggcctggttttaacaatatcttgggcgtgtagaatactgcccatatgttgttttagaatacccaacaaatatttcttgaggtttttttttttattatgtactaggccctgtcctgagctctgggcatacaggaaacaagacccacatgatttctgcccttggacctcacagcctaagggggaaacagacctaccagcaaagaagataagtcattgaaaagcatgataagtgccatgaagttgagaataggagccagcatctacctcaggggcagaggaaactgagagaagcccatggctttcctgtggccaaatcgctatgggacccaggaagcctgggtccccccaaaactttgctcttaacttttaaaagttaagaatttatgagtttatgagtaaattatcactgagatttatccaaaggattgttcataaaaagatatgactgaatacaaggcaatattaatataaacctctgttgcttttctgctaaattcacaggaacattttaactaaatattctagctaagatatttagctaaatatttggcagaaatattctacataatctagcattaggagttttagccaccgctttgaaacattagcatcggacaggtctttaaaagttcccattggctagttagcatgaggattctttctgcagttgatgtcatacagctgtaaattgagagcttactagggtttctgaattgtacctgcttttgttcagatgtttagatttattcaataagaaaatattaaagtaattttaaaagcttgagcactgatcaaagatatgagtaaaaaattgtcgggcagccctgtttctgattccaggaggaaaatagagtcttaagaggctccaagtttaatgttttggaaacatgaaatgggttaaaatggattaggggaaaaggcacattatttggaaattggaattaacattttacgtgaaatcatttgagcataaagcatggactctggagttggtaataattggcctcaccataactgctgcatgactgtggcttccgtgtattcacctgtgaaaatggggtaacacatctgtcactgccttagtgaggcatcagtgagattctgggcataatacacctagcaggtgtatacctagtcagtacagccgctcgtttcctcttggagccagctctgcacgtcaggggctattctccctgcaggaagggtcggcttgcagccccacgattgtttctgtttctatggcgcctcaggtttgggggcagccaggtgttggaatggactggaagttctttagaaaagttccttttaaaaaaattacagccttgtcttaattgaaccaagaacagagtatgtttttgtttcttgttttccatagctctgtttggagtaagcaaggaagaagaaaaactgtaggactgagagtccagggactcaggagatgcagctctgacctcagacaaccccagatacctggcctggcctgggggtgggggccagggacagttcttccgactcttacattctgatgtggaagtggtagacacaggcagtacctttctcctcaggatgggactagcaatgacaggctccggagaatgaggaaccaagatggggactgtggacacccaggaggtgtggaagtggttctcaggtttagctgctctttagaatcacctgggggatttttacactcttgactcccacactgtaccccagactaatccaatctgaacctctggtggttaaagcagtgtgtgtgaaagcccgcgggtgatttcaatgagctgtccctgcacagaatttgagacagctgctgacagcccctagtcagcagagaactataacctcagcctatacctaagttttgcacttttgaatttggtgtcctgattttaataacgtttccctcatttgttgccctctttttgttatagaggtcttaatgagtcagtggcatttctccacggaccatccccacacctgttttgaagttacagatagaaagtctttccaccctttgtgtctgcggccctgcggtctcctgagcctcttcctcctcacctgacccctcagccttctttgctggcacctccttccagccacccataa

SEQ ID NO: 463321 - DNA, 1293 bp, Homo sapiens
  misc_feature (2)..(5): n is a, c, g, or t
  misc_feature (8)..(8): n is a, c, g, or t
  misc_feature (10)..(10): n is a, c, g, or t
tnnnnttntnctaatctggccatggggagtaaccattcctggactttggtgtcagtcagtgggcagcactggcctgtggaccccctggctgagagtccagggccattccgggctgcaaagggccagcaggagcgggtctccttggtctttctactctgcatcctcagggcggcacccccccttgtgctggcaaggtggcccgtcactcgaggcccaggaggaaggtccactacagagcccctgggggctggatttagtgaggacctgctggtcccgcgcagccccaccctcaaggcccaggcctccccaggctgcgctgtccttactgcaatgctgtcctgggcttggacaccttcctcagctttgatctctcacctgtgcctgtctcctccccgaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcccagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatcc

SEQ ID NO: 463322 - DNA, 458 bp, Homo sapiens
gcagatgaagaggagcccacaaaagagactgaggaattgtcttcattcactcattcatgcatgtattcatttggtcaacaaatattttttggcacctcccatggacaggtcctgagcaccaagggtacagtcagaaatgatgaatccagaaatgatgccctccagaacttctggtgaggaaggcactcaggaaaatgcagcaccctatggaggcccagaaaggagggcattcaggaagaacacagtctgatggtgtcaagtgcagcggaggctaagagatactgttatatgtgctcatgtaaattgtctggcaattagctgcaagaggattgtaggaagagattctacctatccatctctttacaccatgccttctgaagagaagattttcggagagaatccttggatttagtcaggaatattagatccctaaataaaaatgtctaaaatcctttccc

SEQ ID NO: 463323 - DNA, 2661 bp, Homo sapiens
cagtggcttcaaaggttaaacaacttgtcttcgattgcacagctaacaagagattgctgttccttggtcttgctgtttgccttgctacatgcgtatgaatgtgcagatgacaagaacagatgccagggcccctggaagatcaaagtcctggcgctgccttagaaaatctgtccatgccacatccctaaatctgcaggaaggccataacattgttttctccaaagaatcattcaaaaagttactaccgtatgaaaactctttagccatttacattttgtgggttttaacaagcgtgtcttccaggctgactctggctggtagaggttttcacccattcctcaatgggcaccagaattctgatgagttcatgacattcagtttaagaaattacccgcggccaaagatcttgattggcaaggatggcaacatcttattccctgcttcctgtgtctctcttcaaccttatctcataatctcactttccccctttcttgctcaccacatctctgatcctggttcctttcggttctgggaacaagtcaaactctttccagtctcagggcctttgcacctgttgatatctctgacccaaagtgttacatagccccacccttgttgcatggggggggggtggggggggggcgggggggggggggggggggggggggggggggggggggggggggggggggggggggggggggggggggggggggggggggggagggaggggggggtgagagggggggggggggggggggggggggggggggggggggggggggggggggagggggggggggggggggggggggggggggggggggggggagggggggggggggggggggggggggggggggaggggggggggggaggggggggggggggggggggggggggggggggggggggggggggggggggggggggggggggggggggggagggggggggggggggggggggggcgggggcggggggggggagggggggggggggggggggggggggggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacgaaggagagcacctcactgtctccctctgcccacccacctgcacctgacagctgtgggctgtgctctcagggaggcaccgtcagatgctaccagactacagaggagagcaccctcaatcctgactgaaggtttgggaaaaggctgctcagaagaggtgatacttgatatgggccctggaggaggagaagcagtttgagaagacagcagtgagagatggcatccgggcaggcgagaaatgcaaagggaagagaggtcatccaggacaaaagtacagaatgaaaagaaaaagcaactaagcacgaaatcttggagaatgtcctcattgaagggtcctgagcaccaagggtacagtcagaaatgatgaatccagaaatgatgccctccagaacttctggtgaggaaggcactcaggaaaatgcagcaccctatggaggcccagaaaggagggcattcaggaagaacacagtctgatggtgtcaagtgcagcggaggctaagagcctcagtgcctccttcagagatgcggtggatattagcttctgttgtatccttcatacagaacctggtgctgagagacagcttcttctttttttttttttctttaaacttttcttaagactagtcaagtacagtatcaagaagac

SEQ ID NO: 463324 - DNA, 2303 bp, Homo sapiens
  misc_feature (1)..(5): n is a, c, g, or t
nnnnncagaaccaactcagcactgggcaaggtccctttcctcaaggagctctgaatctctttgtgagacagacctccggtgaccgcatcacctccgcagaccccaggtcagttcctcaatgctggggacaagatgggccgtgtttgcggaggagatgggttaccatgtctgctgctaactgttaccatagatccagggatctgtgcttctttcccacacagtcccagggctccttgtgaggtgatagctcccagcatccactgcagtgagaggtggtcaagtgacaagttgaaatctgaagattgggcagagagcaccaagcctgcacccagcaccaaaagcctcctgctgtcttctttcccactggcggacatgggaaacagcagcccatcctcctttggggcccatactccccgactcttggtgcctgcgattgcactgggacaggatggagatgggcagaggctgatccggaggaccctacagggcttcgcgtggactgccctgggcttcacagctaagcgagccagtcagagcccttccagttcccactgagagttgtgactcttacattcttccttttattgggagattttcccagggccatcagtagcagttgagggggatgctggacgtcagtttcaggatggggagcttgactgtgcccacacacagtgtctatgatatccttcccctactccccctggctagctcccattggctctttggattgtctcatttcatagagcaccacttccaggaaggcttcctgaatgcccccagctgtgttaagtgtcctttacactttactctccagctgcacagaactaccttttattcagctcaggcatcacctcctccagggaggagtccttctctgattccttggctgggttgggcatcctcctgtgtgcctctttagcaccttgtgcaaacctttatcaggttacattatggttccatgacactgctttcctgcagggctgcgtgttcctggaggatgggaactgtgtcttatcattctgctggggactcatatgagaagaggaggttgagatctctgcagcagacattcccaaacctggtggagcatcagaaccaggtgctgaacttttagaaagtagacatcatggtctgggagacagacatctgcctccaaggatagacaccacatccacaaccctaaatccaagctaagtttggcacctcgaaagaaaggacagccacaatgggatgataaagtgggagcacaaacacagcacccagaggggccagagggtgatgtaatttactgatgctggatgaatgacccaggctgtaggttcctcaagggttgggactgtgcctgtgttctgggcacctgcccatgcctggcaatttgaagaagctcaattgctacatgttgaaggaatgaataattgcatgagcaaccatcgataattgcatgctacaaccatcaaacttgcagggttcttccatggaataaagcacagaactccagggagcccacgatgcaggagagttcagcgacattcactgagtacaagagaagactgttgggaggcaccaatggactttgcaactggagatctcccaactggaccatgtcactgttatgtttaatttgcactgtgcacagtaggtacccagtcaacgtttgtcgaattccatggactgggccttatacctccgaggatttttcacagcagtagcatgtgcacatgcacagaacgagaacacaaccaatgcttgtttgctggtgaagacctggtctcagtattttgcccaggaaaccctttcttcatggacagcatgaggcaagctatggcccttgctgtggtctcagtggttcagcacggaagatgaagatgacgggcagtctcagaatattagctttagaagggactttggatccttttgattttggtaggtgaaatactttttaaaaataaagaaaacggactttggacaaatgctctcattttgtaaatgaaaaagtagagacaggaagagtaactgatttgtccaaaatcaaacaaagtaaattgtgttgcatcctctccatccgtaaccaccttcgccttccctaactgctccatgtggcctgggaaagtccacttcacctcgtcttagaggtgggcttctgattctagctaagccaacccccacgttctgttcctctggtcatggtgattgatttggggaccagcctgagacctaagctagcccaacgggcatcctttctgccaggagtgagaggagtcaggccctctcttcctcaggatcagggatgtgagaagatg

SEQ ID NO: 463325 - DNA, 427 bp, Homo sapiens
ccacgggcggcggccccctcttctctctctcaaggagcccaagggtggtggcttcagcaccctaggaaatgtgccagcaaggtctacagtatcagcaactttacctctccctcccaaagctttctggagtgcttagtagaagacagaggactctaaagtgtgaatgtggaatggaaatcgaggccactgggaacggctgcgtcgaagagtaacttgggaacgcatagggattcacaggatagatattgtctggatatcagggcgaaatgttaattagggatcaaaatgtccttttaaattagctatgttgaagagaaaggagaagaccaggaaacagaagaaagatatatgttatgtggtattttggaataaatatttatagaaaacaatgatctgtttgtttaaaaactaccgatctaaaatgctg

SEQ ID NO: 463326 - DNA, 748 bp, Homo sapiens
atttccccttccctgatcataggcatggacagccggcccagggtctcccccgtggatctccccttccctgatgctatcatcttagtattcacggggtttgctctgacttactggcttcctcaccagttgtgctggatccttattggctttgatatttccatttacttactctctcatcaaagtgccctagaaatgggaattgaaggacgtcccgtttctaggggagggtgggaacagagcctgagaattccagcctgctcacccttatctcagagtgttgcattcccaggacatcttccaaggccacctggagagctgtcctgcagtgacacacctcagcttacccagcgtagaagagcccaagggtggtggcttcagcaccctaggaaatgtgccagcaaggtctacagtatcagcaactttacctctccctcccaaagctttctggagtgcttagtagaagacagaggactctaaagtgtgaatgtggaatggaaatcgaggccactgggaacggctgcgtcgaagagtaacttgggaacgcatagggattcacaggatagatattgtctggatatcagggcgaaatgttaattagggatcaaaatgtccttttaaattagctatgttgaagagaaaggagaagaccaggaaacagaagaaagatatatgttatgtggtattttggaataaatatttatagaaaacaatgatctgtttgtttaaaaactaccgatctaaaatgctg

SEQ ID NO: 463327 - DNA, 884 bp, Homo sapiens
gtcacaccggcttttttcaaatgaacgcgcaaaaggcggggaagtatctggaaagcgattggttcgtcctagaaaacggtcaaacccggagagtctgtacggatcctttccgttctccgcgggtggggcgcaggcgagagtgggaaactgggaaggccgggctctggggaggtgttgcggggaggggaaaggcccggatgttccctaacaatgaaatcatcgccgacctatcagagccgccgagctgggatacctgcctgacctgtaccccggagggagaagagtgggcgggaaattggggtgtcggaagaacctggaaagcaacgccgatggggaaagtggacatgactcctccagctatcaaattagacgatgctgccatgttaattctccaaacgagaaacaaaagtgtaatagagaacttgtatcgtcaataacgtcatcgtgaaccagactagcagtgtggatcatttctgcaattaaggctatggcgcggtggctggcttgcacatgtcaaattaacagacagcaatgctttttaacagacgccgcctagaaccttctcagcaatcagcttgtgaaaattggacatcggatcgggagttgttatgatggatattacatgctcgggccattagcaccccaataattggtcgaaaggcttttccttttccatcaaagtagtactcagacatttcctgaagttctgttgttgatatgagcagttcctttctaatgtcctcatacagacctttcaagtctctgcaaccgaatttgaaaggatcggtgatctgtatatttctcaccactgtgtgttttactgtccggggttgtgtgataaaaccgtgatatactgtatacatttggacaggcagatgttaagc

SEQ ID NO: 463328 - DNA, 951 bp, Homo sapiens
taaaggggtgacccgacacccaagaagaagcatatggcttcaccagagattggtctggtaaaacaattccacttgagcgcaggcctggttagggaaaatagaatgttctagcatagtttaaaatggcaactttcctcccccaacctacaggaagcataagggaatttttctctcatcttctctgtgagaacctggtcaagctcctggaggtaaaaccccaaacagtgttgggggcccttatgactgagtcccctggagtgtttaaccctcagatgtgtccacacgaagcctccagccattcatccattacagttcaggtttccctaccctggcatgggttctcattatggtttctgctcctgtgtttctgctctagaaacctgagaattcaatgatgtattggagaaaacaagtgcctgcaaactgtttgcagatatgtggtctttggtctgagctaccatagaaaagcttcccgcaaccaaatgaattacagacactcagcaaaagaaactctttgcaaatgtgattattataagtgccagatcgagacacccacagaatggtcccctctgagaaaagcactcaagcaggcccttctagtaacagggcttccaagaccacctccctggtctccagccctcaccctcacacactttctctttcctggtcctgtcacctcagggggcagagccagcccaagacctaagtttctgtttctggggaaactctcagccccacgaccttgcactacttcagaatgccccgggagtccgttaaactttgaaaatcaaaagctccaaggaaaatggcattccttcctgccatgctcctctgtgatctcggttccctgcaattgtgctggtgtctttactggccctttggtatttccatgtctttgctttatgctgcagcgtctcttcattagacaaagttgactttcttgtgtggcta

SEQ ID NO: 463329 - DNA, 1133 bp, Homo sapiens
aaagtgagctatactcagagcagacaccagaacctggaaatgaagcagctgcttgacagtccctgtgaacccgcagacggtggcctgaaatcagagaccttggccaaaagacggagttccaaggacctcctggggaagccgccacagctatacgacactccctacgagcctgcagaaggggggcccagggcagaggggaaggcgcggcccccagacagccggctgcccgagaacgacgagaggcccgcggcagagtacgagcagccatgggagtggaagaaggagcagatcgtgcgggctctgtcagtccagtttgaaggagctgagcgaccttccttcagggaggagacagtgaggcagcaccaccggcagaagagctggacccagaagatcctgaagccagccctctcggaccacagtgagggagagaaagtggacccgggcctgcccctggagaagcagccctggtatcatggtgccatcagccgtgctgaggctgagagtcgactacagccctgcaaagaagctggttacctggttcgaaatagtgagtcagggaacagcaggtactccattgccctaaagactagtcaaggatgtgtccacatcatagtggctcagaccaaagacaacaaatacacactgaatcagacaagcgctgtgtttgacagcatccctgaagtggtacactattattccaatgaaaagttgcctttcaaaggggcagaacacatgactttactctacccagtgcacagcaagcttcactaagattcagccactgcaagccctgggcctctggcaccttcaagggcatcatcagcgcacaaccagcatctcagaggacaaggctggactagcaactgctagaaaatgggagtcttccttgaaaagtcagagagtgatttgttttgttttgtttgagacgaagtctcgctgtgttgcccaggctggagtgcaatggcgcaatcttggctcactgcaacatctgactcctgggttcaagcagttcttccccatcagcctcccaagtaggtgggactataggttcgcaccaccactcccagctaatttttttttttgtatttttagtagagatggggtttcgccgtcttcgtcaggctggtctcaaa

SEQ ID NO: 463330 - DNA, 1504 bp, Homo sapiens
tctgtcccagaatctgtacaaaatgatcctctgcaaactggaagaagactgtgcaggcgcccgggagcagagtggccatgcagaggaagggacccagacacagcaccccaagatctggctacctcgggccctgaggcagacctacatccggaagatccttaggctgttgctgaaaggaggaggcccccgggagggtccaccaacttctaactcaaggaatgtgcagctccaagtcaagcctccctgtggacctggggtggacaggacccctacagcagcagggagagtcaggaagcctctcggggctgctcaaagcattaccctcattcctcagggcaagcccaaacctcaagccatctggacacatgatggctgtgccttggacaccaggcgtgtgagtgtgcggaatggggagcaagactccatcctcttcatccgagaagcccaacgtgctgactcaggtcgctaccaactccgcgtgcagctgggtgggctggaggccaccgccaccattgacatcctggtgattgagaggccaggccctcctcagagtattaagctggtggacgtttggggcttcagcgctacactggaatggacaccgccccaagatacggggaatacagcacttctgggatacacggtgcagaaggctgacacaaaatccgggctgtggttcacggtgctggagcactatcaccgcaccagctgcatcgtctctgacctcatcatcggcaactcctatgccttccgtgtctttgctgaaaaccagtgcggactcagtgaaacagcccccatcactacggacctcgcccacatccagaaagcagaagctacatgccagcccctcttggtgccctcagctactgtttacaagaccaaggggtttgcccaacgagacttctctgaagccccaaagtttacccagcctctggccgactgcactacagtcaccggctataatacccagctcttctgctgtgtccgcgcctctccccggcccaagatcatctggctgaagaacaagatggatatccaaggcaaccctaagtacagagccctgactcacctgggaatctgctccctagagatccgcaagccgggtccctttgatggaggcatctatacctgcaaggcggtgaaccccctaggggaggcatctgtggactgtcgggtggatgtgaaagttcctaattgaggacacctaagaaggcatggtactctgacaaagtgcctccaggaagcccgccagtggtgagactgtgtcctcaaggagcttcggcaccatgtctggtttggattcatctaaataaatatgtggttccccaatctctgttttaatgttaatgttggtcagctgtgcctgattcccaaagggcagagagtataatgaggcatgtccaacccccactttccattatggcctgaactagttttccaggttaaatctggaatgcccttgtcagagagaaggggtccattcagttggttggggggcttagaa

SEQ ID NO: 463331 - DNA, 1198 bp, Homo sapiens
cagcatcagccatgctcctcaaaatacaagaaatgggatcaacagtggaggttttgaatgaccaattgactaaaaagtgttcagagttgagctgcatgcttcagactgttactatggaaaaagccagaatcattgctgaccatcaggccattctgcaggtagagcagaaaatgatgacgcagacatttcaagaacaaaacttattgctggatgcagcccatgccagtatcacaaatgaactacagactgttcagaatgagaaaacccaactccaggcacatctggatcatttaatccttgagcataaccagtgtatccagaaagcacaggatgctgaaaagagaacagctgtgcaaaaagagctgctagaatcaactattgcaagattgcgaggtgaattggaagcatcaatgcaagagaagaagtctctgctagaggagaaagaaagatttcagagggaggttaataaaacagaaaaagaaatagtgcaagaaagatgcaatttggaaaaggaattagctaaaaacaagcttgcccaacagaaggtggaaaaaatcactgaaagtaaaaataaactggcctatgaaaacggaaaactccagataaaagttaaacagctagaagaacaagtacagtcttttactgacaccagcttacagaatgatcatctacgcaagatgaataagtatttacagactaaatatgctcaggtgtgattaatatctacaaaagcggattgctgctatatttcgtttttaagaaattgtttgatgtctttttccccactttaccacacaatcccagaaagataaatatgctgtcacttgactcagtttaacaaactttttttcaagcacctagtacatacaaggttctgctaaagcctcagaaattgtaaagatacctgaagcaggattgagacattcaacttgcttattatagttaggaaatgtactccataaactttattagagaatagaaagttatgcttttcagaaaaatagattgtattactgaacattcatagggagcattattatgagtagaagcagtgagaaatgctttcataaaggcagtgctttttaaaattttggcagttgtgaggaacaagtatctttgttttttgaattaaaggcaaactcagaactcagtgccaagagggtacacctgcagcaggcagatgctcacctgaaagaag

SEQ ID NO: 463332 - DNA, 715 bp, Homo sapiens
tctgctggggctccaggtcctccaggagtaaagggttcatcaggcttgccaggaagcccaggaattcaaggcccaaagaatggtaagattaatagtttttaatagaatttggctaataggtgaacaagggctacctggtcaacctggaattcaaggtaaaagaggtcaccgaggagcacaaggtgatcaaggaccatgtggagaccctggcctgaaagggcagcctggagaatatggtgttcaaggtttgacaggtttccaaggattcccaggccctaaaggtcctgaaggggatgctggcattgttgggatatcaggtcctaaaggtcctattggacacagaggaaacactggtccccttggcagagaaggtataataggcccaacaggtagaactaaatttggctatgaaataaaacataaaaatgagacaatgattggtcaagtgatgttgggaaagttttccaatattgataatagtataaacaagcaaggagcacagtagaaagggtcaaattgagacttagagaggaaagattcattctatctagggaattaatattttgaattatttgaaagttatttatagacacagacaattaaaaaatataaaaatagaatgcttcaagtgtttagtaccactattctctttgataaatttagagaagaaaccaccaaagttactggatatgtaaacaaaagaagtaaaatgtat

SEQ ID NO: 463333 - DNA, 740 bp, Homo sapiens
aagttaagcagctgatcatggcatgatggcttcatcaaccctgaatgaccaagaatgtctacggcgcctgctgctttggacctgcctgcagagttcaattttctccctgcctgtgcttcggcatgtgggttacaatacttcagcctcagcctcctcatccacaaacagggctaatattaccaatgacctacttcatagagatgtgatgagggctaaatcctatgagtttatgcctttaaagcacttattgaaaatgctcatcatctcaagatccaaggagctagaaattggctcctatgctcagtcacatggctggtggcatgccacagctcctcactggctgtttgctggaggcctctgctcctcacctcatgggcctctccatagaattgcttccaacagggaagctgtgtcccccagaccatggtcatcttgcccaggattttccatggtgacattatctgtggtcacaatgggtacatcccccaagaagggtggtcttccaggagtcactgaaaatttcaagaagtgaaaatccaacagaaaatatttgaacccaggaataaaatagaagcctggaagactgaaggatattgagaaatattaccacgcgtgctgatgcctcagacacaccaatctgcaacaagcaactaggataaaaaatagttaaaagtgaatcaacatttatctggaatatacagtcctgacccccttacgcactcccccccacccccctcccc

SEQ ID NO: 463334 - DNA, 1065 bp, Homo sapiens
tcccacccgggtgcttcagctcaaagactacttgctgcagccagttaatgaccccctggactgggatggcacagacatccactttagcaaagtggagtgcctacttggagcagcagagcacactgagtacaagtccccttgcagcagagttgcaagaggtcttgggacctgtggtcctaatgcaagataaggccacggggcctgaggcacccctagaccctgagccttcaccatctaaggaaaggtgtccccccattcccaatggtgcgtggtacacagatgggtctagccgaggtgctgctgctgcctggaccagaccactgttgcagtccaacctagtactgccaccctatgttttgaaactggcaacttggatggagccatctgtgttcccagcccacataaaaatatgcacaagaagggtgcaaatcagcaagtccacagcttccagaggccccagctgggatgtgccctccctttggggactaatgaaagtgtgactcaagagtctatcatactgagttcatgctcccagtatttaaaactgcatgaaaataatgcagaaaataatttgctagcgttgacttgctcccagaacttaaactgatcaagcaggacatctgaggaataatactttttagcagggattggcaaactttttctgtaaaaggccagagtgtaaatattggctccgccactctgactgtgttccccccatcaaatgtagggcactccaacagccctgatcccaagtgtgaagctgtggcctcagctggacatcctgtctggtcttggttagcggaaaggcaacagaatgaatgtccactccagagataatcaaagatgtgatgggggtatgcaacatgaaagaacagagcatcaatgtattgttcctgccggcgagacacttgaaacgttatttatgtagtaaaacaaacacacatctattattaactacaatgtataattcacatgaatttctcagataaaacataagacttcaaagaaagtcatgcctgaaatttgcagctacgagctttacctacagtcttctaaaagcactaa

SEQ ID NO: 463335 - DNA, 400 bp, Homo sapiens
cttaaataagatcctcattcctgatccttcccttctgctcttggtcccacgcatcacagcagggcactccaacagccctgatcccaagtgtgaagctgtggcctcagctggacatcctgtctggtcttggttagcggaaaggcaacagaatgaatgtccactccagagataatcaaagatgtgatgggggtatgcaacatgaaagaacagagcatcaatgtattgttcctgccggcgagacacttgaaacgttatttatgtagtaaaacaaacacacatctattattaactacaatgtataattcacatgaatttctcagataaaacataagacttcaaagaaagtcatgcctgaaatttgcagctacgagctttacctacagtcttctaaaagcactaa

SEQ ID NO: 463336 - DNA, 616 bp, Homo sapiens
gtaaagaggtatcttaactataaacgctattgtgtaagctagtcatattaagttgtgcgcccaggagtttgatatttctcggacagtgagagtgagtagtagaatgtttatcgaccccacaatttctctctttcattttgctacattctactactgttgtctttcgaatctggtctggtttaagagagaaattgtggctgggtaactcttccaaagccagttgtgtttcattggaaacattttaaaacaagatacagcggccaaactctaagtgtttatctgagggaagcattctcggcaagccaggtcctgtaataattccagaactccctcgtggttcgttttcattttgcgtgtcacttctgtcatctgcccccaactggaaccctgtcgttcacgcctcgcccctttgggtgatcttgtctgtacagctaatattgtgggattctgtggctcccccttctctttcgggatgatgtttgatttgtgtttccttaaggtgtgagtcccattccctttctttttctgggtagcaatattttaggtcatgcgtgttttcttccttcgacagtatgttatggtggcatcgatacaccgggtccgagctcgattcgta

SEQ ID NO: 463337 - DNA, 1389 bp, Homo sapiens
agaaaccactcttgtctgccacaggcttcactcgaggctaaattccaagacccccccaatggaggcctgaaccctatatatgttttttcctacatggttgtctgtcaatatctgtgggggattggttccatgacctcctatggatgccaaaaatccatggatgctcaagaatttcttcacatggctcctggagaagtgaccatcacagttcgcctcatccgttcctttgaacatcgcaatttcaaacctgtagtgtatcacggagtgaatttggaccaaactgtaaaggaatttatcgtatttctaaagcaagatgcactaaagattattcatcaagcacataaatcaaagacaaatgaacttgtgttgagtttggaagatgacgaaagactcctgctgaaagaagacagcactctgaaagcagctggaatcgaggaggaggatgagaatgatgtgcattccgatctcttggctgaggacagtaggtgtctgctctccaaatatgcagaatgcaaatggctgttttcagaaggtatgctcagaattctcctgagggtcattttaagtgacgggttggagaaattctctagttcatcctttggctttttatctgcactgcagatccccgtggaacattctacacctgacgtcagtggagtttttgcttgtggacccagtacgaaaatacgtacttcaaaaagatttgatcagtagaagcaagaagagacttttacctagaaatgttacttataattttttgtcagcaattgtagttttatgggctaattcccctaagtaataaatttacatgtaagcttttttttttaagtgttattttctctctttcattttgctacattctactactgttgtctttcgaatctggtctggtttaagagagaaattgtggctgggtaactcttccaaagccagttgtgtttcattggaaacattttaaaacaagatacagcggccaaactctaagtgtttatctgagggaagcattctcggcaagccaggtcctgtaataattccagaactccctcgtggttcgttttcattttgcgtgtcacttctgtcatctgcccccaactggaaccctgtcgttcacgcctcgcccctttgggtgatcttgtctgtacagctaatattgtgggattctgtggctcccccttctctttcgggatgatgtttgatttgtgtttccttaaggtgtgagtcccattccctttctttttctgggtagcaatattttaggtcatgcgtgttttcttccttcgacagtatgttatggtggccgttcttcactcttacatagaaacagtgataatctggttactcggtaatgtgggtgtcggacccaggaaactgggggattccagaagcagg

SEQ ID NO: 463338 - DNA, 3090 bp, Homo sapiens
cctacacacgtgcacagacacgtagctgctgttcaggaactgagctaatggttttaaagtctgttccttatctttgctggaggcaggcagtagctgtgcagtgacagtgtgcctatgcagacagagggagcagtgaatagcaatagggtgtttccaccatggtcttcactcaggccccggctgaaatcatgggccacctccggatacgcagcctcctggcccggcagtgcctggcagagtttctgggtgtgtttgtactcatgctcctcacccaaggagctgtggcccaggctgtcaccagtggagaaaccaaaggcaacttcttcaccatgtttctggctggctctctggccgttacgatagccatctacgtgggtggtaacgtctcaggggcccacctgaatccagccttctccctggccatgtgcatcgttggacgcctcccctgggtcaagctccccatttacatcttggtgcagttgctgtctgctttctgtgcttcgggagccacctatgttctctaccatgatgccctacagaactatacaggtgggaacctgacagtgactggccccaaggagacagcctccatttttgccacctatcctgccccctatctgtccctgaacaatggcttcctggatcaggttctgggcaccgggatgctgattgtggggctcttggccatcctggacagacggaacaagggagtccctgcgggtctggagcctgtggtggtggggatgctgatcctggccctcgggttatccatgggtgccaactgcgggattccactcaaccctgcccgggacctgggcccacgtctcttcacctacgtggctggctggggtcctgaagtcttcaggtgggagacagactctcctggtgctggcctccactcaccttcctctgctaagggctctgtccctgggtccacagcactctgcctttaaaatagctctcttggcttcttaggacagtgttctttctccaagtcatattctccccctttctcccttgcttccctcccaacttttcactgaaacagtaagatttagaggttgtgttcttaggcatgccacattacttccatgcacattagtgacttcatcagcaaaattaatatattcagataattccctaaggcaagaggctggaccaagctctcctggggttccctcttctaaatactatgctttggtgacaaggcaatcctcttcctggtgtctaccaccctgggaacaactttagggcactctcttgttactgccccccgtccttggagaggggaaggctaagggagtcactcctgataccttcccactgtccttcttttgcagtgctggtaatggctggtggtgggtgcctgtggtggcccctctggtgggggccaccgttggcacagccacttaccagctgttggtggctctgcaccaccctgagggcccagagccagctcaggatctggtgtctgctcaacacaaagcctcagagttggaaactcctgcctcagctcagatgctggagtgtaagctatgattaggacaaccctcacttcactcatggaccctggagccagccactgaccccgcctgggaacaacagtcattcttcctctttgttaatgtgccagaacctgggaggcttctctgtttatctgtttggcatcccttcctcctaaactaagaaggatcctggacagggagaagtggaggaggataaggtaccaggactcaggcttctcatcccctcctcccgcaaagcggttttctgaccctcagggcctctcggaatgtagttgctcgagcccagccacgccgaggctcggaagggctaagaccctcccactgccccgcacaaagatggctgctccctcctccccgctccttctcccctccccaaaaccccctcccgccccccggcccccgccgccggctccgtcacttccgccccgccgtggccgaaactgacacaaagtagcgggccgaggccccgggggagcggggccgcagctgggggggcgggagcccgtggggagccgagccgagcgccccccgccccagcccccggcatgggcagtacggggccgccggggcgggcgccgagcgctgagcgctgagggtctcccatgggattgctgggatcttgctgggtgagatggcagtgtgtgcaaaaaagcgccccccagcggttgcccccgacaacgccggcagtccgctcacccgcattggcccggcccgggggtgggaggggaggcggggctcgcgcgcgagctttcgcctacgcggcgcgctggcaggctgcggctcctgcagtcggggagcgggcgggggcggaaccctgggcgtgctcggcgtgtccggggccactcagcgcacgctggcatccgccggggggaatggggggcggcggcggcggcgcagctgagctcgcggtgtccccgagcgccggcggccgggaggatggcctgggctgcgggtggggcgcgcgcccgacggctggggctcccctctgagcggctgcggctcctgcacctccccggggagccgccccgtcgatgccactaaggccaaggacatatagacggtctgccctcccccactcaaaccgggatcatgacggtccccaaggagatgcccgagaagtgggcccgggcccaggcgcctccctcttggagccgaaagaagccctcttgggggacagaagaagaaaggagggcgcgggctaatgaccgagaatacaatgagaaattccagtatgcgagtaactgcatcaagacctccaagtacaatattctcaccttcctgcctgtcaacctctttgagcagttccaggaagttgccaacacttacttcctgttcctcctcattctgcagttgatcccccagatctcttccctgtcctggttcaccaccattgtgcctttggttcttgtcctcaccatcacagctgttaaagatgccactgatgactatttccgccacaagagcgataaccaggtgaataaccgccagtctcaggtgctgatcaatggaatgtgagtgcctgttggagacaagagctctggggacgaagggggtcccttaggaa

SEQ ID NO: 463339 - DNA, 1229 bp, Homo sapiens
gcaaattcagagcagagccacagcgaagcctggaggtagaggaatgccccccggccagcagtggttcagggccgtgcttaggagcaccaaacctgagcctgggcgctgcatgctccgagggccaatcccagcacacactgttcccccactgtctgaggcccagcacctgttgtctagaatcagctcagaaggaaggctgcactgtcccaggggcacccagcctccaaatgagcctcaaggaagggtctggaaggccagacaatactatggtcagattatggacttgggaattgctgcagatgccattggggaaagaaaatggaacaacagaggtcccatccttccaaatgtcatccactggtcttatccttatggaaatagacagtacacggatctggaatggaagcaaataataaccgggtctccagattccatcgtatcacagaacatagaaccaagaaagtaccttagaagtcatctgatccagtcacccctgttttaccaatgaggaatctagacccagaagaagttaaaggacttacccaagagtacccaacaactctctcaccaccccaggctcccatctttgtgtctctcctgtgtgagctgttccctgaagttcttcctgaacttgcacattgcctttccctttgattttaaatccttggctcaaatgacatgcccggactatatcgtgtgatatgagcttgaaaagtaatttacgtacaagtcttgaaagcaaatcaagttttaaaacaaagtagcatctactctgccccagccttgacatcttattacatagcaaatgctggctctttaatttccctaatcaagactggtcctatttagcccacctcctcaaggggtcccagcactagccccactccgacgcctgatgaagttccagaacagtggaatcaagcacagagatgggcacgcctctttacagaaccaaagattcagaactgtgccttaccctttgcttatgaggcggaggaggaggaagagaaagaaccaccgcaaagagagatggcaacaaaggtaaaatgaaggccgggccagccgatcccactcaggctgaccacagtgagggagcagcattaaaatgagaaaggatcaggtctcgaagcccagcccttcccgctgaatctcgtcctttgcttcatccattccattaaataagtcatattgaaaataaattattattaatacaacagtagctaacatta

SEQ ID NO: 463340 - DNA, 459 bp, Homo sapiens
gtgtaaacaagcggaacgtctttgcgctctataaaaacaaggttaaattacttgcagatccgggcaacgtggagagatgtaggaagtgaacctgaagcctgacacactcaaggtctcggaaccgaaaataataggaattgttcttatttttccagtggaatcaagcacagagatgggcacgcctctttacagaaccaaagattcagaactgtgccttaccctttgcttatgaggcggaggaggaggaagagaaagaaccaccgcaaagagagatggcaacaaaggtaaaatgaaggccgggccagccgatcccactcaggctgaccacagtgagggagcagcattaaaatgagaaaggatcaggtctcgaagcccagcccttcccgctgaatctcgtcctttgcttcatccattccattaaataagtcatattgaaaataaattattattaatacaaca

SEQ ID NO: 463341 - DNA, 594 bp, Homo sapiens
gaaccatatcagttgttgagacccacaatggggaaaggacctactgaaggtcacacaggaccgatcatattggacccagagccacctcagagacctcaaggaactgcagtctttccatggtggaaccagcattctgtgcagagggcagataagaagatggcagagcaggagaggagtggagaaagaggggctccagaatccatgagtgctgtggtactgctgaagcagcgggagctggtggtgcagttcagtctcagctggaggtgtgcagtatgtgagtgctctgagtacaatgacgttccagtgctctctgttcagggacatgggagccattttgctgggcacatagatctgaaggttggattggggtttcctttgtgcatcacggttgcaaatgcagcagtcgatatcacgcacacaatatttttgaatgggttgatggaggttgcacgttgagtgccctcagcccttttcagtggaggagagtggagagggactcagtggcagtaaaggcaaggccaccgtaggggaagaaacacaaagtacttgcaccgtcgttttacaagaaaatgacacatgctctaaattgtacat

SEQ ID NO: 463342 - DNA, 7405 bp, Homo sapiens
  misc_feature (5464)..(5464): n is a, c, g, or t
  misc_feature (6517)..(6517): n is a, c, g, or t
ggtgaaggattcacacgtttattatgttttttttttcaatgggagcctccgaacgctgctgtttctagtccatcaatgaattcctttactcttccctcaaaaaataagagggaagcccctgtggtggccagagcagccttgttcctggaatgtgctcgttttgttcaccgctgcaaccgtggcaactggccagagtggatgaaagggcaccacgtgaacatcaccaagaaaggactttcccggggacgctctcccattgtgggcaacaagcgaaaccagaagctgcagtggaatgcagccaagctcttctaccaatggggagacgcaattggcgtccgattgaatgagctgtgccacggggaaagtgagagcccagccaacctgctgggtctcatttacgatgaagagaccaagaggagacttagaaaggaggatgaggaggaagactttttagatgacagtaaggagactccctttactacaagaacccctgcttgtactgtgaacccctctaaatgcggttgcccctttgccttgaagatggcagcatgtcagcttcttctggagattaccaccttcctgcgagagaccttttcttgcctgcccagacctcgcactgagcctctggtggacttggagagctgcagacttcgtttggatcccgagttggaccggcacagatatgagaggaagatcagctttgctggggtcctggacgaaaatgaagactcaaaagattctctccacagcagcagccacactctcaaatcagatgcaggagtcgaggagaagaaagttcccagcaggaagatcaggataggaggttctcgcctgctccagattaaaggaacccgcagtttccaggtgaagaaggggggttccttgtccagcattcgccgggtcggcagcttaaagagcagcaagttatcacggcaggactcagagtctgaggctgaggagctgcagctgtcccagagcagggacactgtcactgacctagaagggagtccttggagtgcaagcgagcccagcattgagccagagggaatgagtaatgccggcgcggaggagaattaccacagaaacatgtcgtggcttcatgtgatgatcttgctgtgcaatcagcagagtttcatctgcactcacgttgactactgccatccccactgctacctgcaccacagccgctcctgtgcccgactggtcagagccatcaagctactctatggagacagtgtggactccctgagggaaagcagcaacatcagcagtgtggctctccggggcaagaaacagaaagaatgctcagataagtcatgcctgaggacaccttctctaaagaagagagtttcagatgccaatctggaaggaaaaaaagattccggaatgctgaagtacatcagacttcaggtgatgagcttgtcgcctgctcccttatctctgttaatcaaggcagcaccaattctgacagaggagatgtacggagacatccagccagctgcctgggagctcctgctcagcatggatgagcacatggcaggggcagcagctgccatgttcctgctgtgtgcagtgaaggtgcctgaggccgtgtccgacatgctgatgtcagagttccaccacccggagactgtgcagaggctgaacgctgtcctcaagttccacacgctctggaggtttcgctatcaggtctggccccggatggaggaaggggcacagcagatttttaagattccgcctcccagtatcaatttcacccttccctcgccggtgcttggaatgccatccgtcccaatgtttgacccaccgtgggttcctcagtgcagcgggagtgtccaggaccccattaatgaagaccagtctgtgagtaacagacacttccaggttccatggtaaatccttttcagcccgggctgtgtcccgctcccatcaaagggcagaacacatcttaaagaacttgcagcaggaggaagaaaagaaacgacttggtagagaagccagcctcatcactgccatccccatcacccaggaggcttgctatgagcccacatgcacgcccaactcagaaccggaagaagaagaagaagtcaccaatctggcatcccgtcgactgtctgtgagtccatcctgcacctccagcacttcccacaggaattattccttccgccgcgggtcagtctggtcagtgcgttcagccgtcagtgctgaagatgaggaacataccactgaacacacgccgaaccaccatgtgcctcagcccccacaagcagtgttcccagcatgcatctgtgcagcagtacttcccattgttcatctgatggaggatggtgaggtgcgggaagatggagtagcagtgagtgctgtggctcaacaagtcttatggaactgtctaattgaagatccatcaacggttcttcgacattttctggaaaaactgaccatcagcaatagacaagatgagttaatgtacatgctgcgcaaacttctcttgaatattggagactttcctgctcagacatctcacatcctattcaactatttggtaggattaatcatgtactttgtgcggaccccctgcgagtgggggatggatgccatttcagccaccctgacattcctgtgggaggtggtgggttacgtggagggcctcttcttcaaggatctcaagcagacgatgaagaaggagcagtgtgaggtgaagctcctggtgaccgcttcaatgccaggtactaaaaccttggtagttcatggacagaatgagtgcgatatcccaacccagttaccagtccatgaagacactcaatttgaagccctgttgaaggagtgtctggagttttttaatatcccagaatcccagtcaacacattattttcttatggataaacgatggaaccttatccactacaataagacctatgttcgagatatttatcctttccggaggtcagtatctccccagctgaatcttgtacatatgcatccagagaagggacaggagctcattcagaaacaggtgttcacccgaaagctggaagaagtagggcgggtgttgtttctcatctccctaacccagaagatccccacagcccacaaacagtcccacgtctccatgcttcaggaagacctcctccgcctgccctcattccctcgtagtgctattgatgctgagttttcactcttcagtgatcctcaagctggaaaggaactgtttggcctcgacactcttcagaaaagcttgtggatccagctgctggaggaaatgttcctgggcatgccgagcgagtttccatggggagacgaaatcatgcttttcctcaacgtttttaacggggctctgatcctccacccggaagacagtgccctgctcaggcagtatgctgccaccgtcatcaacaccgcggtgcacttcaaccacctcttctctctcagcggctaccagtggattctccccaccatgctgcaggtgtactccgactatgaaagcaatccccagctgcgtcaagccatcgaatttgcctgtcaccagttctatattctacaccggaagccctttgtgctccagctgtttgctagtgtggcccctctcctggaatttcctgatgctgccaataatgggcccagcaaaggtgtgtcagctcagtgcctgtttgacttgctgcagtccctagagggagagaccaccgacatattagacatcttagagctggtcaaagctgagaagcctctcaagtcattagatttctgctatggaaacgaagatctgacattttctatcagtgaagccattaagctctgtgtcactgtggtggcgtatgctcccgaatcattcagaagtcttcagatgctgatggtcttagaagccttagttccatgttacctacaaaagctaaagaggcagacatcacaggtggagacagtacctgctgcccgagaggagattgcggccactgctgctcttgcgacgtccctacaggcccttttgtacagtgtagaggtcctcaccaggcccatgacagccccacagatgagcaggtgtgaccaaggtcataagggaaccaccacagccaatcacaccatgtcgtctggggtgaacaccaggtaccaggaacaaggagccaaactgcactttatcagggaaaaccttcatttactggaggaagggcaaggcattcccagagaggaactggatgaacgaattgctcgggaagagttcagaagaccccgggagtccttactgaatatttgcactgagttctataagcactgtgggccacggctgaagatcttgcaaaatctggctggggagcctcgggtcattgccttggaactgctggatgtgaagtctcacatgaggttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggcgacaggttgagtgggagcctgccagcaatttgattgaaggggtttgtttgacacttcagaggcagccaatcatatccttcctgcctcaccttaggtcactgatcaatgtctgtgtcaatctggtgatgggagtggtaggaccttccagtgttgctgatggattaccccttcttcatctcagcccttatctctcaccacctctgcccttcagcacagctgttgtccggcttgtagcattgcagatacaggctttaaaagaagattttcctttaagccatgtgatctccccattcaccaatcaagagcgaagggaggggatgcttttaaatctgctcatcccatttgtgctcacagtaggatctggaagcaaagatagcccatggctggagcagcctgaggtgcagctgctgctgcagacagtcatcaatgtactcctcccaccgcggatcatcagcacatccaggagcaagaacttcatgttagagagctccccagcccactgctccacccctggggatgcggggaaagacttgcgcagggaagggctggctgagtccaccagccaagcagcatacttggcgctgaaggtgattctcgtctgctttgagaggcagctcggaagccagtggtactggctgagcctccaggtgaaggagatggctctgcggaaggtgggaggcctggccctttgggatttcctcgacttcatcgtgcggacccgaatacccatctttgtgcttttgcgccctttcatccagtgcaagctgctggcccaaccagcagagaatcatgaagagctttccgcccggcaacatattgccgaccagctggagcggcgcttcataccacgccctttgtgtaagagctcgctcattgctgagttcaacagtgaactaaaaattctaaangaggcagttcatagtggatcagcctaccaaggcaagacatccatcagtaccgtgggcacctccacctctgcttaccgcctgagcttggccaccatgtcccgctctaacacgggcacgggcactgtctgggagcaggacagtgagccatcccagcaggcttcgcaggacaccctgagtcggactgatgaggaagatgaggaaaatgactctataagcatgcccagcgtggtaagtgaacaagaagcttacctcctgagtgccattggaaggaggcgattctccagccatgtctccagcatgtctgtacctcaggctgaggtgggcatgctacccagccagaggtaaacagctatggttatactgtactctgcatttgggggcaaagttagaaattctgaaaatacactcctgttattctacaaagacagaaagagaagcaagcaatggtaatgtttttagatagatcattccacaaaggatttgtcaactaggttcctgcaggcaacactttgcagttttctaagccaagctagtagaagggatcccaatttccaagtattgtctctccttaaaaattttccatagacacatggtcttctttctgttgtcaaatggcattcttgtatttcagatttatcattagctaagctaatgatgggtacttggcaagagttaggaccatctttatgtttttggtaaagtttaggcttctgatatattattagtattcagttgtaggtagtgacacttaaccaagcagaaaaggatctatgccactgagtgtgaccttgggcaggtcatttaaccgtaatccacagttctccctctgtaaaatgaagaggtttgctaaaatgatctttaagataacttctcatctatagttctatgattccatgacaaaacccctttaaatattttgtgtgttctctgtctcttaagaatataagtaaaaaaaaacttcccatgtatatatatatatacacacacacacacacaatgaaagtataatgaaaatgatctcacatgagtcaaaacatttatcttaagtagatnaatgttttggaaccaatgatattttcactttaggaattgagtttttcaaggaattgaccttatgtgattttagtgtgttgcttatttttaatacctatagattcattgtagtacaattcagacatggaaaataataaaattcagggcatattctgatgttcacataaaaccagtttatatgtaggaataattaccctgtacccaaatcctttcgcaaatggttcgtgaactacacagatgaaataaaatttgtgaaataaagcccaagtttggagaatatcaaagaatagggtaaaatgataaatcattaataaacaagttgcatactttttaagaaggcaatgttttatataagtaccatttaattattacgaagattaatactatataaaggtttgtatcattgtaagaaattgttttacctaccatttggtaattttcctttgaaaagaaagtcttatacacaaaaagtgtgaacaaaatcaaagccaaacaataacatgtcctaaaaaagatataaagccacacaagcagctaatattggtagctatcagttatttttaattgctagcaatgtgcatggttctatgaagaatatttttaaaaatcaattatttgaaagttttatttaaattatagaattgtagaaatttcataaagaggtttttcattgttatttacctaaaataaccaggccatcaatttcctttttacatattcattaaggggtcaagttgtttgcagggagaaaatttgtcctattatacatatcttgattgtacattttcttgatttctagaaatcaagaaaaaataatatagttaaatagtttgggcttcattcatattttggaagactagcgaaggtaataatactgtctctgtacat

SEQ ID NO: 463343 - DNA, 5780 bp, Homo sapiens
ggtgaaggattcacacgtttattatgttttttttttcaatgggagcctccgaacgctgctgtttctagtccatcaatgaattcctttactcttccctcaaaaaataagagggaagcccctgtggtggccagagcagccttgttcctggaatgtgctcgttttgttcaccgctgcaaccgtggcaactggccagagtggatgaaagggcaccacgtgaacatcaccaagaaaggactttcccggggacgctctcccattgtgggcaacaagcgaaaccagaagctgcagtggaatgcagccaagctcttctaccaatggggagacgcaattggcgtccgattgaatgagctgtgccacggggaaagtgagagcccagccaacctgctgggtctcatttacgatgaagagaccaagaggagacttagaaaggaggatgaggaggaagactttttagatgacagtaaggagactccctttactacaagaacccctgcttgtactgtgaacccctctaaatgcggttgcccctttgccttgaagatggcagcatgtcagcttcttctggagattaccaccttcctgcgagagaccttttcttgcctgcccagacctcgcactgagcctctggtggacttggagagctgcagacttcgtttggatcccgagttggaccggcacagatatgagaggaagatcagctttgctggggtcctggacgaaaatgaagactcaaaagattctctccacagcagcagccacactctcaaatcagatgcaggagtcgaggagaagaaagttcccagcaggaagatcaggataggaggttctcgcctgctccagattaaaggaacccgcagtttccaggtgaagaaggggggttccttgtccagcattcgccgggtcggcagcttaaagagcagcaagttatcacggcaggactcagagtctgaggctgaggagctgcagctgtcccagagcagggacactgtcactgacctagaagggagtccttggagtgcaagcgagcccagcattgagccagagggaatgagtaatgccggcgcggaggagaattaccacagaaacatgtcgtggcttcatgtgatgatcttgctgtgcaatcagcagagtttcatctgcactcacgttgactactgccatccccactgctacctgcaccacagccgctcctgtgcccgactggtcagagccatcaagctactctatggagacagtgtggactccctgagggaaagcagcaacatcagcagtgtggctctccggggcaagaaacagaaagaatgctcagataagtcatgcctgaggacaccttctctaaagaagagagtttcagatgccaatctggaaggaaaaaaagattccggaatgctgaagtacatcagacttcaggtgatgagcttgtcgcctgctcccttatctctgttaatcaaggcagcaccaattctgacagaggagatgtacggagacatccagccagctgcctgggagctcctgctcagcatggatgagcacatggcaggggcagcagctgccatgttcctgctgtgtgcagtgaaggtgcctgaggccgtgtccgacatgctgatgtcagagttccaccacccggagactgtgcagaggctgaacgctgtcctcaagttccacacgctctggaggtttcgctatcaggtctggccccggatggaggaaggggcacagcagatttttaagattccgcctcccagtatcaatttcacccttccctcgccggtgcttggaatgccatccgtcccaatgtttgacccaccgtgggttcctcagtgcagcgggagtgtccaggaccccattaatgaagaccagtctaaatccttttcagcccgggctgtgtcccgctcccatcaaagggcagaacacatcttaaagaacttgcagcaggaggaagaaaagaaacgacttggtagagaagccagcctcatcactgccatccccatcacccaggaggcttgctatgagcccacatgcacgcccaactcagaaccggaagaagaagaagaagtcaccaatctggcatcccgtcgactgtctgtgagtccatcctgcacctccagcacttcccacaggaattattccttccgccgcgggtcagtctggtcagtgcgttcagccgtcagtgctgaagatgaggaacataccactgaacacacgccgaaccaccatgtgcctcagcccccacaagcagtgttcccagcatgcatctgtgcagcagtacttcccattgttcatctgatggaggatggtgaggtgcgggaagatggagtagcagtgagtgctgtggctcaacaagtcttatggaactgtctaattgaagatccatcaacggttcttcgacattttctggaaaaactgaccatcagcaatagacaagatgagttaatgtacatgctgcgcaaacttctcttgaatattggagactttcctgctcagacatctcacatcctattcaactatttggtaggattaatcatgtactttgtgcggaccccctgcgagtgggggatggatgccatttcagccaccctgacattcctgtgggaggtggtgggttacgtggagggcctcttcttcaaggatctcaagcagacgatgaagaaggagcagtgtgaggtgaagctcctggtgaccgcttcaatgccaggtactaaaaccttggtagttcatggacagaatgagtgcgatatcccaacccagttaccagtccatgaagacactcaatttgaagccctgttgaaggagtgtctggagttttttaatatcccagaatcccagtcaacacattattttcttatggataaacgatggaaccttatccactacaataagacctatgttcgagatatttatcctttccggaggtcagtatctccccagctgaatcttgtacatatgcatccagagaagggacaggagctcattcagaaacaggtgttcacccgaaagctggaagaagtagggcgggtgttgtttctcatctccctaacccagaagatccccacagcccacaaacagtcccacgtctccatgcttcaggaagacctcctccgcctgccctcattccctcgtagtgctattgatgctgagttttcactcttcagtgatcctcaagctggaaaggaactgtttggcctcgacactcttcagaaaagcttgtggatccagctgctggaggaaatgttcctgggcatgccgagcgagtttccatggggagacgaaatcatgcttttcctcaacgtttttaacggggctctgatcctccacccggaagacagtgccctgctcaggcagtatgctgccaccgtcatcaacaccgcggtgcacttcaaccacctcttctctctcagcggctaccagtggattctccccaccatgctgcaggtgtactccgactatgaaagcaatccccagctgcgtcaagccatcgaatttgcctgtcaccagttctatattctacaccggaagccctttgtgctccagctgtttgctagtgtggcccctctcctggaatttcctgatgctgccaataatgggcccagcaaaggtgtgtcagctcagtgcctgtttgacttgctgcagtccctagagggagagaccaccgacatattagacatcttagagctggtcaaagctgagaagcctctcaagtcattagatttctgctatggaaacgaagatctgacattttctatcagtgaagccattaagctctgtgtcactgtggtggcgtatgctcccgaatcattcagaagtcttcagatgctgatggtcttagaagccttagttccatgttacctacaaaagctaaagaggcagacatcacaggtggagacagtacctgctgcccgagaggagattgcggccactgctgctcttgcgacgtccctacaggcccttttgtacagtgtagaggtcctcaccaggcccatgacagccccacagatgagcaggtgtgaccaaggtcataagggaaccaccacagccaatcacaccatgtcgtctggggtgaacaccaggtaccaggaacaaggagccaaactgcactttatcagggaaaaccttcatttactggaggaagggcaaggcattcccagagaggaactggatgaacgaattgctcgggaagagttcagaagaccccgggagtccttactgaatatttgcactgagttctataagcactgtgggccacggctgaagatcttgcaaaatctggctggggagcctcgggtcattgccttggaactgctggatgtgaagtctcacatgaggttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggtgagaatgcctccgagttagctgttgctatcacaaatgtcaaagttaagatttgtcattttttaagatggtggatcattctggagttgaatggatgacttgaaagttttctttggtatatgtgcatagttaatagggtctatgaatgcctaagtagcaaagcctacattttgagaaaaataacattttctttaaaagtatatgtgctcatcttgaaaaaaatctatccatttcttagctatcatgctcctcatctgacacatataaaaatttcaattagtaccctttaatcccttttaaaataagggagggttggccttataaatgaaacaactaatgagaaaagaaaaggaattttatgttcaaaatactatatttaacatagctagttaacatatttaggaattgagtttttcaaggaattgaccttatgtgattttagtgtgttgcttatttttaatacctatagattcattgtagtacaattcagacatggaaaataataaaattcagggcatattctgatgttcacataaaaccagtttatatgtaggaataattaccctgtacccaaatcctttcgcaaatggttcgtgaactacacagatgaaataaaatttgtgaaataaagcccaagtttggagaatatcaaagaatagggtaaaatgataaatcattaataaacaagttgcatactttttaagaaggcaatgttttatataagtaccatttaattattacgaagattaatactatataaaggtttgtatcattgtaagaaattgttttacctaccatttggtaattttcctttgaaaagaaagtcttatacacaaaaagtgtgaacaaaatcaaagccaaacaataacatgtcctaaaaaagatataaagccacacaagcagctaatattggtagctatcagttatttttaattgctagcaatgtgcatggttctatgaagaatatttttaaaaatcaattatttgaaagttttatttaaattatagaattgtagaaatttcataaagaggtttttcattgttatttacctaaaataaccaggccatcaatttcctttttacatattcattaaggggtcaagttgtttgcagggagaaaatttgtcctattatacatatcttgattgtacattttcttgatttctagaaatcaagaaaaaataatatagttaaatagtttgggcttcattcatattttggaagactagcgaaggtaataatactgtctctgtacat

SEQ ID NO: 463344 - DNA, 864 bp, Homo sapiens
tgggaagacagggatgtggatgaatggaatggaggtgcactgtgcctggtgctgtagggaggagagacctgggcctgaaacaccagattaaaggatttgggttggatcccaaggcacagtgtctgtgtgaatccttagagccaggtctcactgcctgccatagccagcaaggggctggcctggctggggcagagacacagggacagcaagaaatgaagtgggagggctcagggcctgcagcatgtactgcagctcccatgccagctgcagaggactgggcccacctagaggccctgggggaatctgggggcccctctattttccttcagaggagaggagaaattcttggaggttatgagaacattaatggtggtgaaatcctaactttgccacttactagccatgtgaacttgggcaagtgacctaatcctctgcatttcatctctaaattggggagaatagaagcatctacttcatgtagtagccaggattagaagagggaggaataactgggccctggatagaatgtgatgaatgtatattcttaatgagaagtggaaataatttgtggttgagagctgtgcctcagatcagagtgacaggatacatggctaggctatattttccagcagattaagagctgcggcccaagactctgaaatatgaagaaaaaaggagaagatgacagcatatctttttaaagaaatattttccagccaaatggtgcagcagaggacttccaggaatttgttcttgttctgtatcaaaggtgaagagttcgtagccttcaaggaaacaagaaaccatgggatggagtgaaggaaggtggcctggaaccagctgctgagcctctctgagccccag

SEQ ID NO: 463345 - DNA, 1612 bp, Homo sapiens
tgggaagacagggatgtggatgaatggaatggaggtgcactgtgcctggtgctgtagggaggagagacctgggcctgaaacaccagattaaaggatttgggttggatcccaaggcacagtgtctgtgtgaatccttagagccaggtctcactgcctgccatagccagcaaggggctggcctggctggggcagagacacagggacagcaagaaatgaagtgggagggctcagggcctgcagcatgtactgcagctcccatgccagctgcagaggactgggcccacctagaggccctgggggaatctgggggcccctctattttccttcagaggagaggagaaattcttggaggttatgagaacattaatggtggtgaaatcctaactttgccacttactagccatgtgaacttgggcaagtgacctaatcctctgcatttcatctctaaattggggagaatagaagcatctacttcatgtagtagccaggattagaagagatggggccacttgagggaaaagacctacccaagggcacataatctgtacatgagagagagccagatgtaacagactgagtactggacttggggttaaacagactgtgaatctttccaccccattggcaagttaccttggacaagttactttaatctccctgagcctcaatctgctcatctttaaaatggaagtcttaataatctcctcataggggattaaacaagaacatgagcacaccttttctaacacagtgtctgagatgagtagatgttcaaaataggggttcatttgcttctttgctctttggctcccacctttttttcaactgccccaaatctctttctgctcaccttttcttgttccatggggtctttacaccaccgtgttagcatgtgtttctgctacatggttacttcttttctagaagcaagtgagtgagggagggcccagtgggcagctcagaactcagtaataaaaccacacagaatccatctcaaacaaaacggcagattggcaagagtgacctgcatgtagtttttgatttcatttacagtatgcaaggactgtgggaggacaactggaggggagtcaggaaatgggggttcaagtccatggagtggctatgtgatgctgggctggccccttttcctctctgggcctcagtttccccatgtgacaataaggggtcaggccagggaatattctgacactctgaatttttaattttattctaattatatgtttcagggaggaataactgggccctggatagaatgtgatgaatgtatattcttaatgagaagtggaaataatttgtggttgagagctgtgcctcagatcagagtgacaggatacatggctaggctatattttccagcagattaagagctgcggcccaagactctgaaatatgaagaaaaaaggagaagatgacagcatatctttttaaagaaatattttccagccaaatggtgcagcagaggacttccaggaatttgttcttgttctgtatcaaaggtgaagagttcgtagccttcaaggaaacaagaaaccatgggatggagtgaaggaaggtggcctggaaccagctgctgagcctctctgagccccag

SEQ ID NO: 463346 - DNA, 2075 bp, Homo sapiens
ctctagaatttttcttaaacaacagaatctccgacagcttgtttaccgggcaggccataagtgcaggggagttaacttccctaaggacaaccctcaattaaaggctggatggtgatgagcagatttcatctttctgccaagaacagattgaccctgagcccaggaattgctgccaaagtcggcctttggtgcagctgtaagtcggatggaatccaccttcctgacgtcagacccacccactggaacactgctcctctgactggggcttccctgaatggaaactacatgtcatactgcaaagaggacacactggaccctggtgtgagctgcactggcagaaatgtcactgtaagatcccaaggtattattataaattgtcaatatggcagaattaaaggcagccctcctcaagaataccactgcaacactgagcccacccttatcccattctactgtacaccaccagagaacatcactccgaatccagtgtcttttaccagagacaatctgattcctatagattgggatatttctatttttaattctccttaacagagaactctaagtccagaatcttctgcaaaggcctgtgaagtgctattctgatcatcccttcatgttcctgagttgctctgggataatgttgtcgggggaagacccccaggggaacagctgattggattctggcaagatggaccaaacatctgcttcaaacaaaagacatctgcatatttcacatttatttttcataatttacagaagcaacctgccaaaattcagcaagggagaatacactagcacataattagcttaaagtttgcttgctttagaagtatgagcatgaagcccaggagctcacctgggaggacatcaaggaatggcggaactgaggtttgatttctgtgaattttgttttagacctcatatgccagggcagaagacctggccctgctaggcttggaagggagaagcaaatatgccagagatgacacgaggaggttctttcgccctcgtgtcaaataaaaagcctccacaccaaaagagtggtcaaagataatatcatttattaaataagatctgattaatcagaaagattttgcttcaaccacttagcactacagttcacaggttagaaaatgatgcaatgctacatggcgcttaatttaaaatgtatataccgagagtaccaatggcatggtgagaaattatgtgtgggtgtttcattattgttcaaatcatcagaaagctgttatttgtcaaaaaaatactaggaaatatattggttgcctagatgctagtatatttggaatacatgatgaaaacataaagagaacaagataatggactatattatcagtcttaatatatcctgctatcatgaatacaactattttccccctataaactacatcatcccagttgaaattcaaacttggcaaggtcataattacatgaaataactaaagcttgcttagagaataaaaagatttggggggggggaggtaaggaacccagtgagaaagacagagagaagtatggacaagaaacagatcctaaacctgttttgttttatttttggtagtagttgtttatttttgaaaacattcaaaccacctgtattggtggctgttattatgaaataaataaactgagaaacaacaagacaatttggcctctacaatttgtttagttttgactaagtatttgccttggaagaagtatgtgtacaatactcatttttaaaagatgcaacagtcacctcgttacttggagttttacttgagacttgaatggactgaaaccacctggtcaccactagaagctacatcaaggaaaagaaaggcaacatattgaatctcttgggagaaactcatcctgtatctgctcgattgaaaacatgaaggtgcacattccaagctgcatatgctcaggtccgagtttccaaggaaacaagggactgctcatctatctgcaaaactgaactgacgagtcactttcagcttgttacaaaccttgattctgaatcaaattctagtgtgcagtctaaaaattctcactgccttgtcatttctgcc

SEQ ID NO: 463347 - DNA, 981 bp, Homo sapiens
  misc_feature (1)..(2): n is a, c, g, or t
  misc_feature (6)..(6): n is a, c, g, or t
  misc_feature (8)..(9): n is a, c, g, or t
  misc_feature (11)..(11): n is a, c, g, or t
  misc_feature (13)..(13): n is a, c, g, or t
nntttntnntncnagaaatggggttttgccatgttgcccaggctgttaaattctttaaaagggaaaactattaacactttgcctatttgtgttataataccttattacaggggtcgccaacccctggggccacagactggtactactccatggcttgttaggaaccaggccacccagcagcagactcaaacctttgtctgcgaggcaatcttcagagtggcagtcaacctttgcacctcatcttgtgccttgtcttcttcctcttttacagctctcagttgctggcgcaaattcataacttcgagatgcaacagcttcaggtccttagaatgctcttcctgtattgcattcagtcgatctttcagaaaagctaccagaccgcacaggaggggcatcaagcagcagaaagaaggttcacaggtagaaagaacttgccttgagtctcagatgagactttggaattgagacttgggacttctgaattaacgctggaataagcctttagtgtactattgagaagtgataattatattttgcagtgcgagaagaacaagatttggggtccaagggtggaatgatatagtttggatgtttgtcccctccaaatttcatgttgaaatgtgatctccattgttggaggtaaggcctggtgggagctgttaggtcataggggcagatccctcatgaacggcttggtgccctccccatggtaatgagtgagttctcactctgttagttcacactggttgtttaaaggggcctggtacctcctcctctctcttgctccctctctcaccatgtgactcacctactccccctttgccttccaccatgattgtaagcgtcctgaggcctcaacagaagtcgagtagttgctggcaccatgtttttacagcctgcagaactatgaaccaaatatatctcttttctttataaattacccagtctcaagtattcctttatagcaatgcacaatggact

SEQ ID NO: 463348 - DNA, 2519 bp, Homo sapiens
  misc_feature (2506)..(2506): n is a, c, g, or t
ggcttctatgagagcagggggttctgtgtcccgctctgtgcccaggagtgtgtccatggccgttgtgtggcacccaatcagtgccaatgtgtgccaggctggcggggcgacgactgttccagtgagtgtgccccaggaatgtgggggccacagtgtgacaagccctgcagctgcggcaacaacagctcgtgtgatcccaagagtgggtgccatggggcaccctgcgatccccagactggagcctgcttctgccccgcagagagaactgggcccaggtatgtaatggggggaacgacactttaacaagatcgcagacacaaggccacacagatctatgtggggaaatgaggtgactcagacagggccccaagtgtggggatgatgtggaggccaagatcctggtcccagtggatcctattcctcacgagtggagtgaccttgagcaaatcattgactcgttgtgggcttgtttcctgtctgtaaaacgggaatagtattgtctacatggcagggtggctgtgaagataacatgagctgtgacgtgtcctgttcccagggcacttctggcttcttctgccccagcacccattcttgccaaaatggaggtgtcttccaaaccccacagggctcctgcagctgcccccctggctggatggtatggagggtggggcctgtgggcatggggtgtgggtctggggagaattctgtgggtggtgctaagcagggctccaaggtgagtgaggggggtgagctctgtggttagaattctgtgggtggtgctaagcagggctccaagggcaccatctgctccctgccctgcccagagggctttcacggacccaactgctcccaggaatgtcgctgccacaacggcggcctctgtgaccgattcactgggcagtgccgctgcgctccgggttacactggggatcggtgagtggcgtggggcgggcgggagacgggagggaggaggtggggcgccgccaggctcactcagctaggtgcccaggtgccgggaggagtgcccggtgggccgctttgggcaggactgtgctgagacgtgcgactgcgccccggacgcccgttgcttcccggccaacggcgcatgtctgtgcgaacacggcttcactggggaccgctgcacggatcgcctctgccccgacggcttctacggtctcagctgccaggccccctgcacctgcgaccgggagcacagcctcagctgccacccgatgaacggggagtgctcctgcctgccgggctgggcgggcctccactgcaacgagagctgcccgcaggacacgcatgggccagggtgccaggagcactgtctctgcctgcacggtggcgtctgccaggctaccagcggcctctgtcagtgcgcgccgggttacacgggccctcactgtgctagtctttgtcctcctgacacctacggtgtcaactgttctgcacgctgctcatgtgaaaatgccatcgcctgctcacccatcgacggcgagtgcgtctgcaaggaaggttggcagcgtggtaactgctctgtgccctgcccacccggaacctggggcttcagttgcaatgccagctgccagtgtgcccatgaggcagtctgcagcccccaaactggagcctgtacctgcacccctgggtggcatggggcccactgccagctgccctgtccgaaggggcagtttggagaaggttgtgccagtcgctgtgactgtgaccactctgatggctgtgaccctgttcatggacgctgtcagtgccaggctggctggatgggtgcccgctgccacctgtcctgccctgagggcttatggggagtcaactgtagcaacacctgcacctgcaagaatgggggcacctgtctccctgagaatggcaactgcgtgtgtgcacccggattccggggcccctcctgccagagatgtgaggctccctactgccccttccacctgccaccagcagggggcagtgtagtgtcagctgccagagcacccctccccccgcgcccgccgcccacctctcccaccttacccccggtctcttcctctgacccgtcttcagactagttactgcagtgggaaggtgggagggagacggtggggtaagggctgattgaggattggcctctgcccccaatcaccatgtacccctttcccccagcctgtcagcctggccgctatggcaaacgctgtgtgccctgcaagtgcgctaaccactccttctgccacccctcgaacgggacctgctactgcctggctggctggacaggccccgactgctcccagcgctgccctctggggacatttggtgctaactgctcccagccatgccagtgtggtcctggagaaaagtgccacccagagactggggcctgtgtatgtcccccagggcacagtggtgcaccttgcaggattggaatccaggagccctttactgtgatgccgaccactccagtagcgtagagggttaacccacagatcattcttgataatctcantaatcctgtcagc

SEQ ID NO: 463349 - DNA, 886 bp, Homo sapiens
  misc_feature (873)..(873): n is a, c, g, or t
tggcgtcccccagctgactggcctacctgctccccactccttctccaagaaggggcagtttggagaaggttgtgccagtcgctgtgactgtgaccactctgatggctgtgaccctgttcatggacgctgtcagtgccaggctggctggatgggtgcccgctgccacctgtcctgccctgagggcttatggggagtcaactgtagcaacacctgcacctgcaagaatgggggcacctgtctccctgagaatggcaactgcgtgtgtgcacccggattccggggcccctcctgccagagatgtgaggctccctactgccccttccacctgccaccagcagggggcagtgtagtgtcagctgccagagcacccctccccccgcgcccgccgcccacctctcccaccttacccccggtctcttcctctgacccgtcttcagactagttactgcagtgggaaggtgggagggagacggtggggtaagggctgattgaggattggcctctgcccccaatcaccatgtacccctttcccccagcctgtcagcctggccgctatggcaaacgctgtgtgccctgcaagtgcgctaaccactccttctgccacccctcgaacgggacctgctactgcctggctggctggacaggccccgactgctcccagcgctgccctctggggacatttggtgctaactgctcccagccatgccagtgtggtcctggagaaaagtgccacccagagactggggcctgtgtatgtcccccagggcacagtggtgcaccttgcaggattggaatccaggagccctttactgtgatgccgaccactccagtagcgtagagggttaacccacagatcattcttgataatctcantaatcctgtcagc

SEQ ID NO: 463350 - DNA, 5292 bp, Homo sapiens
ggcttctatgagagcagggggttctgtgtcccgctctgtgcccaggagtgtgtccatggccgttgtgtggcacccaatcagtgccaatgtgtgccaggctggcggggcgacgactgttccagtgagtgtgccccaggaatgtgggggccacagtgtgacaagccctgcagctgcggcaacaacagctcgtgtgatcccaagagtgggtgccatggggcaccctgcgatccccagactggagcctgcttctgccccgcagagagaactgggcccaggtatgtaatggggggaacgacactttaacaagatcgcagacacaaggccacacagatctatgtggggaaatgaggtgactcagacagggccccaagtgtggggatgatgtggaggccaagatcctggtcccagtggatcctattcctcacgagtggagtgaccttgagcaaatcattgactcgttgtgggcttgtttcctgtctgtaaaacgggaatagtattgtctacatggcagggtggctgtgaagataacatgagctgtgacgtgtcctgttcccagggcacttctggcttcttctgccccagcacccattcttgccaaaatggaggtgtcttccaaaccccacagggctcctgcagctgcccccctggctggatggtatggagggtggggcctgtgggcatggggtgtgggtctggggagaattctgtgggtggtgctaagcagggctccaaggtgagtgaggggggtgagctctgtggttagaattctgtgggtggtgctaagcagggctccaagggcaccatctgctccctgccctgcccagagggctttcacggacccaactgctcccaggaatgtcgctgccacaacggcggcctctgtgaccgattcactgggcagtgccgctgcgctccgggttacactggggatcggtgagtggcgtggggcgggcgggagacgggagggaggaggtggggcgccgccaggctcactcagctaggtgcccaggtgccgggaggagtgcccggtgggccgctttgggcaggactgtgctgagacgtgcgactgcgccccggacgcccgttgcttcccggccaacggcgcatgtctgtgcgaacacggcttcactggggaccgctgcacggatcgcctctgccccgacggcttctacggtctcagctgccaggccccctgcacctgcgaccgggagcacagcctcagctgccacccgatgaacggggagtgctcctgcctgccgggctgggcgggcctccactgcaacgagagctgcccgcaggacacgcatgggccagggtgccaggagcactgtctctgcctgcacggtggcgtctgccaggctaccagcggcctctgtcagtgcgcgccgggttacacgggccctcactgtgctagtctttgtcctcctgacacctacggtgtcaactgttctgcacgctgctcatgtgaaaatgccatcgcctgctcacccatcgacggcgagtgcgtctgcaaggaaggttggcagcgtggtaactgctctgtgccctgcccacccggaacctggggcttcagttgcaatgccagctgccagtgtgcccatgaggcagtctgcagcccccaaactggagcctgtacctgcacccctgggtggcatggggcccactgccagctgccctgtccgaaggggcagtttggagaaggttgtgccagtcgctgtgactgtgaccactctgatggctgtgaccctgttcatggacgctgtcagtgccaggctggctggatgggtgcccgctgccacctgtcctgccctgagggcttatggggagtcaactgtagcaacacctgcacctgcaagaatgggggcacctgtctccctgagaatggcaactgcgtgtgtgcacccggattccggggcccctcctgccagagatgtgaggctccctactgccccttccacctgccaccagcagggggcagtgtagtgtcagctgccagagcacccctccccccgcgcccgccgcccacctctcccaccttacccccggtctcttcctctgacccgtcttcagactagttactgcagtgggaaggtgggagggagacggtggggtaagggctgattgaggattggcctctgcccccaatcaccatgtacccctttcccccagcctgtcagcctggccgctatggcaaacgctgtgtgccctgcaagtgcgctaaccactccttctgccacccctcgaacgggacctgctactgcctggctggctggacaggccccgactgctcccagcgctgccctctggggacatttggtgctaactgctcccagccatgccagtgtggtcctggagaaaagtgccacccagagactggggcctgtgtatgtcccccagggcacagtggtgcaccttgcaggattggaatccaggagccctttactgtgatgccgaccactccagtagcgtataactcgctgggtgcagtgattggcattgcagtgctggggtcccttgtggtagccctggtggcactgttcattggctatcggcactggcaaaaaggcaaggagcaccaccacctggctgtggcttacagcagcgggcgcctggacggctccgagtatgtcatgccagatgtccctccgagctacagtcactactactccaaccccagctaccacaccctgtcgcagtgctccccaaaccccccaccccctaacaaggttccaggcccgctctttgccagcctgcagaaccctgagcggccaggtggggcccaagggcatgataaccacaccaccctgcctgctgactggaagcaccgccgggagccccctccagggcctctggacagggggagcagccgcctggaccgaagctacagctatagctacagcaatggcccaggcccattctacaataaagggctcatctctgaagaggagctcggggccagtgtggcttccctgagcagtgagaacccatatgccaccatccgggacctgcccagcttgccagggggcccccgggagagcagctacatggagatgaaaggccctccctcaggatctccccccaggcagcctcctcagttctgggacagccagaggcggcggcaaccccagccacagagagacagtggcacctacgagcagcccagccccctgatccatgaccgagactctgtgggctcccagccccctctgcctccgggcctaccccccggccactatgactcacccaagaacagccacatccctggacattatgacttgcctccagtacggcatcccccatcacctccacttcgacgccaggaccgttgaggagccaggatggtatggcagaggccagcacacctggctgttgctgctcaaggctggggacagagcctagtgtacccctgccaggagcagggagtggaccggcaggctgtgaacatgaacaacgcttaacagagcaagtgatgggagccttgttcctgggttctaccatgggagacgctgatcagcaggatgcctggctccctttcccaacccactgctcccaaggcctccagggccctgtgtacataaactggtgggttggaagttgctgggtaactctgatttcagacatgcgtgtggggtaccttttctgtgcatgctcagcctgggctctgtgcgtgtgtgtgtttctgtgattttagaagggtaccaggcacaggttctgtcctagggcacttaccatttagtagggagatggaaccaacccaattaactctagcaatagcctcctaactggcctcctccattgattcagtgaaccttccaatgcatggctcataatttcaaaatacaggctggttagttactccctacctgaaagccttcataggtgcctctttgctcttctgccagtatcaaaacttttgaaggccttaaaggccctgctttgcctggcccatctgtctctccagcctcaccttgaactgtgttcctgtcactgcacgccagtcacaccggcctctaggtcctcctgtaggccactcttctttctggcacagggacctgcacacctggagtgcccttcctcccccactcgcctgttcacccctgcttttcctttacacctcctcctcagggaagtgcccaccctccgtacatctttcacagccctgattgcagctgtgttcactcaccaggtacctgcagaaggcctacagggtgccaggcacttctttaatgtgttctttctttatgtgattatttgattaatctctgcctcccccactagactgtaagctccctgaaggcaagaatcctgtgcttatgctcaatattagctctcccttggcacagagtaggcactcaacaaatgctccccaaaaggctgagtggctgactgaattaagtaccagtgacatgcagtaactgctaagatagatgagccatctgtatgctctgacagttacagactgaataagttggagacttccctaaagggtggcatttccccagggtaacaacgcagagctcaggtgtgggaaggtgccaggggcaggggtgcagaggggctgaggctgaggggggtgcagaggctggagaaaggataacaggagagagtatacaggcatgccttgatttattgcacttcacaggtagcagaatttttaaagaaattgaaggttttgggacatatatgtgacagcaataggttaagaaaagcaaagcagagaaattgaagatttgtgtcaacactgctttaagcaaatctgttggcaccatttttccaatagcatgtgcccattttgggtctctacattgcattttggtaattgcttgcaatatttcaagcattttcattgttattatatgtgttatagtgatctgtgatcagtgatctttgatatattattgtaattgtttcggggcgccatgaaccgcacccatataacacggtaaacttaatcagcaaacgttgtgtgtgttctgactgctccaccgaccagccgttcccccaagtctttccctctcttagggcctccctattccctgagacacaacaatattgaaatgaggccaattaataaccctacaggggcctctaagtgttgaagtgaaaggaatagtcacacatctctcacttaaaatcagaagctagaaatgattaaacttagtggggaaggcatgttgaaagccaagacaggctgaaagctaggccttttgcactaaatagccaagttgtggatgcaaaggaaaagttcttgaaggaaattataagtgttactccagtgaaaacatgaataat

SEQ ID NO: 463351 - DNA, 1877 bp, Homo sapiens
ggcttctatgagagcagggggttctgtgtcccgctctgtgcccaggagtgtgtccatggccgttgtgtggcacccaatcagtgccaatgtgtgccaggctggcggggcgacgactgttccagtgagtgtgccccaggaatgtgggggccacagtgtgacaagccctgcagctgcggcaacaacagctcgtgtgatcccaagagtgggtgccatggggcaccctgcgatccccagactggagcctgcttctgccccgcagagagaactgggcccaggtatgtaatggggggaacgacactttaacaagatcgcagacacaaggccacacagatctatgtggggaaatgaggtgactcagacagggccccaagtgtggggatgatgtggaggccaagatcctggtcccagtggatcctattcctcacgagtggagtgaccttgagcaaatcattgactcgttgtgggcttgtttcctgtctgtaaaacgggaatagtattgtctacatggcagggtggctgtgaagataacatgagctgtgacgtgtcctgttcccagggcacttctggcttcttctgccccagcacccattcttgccaaaatggaggtgtcttccaaaccccacagggctcctgcagctgcccccctggctggatggtatggagggtggggcctgtgggcatggggtgtgggtctggggagaattctgtgggtggtgctaagcagggctccaaggtgagtgaggggggtgagctctgtggttagaattctgtgggtggtgctaagcagggctccaagggcaccatctgctccctgccctgcccagagggctttcacggacccaactgctcccaggaatgtcgctgccacaacggcggcctctgtgaccgattcactgggcagtgccgctgcgctccgggttacactggggatcggtgagtggcgtggggcgggcgggagacgggagggaggaggtggggcgccgccaggctcactcagctaggtgcccaggtgccgggaggagtgcccggtgggccgctttgggcaggactgtgctgagacgtgcgactgcgccccggacgcccgttgcttcccggccaacggcgcatgtctgtgcgaacacggcttcactggggaccgctgcacggatcgcctctgccccgacggcttctacggtctcagctgccaggccccctgcacctgcgaccgggagcacagcctcagctgccacccgatgaacggggagtgctcctgcctgccgggctgggcgggcctccactgcaacgagagctgcccgcaggacacgcatgggccagggtgccaggagcactgtctctgcctgcacggtggcgtctgccaggctaccagcggcctctgtcagtgcgcgccgggttacacgggccctcactgtgctagtctttgtcctcctgacacctacggtgtcaactgttctgcacgctgctcatgtgaaaatgccatcgcctgctcacccatcgacggcgagtgcgtctgcaaggaaggtaatagggtggagtttcccagagagaagacttgggggatggccaagggaagaagggagagtccaagagtatgggtgggccaagggcaggggagcggctgcagggtaagggtggaggggcagcagctggacacagggaaagtatccaggctactttcttcctggaatatccactttgcttttcttcaaccacaaagatcctacctgtccttaaaggctgaggccaaaagccacctcactggcgaacgtccctcaccctcagtcatacggaaacacaattaccatgctgggaagggcctcacatctgccagagtgacacattgcgaacctttaggctggactcggatacagttgacacta

SEQ ID NO: 463352 - DNA, 5116 bp, Homo sapiens
aataaggtttgacactcttgactatggcattcagagccctcttagttttttatcagcctacttttatagatttgctcccaaaattgcttaatgctcctcctcctacttgggaacagctggaaaatgggctggttgctgtgcgtacagtggtacatgggctggttgattatatccagaaccacagcaaaaaaggagcagatcagcagcagcctccacagcatagcaaatacaaaacatacatgtgtcgagatatgaagcagagaggaggatgccctcgtggggccagctgtacatttgcacactcacaggaggaactggaaaaatttcgtaaaatgaataagcgcctggttccgagaagacccttgagtgcctctttgggtcaacttaatgaggtgggcctgccttcagcagctatccttccagatgaaggtgcagtggatctccctagcagaaaacctcctgctctgccaaatggaattgtatcaacagggaatacagtaacacagcttattccgcgagggacagaccccagctatgattctagtctgaaaccaggaaaaatagatcatctgagcagtagtgctcctggatcccctcctgacctgctagaatctgttcctaagagtatttctgccttacctgtgaatccacattctatacctccaagggggccagcagatctgcctccaatgcctgttaccaaaccacttcagatggtacctcgaggttctcagttatatccagcacaacagacggatgtttattatcaggatcctcgaggagcagctccgccatttgaaccagcaccttatcagcagggtatgtattatactccaccaccacaatgtgtgtcccgctttgtccgacctccaccatctgctcctgaacctgctcctccctacttggatcattatccaccctacctccaagaacgtgttgtaaactctcagtatggcacacagccacagcagtacccacctatatacccatctcactatgatggccgtcgagtgtaccctgctccgtcttacacaagagaagagatattccgagaaagccctatacccattgagattccacctgcagcagtaccatcgtatgtaccagaatccagagaaagataccaacagatcgagagttactatccagtggctcctcatccaactcagatcagaccttcgtacctcagagaacctccttatagccggcttcctcctcctccccagcctcatcctagtctagatgaactacatcgccgacgaaaggaaataatggcccagctagaggaaagaaaggttatctctccacctccttttgcaccttcaccaaccttgcctcctacctttcatccggaagaatttttggatgaagacttgaaggtagctgggaaatacaaaggaaatgattatagccaatactctccctggtcatgtgacaccatcggctcctacattggaaccaaagatgcaaaacccaaagatgttgtggcagcagggagtgtggaaatgatgaatgtggagagtaaaggaatgagggaccagcgattagatcttcagagaagagcagcagaaaccagtgatgatgacctcatcccatttggagaccgaccaacagtgtctcggtttggtgccatctcacgaacttccaaaactatatatcagggtgctggtccaatgcaggctatggcacctcagggagctcctacaaaatctattaacatttcagattatagtccatatggaacccacggtggctggggagcttctccatattcacctcatcaaaacataccttctcagggacacttcagtgagagggagagaatatctatgtcagaagtggccagtcatggaaaaccccttccatctgctgagagagaacagctacgactagaattgcagcaattgaaccatcagattagccagcagacccagctacgtggactagagagggaggcaaacaccctggcaggccagtcacagcccccaccaccgccacctccaaaatggcctgggatgatctcaagtgagcagttgagcttggaactgcaccaggtggaaagggaaatcgggaagagaacacgggaactgagtatggaaaaccagtgttctctggacatgaaaagcaaactgaatacaagtaaacaagcagaaaatggacaaccagaaccacaaaacaaggttccggctgaggaccttacattgacattcagcagtgatgtaccaaatggatcagccttgacacaagagaatatcagcctcctatcaaacaagaccagctctctgaacctgtcagaggaccctgagggaggaggggataataatgactcccagagatcaggagttactcccagttctgctccttaaaatatgaggagtcctacttttatcttctgctcctaatcagtttgtcgggcataggggtaggagaacgcataacttctaaactttttctcttaagagcggtcagagaaatccaggaaattcaccagaggcaatgtgcacaaacaccactactaaaaacaaaccctgcacatagttcacattaatgcatttttttaatttaaagaaaaagaaaattagcagtatctgcaagcaattcagattaaatttgtttttgttctgtgaatgaactttattttaataactttggacgccttggatccagggctttaaaaaaaaaagatattatatatacactctgtttgattaattgtatgatcttaatgaagtaggttttcttgtattttggtattacatacccagtgtataatttgtataattcctcacccccaatccttatcaattctcaccaccccataaacttaaaacagaccaaaaatgtcagctttcagagaattctgtggtgcttgagaaacagacagtactagactgagttattagaaaatgtgcagcaaaccaacttttcccagagctgttatttggaattctttatccctttctagatcactagcttcattggatacgtatatttttcttgacattgaagctttttgtttgtttgggagggttttatttcttgtttttattttcaacttttcaaatagaattaccaattttgaagtcctcattttcatattaaggatcatttgcattctcttaatataatcagaaagctgattcagtgtttaattagatttaaatgttgatcaagaattaactgtaacttactagcactgaaaatacatgtttggtgtttcgcctgcgttcagctcatggttggaaatttgaagcagtgcttttcaaattaaacttttgctgacatcataggatgctaaaaaacaaggacaatcaactatgttttaaaactgcaacatttgatttgaacttaaaatgaatagagccacattattttaatggatgttttgttttacttgtgaactgattgagtcttaaggatagtttatgaattgatcacttgttgctcagaatcattagtataagtaggtaggaaatagtttgaagtcatttttcatagacttaactgtccaatgttgcaaatgtttcttcatgaaaatattgaaaagagtaaggttttttttttttttaattctgctgcacatattctgatgccatgtgtctgtgcttaattaactaagaccctataaaacgtgtttagtggggactgtttgatatagttgccctctccattcctctatttgcctgatttttttcagtttccctttctgtattttactactaaattagaaagcactggttatgtaataagttactacattgctttggttgagtaaaaacaagagtttatatttttcttgtttcttattttcttaacccttaactcctgctgaggtcataacaacctcagtctaagctctgtgtccatcatactgttaacttaaacaaatgggtggtgggggtgggaagggtaatacagtcctgccattgcctaccagtaggagagtccaaacagaacactcttttgagtagcaattatttaatttgcccagtcaaggcaccgtgtttatatactatttcacattgaatttgattatgccctacagacctggctggtcaaggatttgatatacacatattggcttgggattcgagctttcttttttatttaaataaaaatttatatatatattatatatatacatatatacatagctatatctgtatatatattgggtatgttttaaggattttttcgcatgagcgcagctgttgcgataaattgaccgattgggaggtggtagaagcactgaatgaagcctgtaaggacaaatggcatatttgggcataactgcttgactctgtaactacttttttaaaatcaaaattgaaaagtctccccgagacattctgcagtcattatcacctttttgggtggattttattttgttttattttgttttttttaaaaaaataactttttaacattggtgcatatttgcttgggatagagcttgtgtaatttaccaatcgtattgattcctccaaagaatagccttgtccaatgtttctgttcatacaaggtgtcaattcttctggatgagtaagcatttttcaccttacttgataatctaaactttctatttgggaggaatttaaagtgctatatttcctgttattaagttagcagaactactctggacctggattttttcaaacatgaatgtttatcaagtacttggtacattcaacaggacatgttcaataaatatttgctgttttgatttggtttccctgaagccaaaactgaactttctaacaggaggatttgggcaaattccagtgagatgccttgagagcctcagctaaatgctgctaaatgataatgtaggatttattttggtaagtttaatttcaccttaattaaaatgtcatgttcacctagtaaactgggaacccaagggagttggagactgctttttgtgctaaatgttttgccaaatttccatggaagggttaagctttgagttattcagtaaccacagcagaagctgggtcctatctcttccctgccaaggtcttattcttgagtccaaaggaaagaacagaacagcccagggtatgaggcaatggacatggacctgctgaattacctgctcatggaagttactactgaa

SEQ ID NO: 463353 - DNA, 633 bp, Homo sapiens
acaggcgtgtgccaccacgcccagctgatttttgtatttttagtagagacggggtttcgccatgttggccaggctggtctcaaactgacctcagcagtccacctgcctcagccccctaaactgctggtattacaggcgtgagccgccatgcctggccgcctttctaggtcattgtttttttctgagaaattttttttcatattagcttgaggcattgtctgtcttattgtccagcttggttagtgagcaagtggattgtattctgttatgtttttatgtatgtcactcttttagtctgccagtttctttggttattttacaaaattgaatatgatttctggatcatcactttgtattatctgtaatttggtctctcccattaacaccattaaatagatgataactgattttatttccttctctttcaaaggaaaaccagtgttctctggacatgaaaagcaaactgaatacaagtaaacaagcagaaaatggacaaccagaaccacaaaacaaggttccggctgaggaccttacattgacattcaggtaaagaaaaggagattgtcgtagccatattaaattacacacaaaagagaaactaatatatgatccagacatatcagaaataccctc

SEQ ID NO: 463354 - DNA, 3510 bp, Homo sapiens
ccacctcagcttcccaaagtgctagaattaaaggcacaagccaccatgcgtagccaacttctctttcaaatcagaaaatacaaggagcaatttatacataagatgaaattactgtttactaaatttaaatgtccctattttgttatttttttgtttgaatggtactcaaagagaacagcaccttacagttgcattattttgttgcaaatggctgggtgataagctactcaaggctgtggtctggaattgagcctggttattctgtgcatggtgtgaagtgtgttgagttttctgtgtgcttggctttatgcactaggctgttagtaacaggctggtgttgcagagggaggcaaacaccctggcaggccagtcacagcccccaccaccgccacctccaaaatggcctgggatgatctcaagtgagcagttgagcttggaactgcaccaggtggaaagggaaatcgggaagagaacacgggaactgagtatggaaaaccagtgttctctggacatgaaaagcaaactgaatacaagtaaacaagcagaaaatggacaaccagaaccacaaaacaaggttccggctgaggaccttacattgacattcagcagtgatgtaccaaatggatcagccttgacacaagagaatatcagcctcctatcaaacaagaccagctctctgaacctgtcagaggaccctgagggaggaggggataataatgactcccagagatcaggagttactcccagttctgctccttaaaatatgaggagtcctacttttatcttctgctcctaatcagtttgtcgggcataggggtaggagaacgcataacttctaaactttttctcttaagagcggtcagagaaatccaggaaattcaccagaggcaatgtgcacaaacaccactactaaaaacaaaccctgcacatagttcacattaatgcatttttttaatttaaagaaaaagaaaattagcagtatctgcaagcaattcagattaaatttgtttttgttctgtgaatgaactttattttaataactttggacgccttggatccagggctttaaaaaaaaaagatattatatatacactctgtttgattaattgtatgatcttaatgaagtaggttttcttgtattttggtattacatacccagtgtataatttgtataattcctcacccccaatccttatcaattctcaccaccccataaacttaaaacagaccaaaaatgtcagctttcagagaattctgtggtgcttgagaaacagacagtactagactgagttattagaaaatgtgcagcaaaccaacttttcccagagctgttatttggaattctttatccctttctagatcactagcttcattggatacgtatatttttcttgacattgaagctttttgtttgtttgggagggttttatttcttgtttttattttcaacttttcaaatagaattaccaattttgaagtcctcattttcatattaaggatcatttgcattctcttaatataatcagaaagctgattcagtgtttaattagatttaaatgttgatcaagaattaactgtaacttactagcactgaaaatacatgtttggtgtttcgcctgcgttcagctcatggttggaaatttgaagcagtgcttttcaaattaaacttttgctgacatcataggatgctaaaaaacaaggacaatcaactatgttttaaaactgcaacatttgatttgaacttaaaatgaatagagccacattattttaatggatgttttgttttacttgtgaactgattgagtcttaaggatagtttatgaattgatcacttgttgctcagaatcattagtataagtaggtaggaaatagtttgaagtcatttttcatagacttaactgtccaatgttgcaaatgtttcttcatgaaaatattgaaaagagtaaggttttttttttttttaattctgctgcacatattctgatgccatgtgtctgtgcttaattaactaagaccctataaaacgtgtttagtggggactgtttgatatagttgccctctccattcctctatttgcctgatttttttcagtttccctttctgtattttactactaaattagaaagcactggttatgtaataagttactacattgctttggttgagtaaaaacaagagtttatatttttcttgtttcttattttcttaacccttaactcctgctgaggtcataacaacctcagtctaagctctgtgtccatcatactgttaacttaaacaaatgggtggtgggggtgggaagggtaatacagtcctgccattgcctaccagtaggagagtccaaacagaacactcttttgagtagcaattatttaatttgcccagtcaaggcaccgtgtttatatactatttcacattgaatttgattatgccctacagacctggctggtcaaggatttgatatacacatattggcttgggattcgagctttcttttttatttaaataaaaatttatatatatattatatatatacatatatacatagctatatctgtatatatattgggtatgttttaaggattttttcgcatgagcgcagctgttgcgataaattgaccgattgggaggtggtagaagcactgaatgaagcctgtaaggacaaatggcatatttgggcataactgcttgactctgtaactacttttttaaaatcaaaattgaaaagtctccccgagacattctgcagtcattatcacctttttgggtggattttattttgttttattttgttttttttaaaaaaataactttttaacattggtgcatatttgcttgggatagagcttgtgtaatttaccaatcgtattgattcctccaaagaatagccttgtccaatgtttctgttcatacaaggtgtcaattcttctggatgagtaagcatttttcaccttacttgataatctaaactttctatttgggaggaatttaaagtgctatatttcctgttattaagttagcagaactactctggacctggattttttcaaacatgaatgtttatcaagtacttggtacattcaacaggacatgttcaataaatatttgctgttttgatttggtttccctgaagccaaaactgaactttctaacaggaggatttgggcaaattccagtgagatgccttgagagcctcagctaaatgctgctaaatgataatgtaggatttattttggtaagtttaatttcaccttaattaaaatgtcatgttcacctagtaaactgggaacccaagggagttggagactgctttttgtgctaaatgttttgccaaatttccatggaagggttaagctttgagttattcagtaaccacagcagaagctgggtcctatctcttccctgccaaggtcttattcttgagtccaaaggaaagaacagaacagcccagggtatgaggcaatggacatggacctgctgaattacctgctcatggaagttactactgaa

SEQ ID NO: 463355 - DNA, 3450 bp, Homo sapiens
acaggcgtgtgccaccacgcccagctgatttttgtatttttagtagagacggggtttcgccatgttggccaggctggtctcaaactgacctcagcagtccacctgcctcagccccctaaactgctggtattacaggcgtgagccgccatgcctggccgcctttctaggtcattgtttttttctgagaaattttttttcatattagcttgaggcattgtctgtcttattgtccagcttggttagtgagcaagtggattgtattctgttatgtttttatgtatgtcactcttttagtctgccagtttctttggttattttacaaaattgaatatgatttctggatcatcactttgtattatctgtaatttggtctctcccattaacaccattaaatagatgataactgattttatttccttctctttcaaaggaaaaccagtgttctctggacatgaaaagcaaactgaatacaagtaaacaagcagaaaatggacaaccagaaccacaaaacaaggttccggctgaggaccttacattgacattcagcagtgatgtaccaaatggatcagccttgacacaagagaatatcagcctcctatcaaacaagaccagctctctgaacctgtcagaggaccctgagggaggaggggataataatgactcccagagatcaggagttactcccagttctgctccttaaaatatgaggagtcctacttttatcttctgctcctaatcagtttgtcgggcataggggtaggagaacgcataacttctaaactttttctcttaagagcggtcagagaaatccaggaaattcaccagaggcaatgtgcacaaacaccactactaaaaacaaaccctgcacatagttcacattaatgcatttttttaatttaaagaaaaagaaaattagcagtatctgcaagcaattcagattaaatttgtttttgttctgtgaatgaactttattttaataactttggacgccttggatccagggctttaaaaaaaaaagatattatatatacactctgtttgattaattgtatgatcttaatgaagtaggttttcttgtattttggtattacatacccagtgtataatttgtataattcctcacccccaatccttatcaattctcaccaccccataaacttaaaacagaccaaaaatgtcagctttcagagaattctgtggtgcttgagaaacagacagtactagactgagttattagaaaatgtgcagcaaaccaacttttcccagagctgttatttggaattctttatccctttctagatcactagcttcattggatacgtatatttttcttgacattgaagctttttgtttgtttgggagggttttatttcttgtttttattttcaacttttcaaatagaattaccaattttgaagtcctcattttcatattaaggatcatttgcattctcttaatataatcagaaagctgattcagtgtttaattagatttaaatgttgatcaagaattaactgtaacttactagcactgaaaatacatgtttggtgtttcgcctgcgttcagctcatggttggaaatttgaagcagtgcttttcaaattaaacttttgctgacatcataggatgctaaaaaacaaggacaatcaactatgttttaaaactgcaacatttgatttgaacttaaaatgaatagagccacattattttaatggatgttttgttttacttgtgaactgattgagtcttaaggatagtttatgaattgatcacttgttgctcagaatcattagtataagtaggtaggaaatagtttgaagtcatttttcatagacttaactgtccaatgttgcaaatgtttcttcatgaaaatattgaaaagagtaaggttttttttttttttaattctgctgcacatattctgatgccatgtgtctgtgcttaattaactaagaccctataaaacgtgtttagtggggactgtttgatatagttgccctctccattcctctatttgcctgatttttttcagtttccctttctgtattttactactaaattagaaagcactggttatgtaataagttactacattgctttggttgagtaaaaacaagagtttatatttttcttgtttcttattttcttaacccttaactcctgctgaggtcataacaacctcagtctaagctctgtgtccatcatactgttaacttaaacaaatgggtggtgggggtgggaagggtaatacagtcctgccattgcctaccagtaggagagtccaaacagaacactcttttgagtagcaattatttaatttgcccagtcaaggcaccgtgtttatatactatttcacattgaatttgattatgccctacagacctggctggtcaaggatttgatatacacatattggcttgggattcgagctttcttttttatttaaataaaaatttatatatatattatatatatacatatatacatagctatatctgtatatatattgggtatgttttaaggattttttcgcatgagcgcagctgttgcgataaattgaccgattgggaggtggtagaagcactgaatgaagcctgtaaggacaaatggcatatttgggcataactgcttgactctgtaactacttttttaaaatcaaaattgaaaagtctccccgagacattctgcagtcattatcacctttttgggtggattttattttgttttattttgttttttttaaaaaaataactttttaacattggtgcatatttgcttgggatagagcttgtgtaatttaccaatcgtattgattcctccaaagaatagccttgtccaatgtttctgttcatacaaggtgtcaattcttctggatgagtaagcatttttcaccttacttgataatctaaactttctatttgggaggaatttaaagtgctatatttcctgttattaagttagcagaactactctggacctggattttttcaaacatgaatgtttatcaagtacttggtacattcaacaggacatgttcaataaatatttgctgttttgatttggtttccctgaagccaaaactgaactttctaacaggaggatttgggcaaattccagtgagatgccttgagagcctcagctaaatgctgctaaatgataatgtaggatttattttggtaagtttaatttcaccttaattaaaatgtcatgttcacctagtaaactgggaacccaagggagttggagactgctttttgtgctaaatgttttgccaaatttccatggaagggttaagctttgagttattcagtaaccacagcagaagctgggtcctatctcttccctgccaaggtcttattcttgagtccaaaggaaagaacagaacagcccagggtatgaggcaatggacatggacctgctgaattacctgctcatggaagttactactgaa

SEQ ID NO: 463356 - DNA, 1402 bp, Homo sapiens
aataaggtttgacactcttgactatggcattcagagccctcttagttttttatcagcctacttttatagatttgctcccaaaattgcttaatgctcctcctcctacttgggaacagctggaaaatgggctggttgctgtgcgtacagtggtacatgggctggttgattatatccagaaccacagcaaaaaaggagcagatcagcagcagcctccacagcatagcaaatacaaaacatacatgtgtcgagatatgaagcagagaggaggatgccctcgtggggccagctgtacatttgcacactcacaggaggaactggaaaaatttcgtaaaatgaataagcgcctggttccgagaagacccttgagtgcctctttgggtcaacttaatgaggtgggcctgccttcagcagctatccttccagatgaaggtgcagtggatctccctagcagaaaacctcctgctctgccaaatggaattgtatcaacagggaatacagtaacacagcttattccgcgagggacagaccccagctatgattctagtctgaaaccaggaaaaatagatcatctgagcagtagtgctcctggatcccctcctgacctgctagaatctgttcctaagagtatttctgccttacctgtgaatccacattctatacctccaagggggccagcagatctgcctccaatgcctgttaccaaaccacttcagatggtacctcgaggttctcagttatatccagcacaacagacggatgtttattatcaggatcctcgaggagcagctccgccatttgaaccagcaccttatcagcagggtatgtattatactccaccaccacaatgtgtgtcccgctttgtccgacctccaccatctgctcctgaacctgctcctccctacttggatcattatccaccctacctccaagaacgtgttgtaaactctcagtatggcacacagccacagcagtacccacctatatacccatctcactatgatggccgtcgagtgtaccctgctccgtcttacacaagagaagagatattccgagaaagccctatacccattgagattccacctgcagcagtaccatcgtatgtaccagaatccagagaaagataccaacagatcgagagttactatccagtggctcctcatccaactcagatcagaccttcgtacctcagagaacctccttatagccggcttcctcctcctccccagcctcatcctagtctagatgaactacatcgccgacgaaaggaaataatggcccagctagaggaaagaaaggttatctctccacctccttttgcaccttcaccaaccttgcctcctacctttcatccggaagaagtaagcaaatcatttttagtctcatttatccgtgtttttttgtg

SEQ ID NO: 463357 - DNA, 351 bp, Homo sapiens
tttttggatgaagacttgaaggtagctgggaaatacaaaggaaatgattatagccaatactctccctggtcatgtgacaccatcggctcctacattggaaccaaagatgcaaaacccaaagatgttgtggcagcagggagtgtggaaatgatggtatgtgtaatagctaagcaataattaatacaaattaagataaaccaaataaatttttacccattaccatttaggcacaaataattcagctttgcttaagagtttcagaccatattctatactctgcagttgagttatctttaaacagtataggtttttgattcatttaggtgtaaataaaaatattttaatacttac

SEQ ID NO: 463358 - DNA, 395 bp, Homo sapiens
tacccacctatatacccatctcactatgatggccgtcgagtgtaccctgctccgtcttacacaagagaagagatattccgagaaagccctatacccattgagattccacctgcagcagtaccatcgtatgtaccagaatccagagaaagataccaacagatcgagagttactatccagtggctcctcatccaactcagatcagaccttcgtacctcagagtatgctgtatttttttttattacatagacttaatttgactgttgcttgctgtgattccttactttttatgcaatgacaataaccctttgatgaattcttttttataagagagcttcttttttttttaaatcttttcataatttgggtattttttttttttaaactatataatgag

SEQ ID NO: 463359 - DNA, 2100 bp, Homo sapiens
cagccagaattcatgagaactcactcaccatcactatcacttgcctcttccctggctctttacggtacctcgtccagcagcacctggatctgcttcacgcactgcaggaaagggtcctgaagtggccacgccaaggcgttcttggagatttattccttaagttaacaaatgacgagggtgatgaagagattaaatctgacatctacacgttgttttttcacatagtccagcgcatccctgaatatctgatacatctgcagtgacaaggaatattttaaaatttttattatgaaaatttcaaatttacatagaagagttcagtgaactccacatgccctcatccagattcaacagttatcaagatcatgccacgtttactttatctaggaacgtaatttgtttctgagtgtgaagatccacaagtcgaacagaagttgagttttccattattccgtatgactctgctagggcaagcaagggagagaagagagttgaaggtgtgccttggagcaccgcaggtggtgaggagggtcagggcttccacgcggggtgatgacagtccctggcccgcaggccatttcccagaagctcagacaataccttcgggcctccgctcgacggactgccttgtccactctccgcctgggaacgggggttcgtgggagcgccttagtggaagtttgtggagctcgggaggtggcatgcacaggcgcctcggagcgcggccccgaggggcgccggcaggcgagaggcctgcactaaccggccgtaagcacagctcttttgtactctgttttccccctaaagacatctgatgcccccagtgaagaaaagccaacagcagcaaagcctgatggagagcatgcagcccgggaagcccagtgactgggagctggagggcaggaagcacgagcggcccgagagccttctggcaccgacgcagttctgcgcggccgagcaggacgtgaaggcgctggccgggcccctgcaggccatcccggagatggacttcgagccctctccggcggagccgctgggcaacgtggagcgctccctgcgcgccccggccgagctcctgcccgatgcccgcggcttcgtgcccgcggcctacgaagagttcgagtacggcggcgagatcttcgcgctgcccgcgccctacgacgaggagccgttccaggctccggccctcttcgagaactgctcgcctgcctcctccgagtccagcctggacatctgcttcctgcggcccgtcagcttcgccatggaggccgagcggccggagcacccgctgcagccgctgcccaagagcgctacgtcgccggcgggcagcagcagcgcctacaagctggaggcggcggcgcaggcgcacggcaaggccaagccgctgagccgctctctcaaagagttcccgcgtgcgccgccagccgacggcgtggccccacgcctctacagcacgcgcagcagcagcggcggccgcgcgcccatcaaggccgagcgcgccgcgcaggcgcacggcccggccgccgccgccgtcgccgcccgcggcgcatccaggaccttcttcccccaacagaggtcccaaagcgaaaaacagacctatttggaagagatgcatttagaagatactaccagattctgtcccaaagaagaaagagaaagtgaacaaacatctttcagcgatcaaaatcccaggcaagaccagaaggggggctttcgcagctccttccgcaagctctttaaaaagaaaaatgggaacgcaactggtgaagatttctgtggtccttggggctggtggtgacatcaaagctttcctattttcagggacttctgacatgagaaaactggagaaggtgcagagctggaatggattacccaagtggcttaagcaagataaaggaagaatgcaccctcgactggggactcaaatggactgatctgagttgttgactattgattggctttggtctcttttgtggtggttgagattatagtatctctgcaatctgattactgtacgaatttctgcattctaccaaatgtagcatatatgtgtggttggcttcaataaatctttcatttaacaatgaaaacaagcaagag

SEQ ID NO: 463360 - DNA, 506 bp, Homo sapiens
agcatacctgacagcctcagcatatggagaacttggtcagttgtatagaagctttggacaagcaacttcatgtctaacatcactttcatacaccctgcatgaggttttttgatattggttcttagtgtctggactagttttacccattctaggtcagagtttaagctagccaaagggccccagtctagcttatcagaggttatttccagaaagcctcctccctccagggacttctgacatgagaaaactggagaaggtgcagagctggaatggattacccaagtggcttaagcaagataaaggaagaatgcaccctcgactggggactcaaatggactgatctgagttgttgactattgattggctttggtctcttttgtggtggttgagattatagtatctctgcaatctgattactgtacgaatttctgcattctaccaaatgtagcatatatgtgtggttggcttcaataaatctttcatttaacaatgaaaacaagcaagag

SEQ ID NO: 463361 - DNA, 4945 bp, Homo sapiens
gagtgctgactggccacgctgtcggtcatggctgctgagctgcagtcaggtcctcacgctgccctgcagttccgctcgctctccaggttcctttagaccctcaactctgagacccctcctctcactcccagctgctgtcttcacttcgggccatcctagacaacatgctcctgctcccggacatgtccctcacctgccttcctgtgtgggtgggcgagcgagtagtgctatctgtcctccctcgtgcctgggctccccacctctggaacaccaatgagcacacttcagcgttgtcctccctcttccacaccatcaagttctgcaccccaccagcatacggacagctctcccttccgaaccctaccacaagagccgccccatcttcccttcacagccaaattcctgaaccgagttctccataccctctttcctccatgagggcttccgtccagcactctgctgagacagcttttgccaagaaggccccagggctcggtcctctgacttctctaattatatcttctccctagatgacctcatgcgtgctcccagctttaaataacaactaaatgctgcagactccggatttcagtccacagcccagctgcccgctggagtccctgctgggtgctccccatccctggcaccagccgattaatgcccagccgttcatctttacatcttgccgagcagcttctcctcgtctctggcctgagcaaggcctgcggcttccaggttctgaggcccgcagagatgcctgtgcacttcccccaagaagctcctccaagttacgtgaccctgatgaaggtcttccttcaccatatgatttgttacaggaaaaataaggaaggaatttggaagcagttaaggagcaagctggctgttggctgtcatctggagtcacctactgggaagtgccgaatcaccccagaccaaggacaggaaggaggcttgggtctcactctgtcaccccaggctggagtgcagtggcaggatggcagctcactgcagcctcgaccaccctggctcaagctatcctcccacctcagcctaagagaaactcttggaacggaaaaccaaataccacatatcctcagttataagtgggagctaaatgatgagaacacgtggacacaaagaggggaacagcagacaccgaggcctacttgagggtggaagttgggaggagggagaggagcagaaaagataacttttgggtactgggcttaatacccgggtgatgaaataatctgtacaacaaacccccatgagatgagttttcctgtgtaacaccgaacctaaaataaaagctaaaaataaaattaagttaaaagagaagctgtcatttttctcataacctaattacaaacctatgtgttgtgctccccattactgaataccacagatgagctgtgccttcctcccctcccctcccttccctttgcttttatgtcaaaatattaggctgtcgttttcacccgtgtgtttctctggcatgcttttatcgtctgcagggatgttattctactttttattttttctttgaataaccgtgtgggatttgacttcaatccttttctgctacttatgtttacataatattagatttcctgaactttttgaaaggaggatcagctttatcagagattcatctgtttgattagttttatccaaaaaccaacctttggctttgtcaatcctctctattatatttttgtttcctagttcactaatttctactcttacattcagtatatctttctgtgtgtatctatcttttactttctgtgggttggattctttttgtactgattttcatcaaggttattgatttccttccaagcagtatttttgctgcatctctaaatatttgatatgaagatatttaataatcattcacatttaaaaattttgaagaattttcagtgtaattttctctttgattaatgacttatttagaaatgtgtatttaaagctttaaaataacaaggtgctctgcaatgcttaagctcagtgatttaagtacctgtagggtataaaatccagagtggactgctttcagggtccctcagctgtagtgtgaagttgggcatatgcagatgggattccgtctgccctgggcagcttgcttgagttctgggggaccagctccccacggattctatgcttctatctttgctacatatctgtgagtaataagtcggctttgcctgacttgtgcaggtgttttgtcataccagactcagactccggcagctgggtttgtgcaaaacctttagaagctgtgtttgtgtaaagactcctgccagacctgggcatccaccagatacaggaatctttacaaaaattggcaaagtgtttagagtcctctcctggtatccaacatatggtgtgcccctcataaggattgataccagtgcatggtattctgtttcacaattatgaatatatgtggattttttctaatacctactttttgttttctgtgtcttgctttacctatgctatttttcttgtttcttgtttttcaaaaatccaattaaaatttttttcccttcctaaggattttggcattatacttttagctttttatggttacccttgacatttttctagatgtacttaacaagatctaaattagcccataactttcccaaccccaacctctaaacaaatatgagcctcagaacattttaactcaatcccttatttacatatcattgtttttagccagttaattcccctctgggatcattttctttctatctgaagtatatttttagaagttcttcagaaaagaactgttggtaagctctcaatttctgtaatctgaaacattcttattttgcactcaatcttgaaagtcagttttgcttgatttaaaattctaagttggcaatcacttccccctgaacttttaagatattagactactattttctaatctccattgatattgttaagaagtctgttgtaattccacaattgtaggtcatttataatttttctcgactgcttttaagagctgcttagtgtggctaactgtagctttacttttaaatttgctttcctgcctgatggtatacattgcactttcagcatttttggataccagtaattcactagttttagaaaattcttggtctttatctctttaaaatttgcctcttcaccattctttccttttggaactccagctatttgtatgttatagttgttcattttaacctttatctctgttaatgacttttttatattttctatccatttgtctctcttttgcattctgggtaatttttttagcttttaaaattcacgattttctccaatctgctgttaaactcaccaaattaagtttgtttctgacaattttttatttctgaaaattccatttttcatcatgcctgtgcctttatagtatattattgcttatttattttttgcaactctattttttaattctttagatacttaatatatcattatcgtatgtttgacgattctgttcttcgaagtccttcaggttttgtttctactgagtctcacctatggtttattaattgtaaatattaagcttcttatttggttgatctgaactgaggttgcttttcttcagaaaggacttgcatttgcttctgccaggagccaaggagagcttttttttgtttgtttgtttttgatttttgtgtgtgttcccatttattttctgtcctgatgatttcccttacttcctgcaaattcagtattgccttaaaaagtatgtcttttgtttaggaactaattgtgttttaagcaggaagacccttcaggaagttaaaagcccacatgaattctttagttgcagaagttttaaatgttggctaaaattagatttttaagaatagactcttcatatatgagaattatagatataagttaggtttctggtccaataaatgcaatcaaccctcaataagcaagagtgttgattattcactttatgggaggattggcaatggaagtttttggttgcctagtgcatcaaagttccatttgtgactgttcatttctgaatagagaaaacaaaaatgaagccaaggcatttctgagtgactattagagatgacactgaactaagacaaactacctagaattattaaagaaactggtgagggaaaatggaatttaactaaacaaaaatctactttgcacacttcccaggaaacacaatttggtatatttcactctggataaaaaatggttataatcaaattttgtttttgttttttaaaccctatcagtttttctggtctgctccctttacattttctccaacaattattttcagccattttgtccctcttcagccctcagagccaaaccttcctcctcccctgttctcagcagaagggattgactgtttttttaaaaagaacagacaacatcagaagggaactgtcacatgctgtgtcatcacaactagcccctcccctcaatactcagccacttcttttccccttctctcctagttgtaaaggacaatctcctcctctaaagccacctgtactctgcactccatctcttcccatgtcctccaggactttgtgattctctatcattctctctctcatcttccatcattccttttcaccttgtttattccccagaagcatttaaaacatgtttaggtcagaaccatggaaaaaaataaccagccctccttcaacccccacatacccctcccattacccatcctttctctttcccttgctttacagccaaatctcagaagagttgtccagtattactgtctccatttccttcttattcatactcaatctggattttaccctcaacatcctactgaaattctcaccattaggtttccatgtttccaaatctagttgacatttattggtcttcaccctatgtgatttcttcatagcattcaacacaatttcaaaca

SEQ ID NO: 463362 - DNA, 1096 bp, Homo sapiens
ttctctgcttggatgcacacagaatattcttgctcacagaataactcactctctttacaaagcactttgtacttgattgattcattatataagaaccgtaaagcaactctgagagttagtcagagaaaagctaaagatgcagggagttttttgtttgtttgtttgtttgtttgttttttgagacggggtcttgctctgtcgcccaggctggagtgcagtagcgcgatctcggctcaatgcagggatttttgtgtatctgcatctgcagaggttgttggagccatcctgtctattcgtttctttctccagcctctcttagcagctgggaagagagagtggagagaaagagggatcaggacagatgtggacacggcagaagaagaggagcctgctgtgacggacttccttgaaatgacaaacaagtaaatatttaagggaataagtaaaaccaaaagaaggactcatgggttggaagaatggaaggagaaggaaaaggcagatgggatagggatagacattgaagattgcaaacaggctagtagcaaagaaagcaaaaacaaacagggtttttagaagccagataaaccttggattcctggtgttgtcacttctgagctatctctgttaccttagcaaagcatacttatttcatgcaatagggacagagggtcactcctgctgatatcttcttttgcatcatctcacatctacctacctactggttggatgatcctaagctaattacctcactcctctaaactgcagctgtcacataagcaggcaaaaaaactttgaaaggccttacaaaagcccatcaagctctacagtaatgctgtccaaggcagtcacaacaggccacatgtggctatagagcacatgagatggggccagttggaattgagatgcaaaatacacaccggactttgaaaacttagtttgaaataatgtaaaataagtaagaatgtaaaatatctcattaataattttcatagtaattatacatggaaattataatatttttggtacattggataaataaaatatattattaaaatcaattttacttgtttctttttacttttttactgtggctact

SEQ ID NO: 463363 - DNA, 2492 bp, Homo sapiens
agttgcttctctctactttaggattaaagatgaggtagaagagtcagcaatgatgggagtaagtggctatgtggagtatctccgagagcaggaagtatctgagcggtggttccggtacaaccctcgtctcacctgcatctattgcgccaaatctttcaaccagaagggaagcctggaccgccacatgcgcctacacatggggatcacaccattcgtctgccgcatgtgtggcaagaagtatacccggaaagatcagctggagtatcatatccgcaagcacacaggcaacaagccctttcactgtcatgtctgtggcaaaagtttccccttccaggccatcttgaatcagcactttcgcaaaaaccaccctggctgtatacccctggaggggcctcacagcatctcccctgaaacaactgtcacatctcgaggacaagctgaggaagagtcaccttcacaggaagagacagttgctcctggggaagctgtccagggctctgtgtccaccactgggccagactgaaacatccagggggagggggctgaccctcttcccctatgagccataagcagccagcatcagagccatgggctgatacttagattcacaaaatgccacatcactaggccagaagatgctcccaagatgttgccaaactggaggatcagcaacttacacaaaagcactaaaggctcctcccttcttattgcccgcctcacactttggaaaataatcaagcaaatcaactttctaattcagggatcaacagccttggtttgttaactttataagaaaaaaggttttttaacaaaacgatgatgataaatggtcatttatctatcagtcatgtttgaacactgtactttggtccatatcatcttggtggctataattgcccggatctaaaaaatgcagcaggagcctcaaccatccgaagcagccaaccgcaagagaggaggtagtcatgatggtgatgaggaggagaaatttctcctcttccttccctggcataacatgcatttttgtgtttcaagaaaaaaatgaatactggtggttcttattttgaaaggttaggctttatctttcccctgactaggcatctaatactttgcctggttatttcatataatcagccatcttgaagcagtattctagtggacaacatcacctgaagcacttggcaactgggagtgaaatgagcagcaaagtgtatgcaataggtactgctacatttggggggcttgagtgttgtgttgaggaagaggagagcagggagggaagtgtttttatgttttgcaaatatcaaacagcacagagccgttctgcaacttcctgactggtatttgtaaaccatagtgctacacatccttgggtaatggctctagttcaggtgaattaatgtgttaggctgactaccaaagtttcatctagtctctttggctcctattttcacgttcagcaatattgtaatcaaaaatgtcactttccagtgaaatgagcctggattgtatttttaaatccacaggtctccatatttgataacttttatatgaagttttaaacatgttttttctgcagtattgtggttgaagaaattcaacactatggttcttactgcaaccacaatttcatttccttatacatatgtaatagtttatattttcaggcatatagaaggacctcacttaaaactatgtctcgggtctgcaaacctagtaattcataaaccaaccatcagcaaaccatagctggtgactccaagagctttgctttttaataatatactacagggcacttatcagaaaacatcatgcagaatcatgttgcaataaatgatcaaaggatcaattttggtcaggtttggttacttagtcattcctaagatttttaaaacttcaagggacccttttagtaattctgggtatttctaagattcttaatccagcactgagagaaagaacttagcaaacatgtagagctttggataccccgtctttcatgaagtgagagaaggaggaatattaagggatgccggcaaatagatgcttataacttacagtgcaagttgaaaaatctctagcttctgttgacggagcactagttgttggggttcttttaagtatgtaatggtttaagaaattgtttcagtgcagaggcatagatgactgtaaaagagatttggcagagggacaggttgtacctgcactggtgaaccatctgtgagaatgttagtcatgtgctcctttcctgagattgctttgtggtgttctcagtctctcctcctgtaagattctgtccttcccctgatgacaagccaatagttcttggtggggttgcatgtctcctagagccccaggacccctgtcgtgtcggggaaggggggagggcaggagggtgggcagagactcgggttgggggagggagttcaaagaaagagtgaaaatatgggtttatataaacatatttaaagcagtttagcaaaagctttctc

SEQ ID NO: 463364 - DNA, 4619 bp, Homo sapiens
tgtgttgcactgagccgctgtctccaggccgaggcccagcagtgaggccggggacctgtttatagggcctggggcttccagaagggagtgactcccagttgggtcccccatctgtgagccagacacctgaggacaggcctctctcagtgcctacgggctggcagacagctgcctggcaacagcaggtatctaactggtgtgctggccatgggctgatggtggacctgccttctgcacctgtttggggggtcactatagggcaggcctgctttacacagcaggtgaagactggtcaacattgtcacgctgagaagtgactctcagtggtgggagcccttcaagagcactggccacgtcttgttcaccctggcatccctagtgaggcctggcccaagacctcgctgtcttgtccttgggtgacatgagggccggtcttaggtgtcgacttggctaggctacaatccccagttattccatcaacactaatctaggagttgctgtggaggacgcagaggggcatgaggggcgagggtccctggaagacacagtccgttggggaaactcccacgccaagctcagcgcccccctccccgcccagctctgatggccggcctgcccttgctcctgcactggtggcccccaggtctggacccacttgcattccccccacgtccctagtgtcacgccgcagcccagccctgcggctccctcactgctcctctcagggacagaggccgtggctgccttgtgtttcctgcagaatcttcccagcctgtccagggagatgtttctctccttctcctcctcctcctcctcctcctccttcttcttcttcttcttcctccccttcctcttcctcttcttctttggaattaaatgggacttgggctctggagaaagcaagcccagacactgcaacaagctcacagctccatgaagatccagccagggccagccccttagaggccaggggatggattaggtgaccccagaggagccctgctgacacctggattccagctgctttcgtggccatgtgggggtggctgtgcgtgccccgccactgcgtgcgtgggtgtctgtgtgtgttatcggtggggggcgcgtgagtgtggccgcgggtgggtgtgtccgatgtgccccggcttgggaccgcgcccgctgcgcccacttgtggctcctgggagccgccagggggaaccgcgccttcaccgcctctgccgaggacgccgccagataggaggctgatgacatgagggctccgtctcccgagtgatggcagcgcgcgctgcttcgccgcctccgccgctcagccccggactccttacgtcagggtagcggggtcccccctccgcgcgggagccagcgaacagcgagagagcacagcagagcgcgccgcggagccggggcgccctcactgcgctaggagccccactaaacccagcggagcggagcctggcgggaggcagcgccgcggagccagcgccggacgccgcaagcagactccccggccagcgcaagcactccctggccggcgccggaccctcggggcgccggattcgtcttgtgtgccccacgtcatgcgcgcgggcgtccgcggctctcccgaccagccccagcgcggtgggcccaggctcagaggtcccggcgcctctcgctgaagtagttgggtagccggggctgggggtcgccacgtcgggggcgcggccaggacccgcggagccggtccccgagcgcggggagcggggccgcccgcgccgccccaccattacctccccgggcggcaaggaggagctggtggcggtcgcctcccggctgtggcagcggcggcggcgtgccgctgctgctgcaggcggcgccccgaggcgccgcgcactatgagatgatgggcacctgccgcatgatctgcgacccttacactgccgcgcccggcggggagcccccgggtgcaaaggcgcagccacccggacccagcaccgccgccctggaagtcatgcaggacctcagcgccaaccctcctcctcctttcatccagggacccaagggcgacccggggcgaccgggcaagccagggccgcgggggccccctggagagccgggcccgcctggacccaggggccctccgggagagaagggcgactcggggcggcccgggctgccagggctgcaactgacggcgggcacggccagcggcgtcggggtggtgggcggcggggccggggtaggtggcgattccgagggtgaagtgaccagtgcgctgagcgccaccttcagcggccccaagatcgccttctatgtgggtctcaagagcccccacgaaggctatgaggtgctgaagttcgatgacgtggtcaccaacctcggcaatcactatgaccccaccacgggcaagttcagctgccaggtacgcggcatctacttcttcacctaccacatcctcatgcgcggcggcgacggcaccagcatgtgggcggacctctgcaagaacgggcaggtccgggccagcgccattgcacaggacgccgaccagaactacgactacgccagtaacagcgtggtgctgcacttggattcaggggacgaagtgtatgtgaagctggatggcgggaaggctcacggaggcaataataacaagtacagcacgttctcgggctttcttctgtacccggattaggggcgcggggggtgcgaggcggggtggctgcaggccgcccggtctccgcccgggcgcggctccttggcaaaggccactctcgattcataacacttcctgacatctcctttggaaaagacaaatccctgcgtcctccctgccccgctcctggcctcagtgcgtctgcgacccaccacgctcagggctgtgctcctggtctccatccccatcccggcaagggaggaagggacgcccgagcccttgaggcggcggcacagactttgcaaacctgattagactggacaggcagggccgggagcctgccctcctcagacagcctcctcccagtgcctagaagcggagggctccgggccctggccagggaggtaggccagagggagcgcgggcttcctggggcgtccttctttgtgacccgaaatacttgtgcagatttccctgtccatcagccaaaaccccacccacagcagaattccagcaaacagaaaattcacctctccacaccgcattccctcctgactcagactcaccgcgatgcattaaattatgtttttagactatgcgttctgttgtctgtatgtcgacacatcctggaccagggctccagatggcctgctgaccactttctcttagaacagctctcccttttctcctctagggctcagctggcacatgatttccagtagtccccccacagccctggtgctccatggcttctcttctccccaccctgggggccagagaaccctgctgagagcctctctgcatggcagttatgacactgttgtaatcctgtgtcaggtggtctgtcttccccatggactgtagacttcacaagggcgctacctggtgtctgtgtgggccaccagagaatattctctgcccccagcacttctaatggtgcctggcacacagtaggtgctcaataaatagtttcagaatggatggatagagggatggaggcatcctgggggatcttgagaaggtaaatcttgaaaacattttgacttcacaatgggatcatagggggttgtcccagcaagctgaatcactgctttctaaccaatgagtctccatctatcccccactgtcacccctagccccgagtttttaaggttggggtgaaagggggcagatatatgtaaaggtgcatttattacaatctttgggtccctggttacatctttaggaatgaccaaaaccttctagctgacacaagcttatgaccactgccatactgcagcttctgggctgctttagcctcccccttggggccttggggatgaccctctgtattctggagcttcttgggcagtagcctcatttccagtagggtcccttggttggtgcttttgctgtgaggattctttcattttcttgaaacgaaaaacatcttttgaaaaattgttgacataatatgcagtagcaaaaaatccaaacaacacagagaaatataaaagagcaaaaattccctctcccttactgcaatgtccttccccagagacaatttgttaacagcttgacttgtattctttcagacttttagaatgcccatatgtgtggctctgaacacgcagagtgtaaaattctaaacactgctccacacctgggtcccccttcatgcttactctcggacaactcagcggtgcacatagagcccctgtttcttttgaccgaggtgcattcattgtactgttgatgatgacctttaataggaggaacaaatcttccaccactgggtctgtgagctgcttccagcattccctggtctagtggaggaagagtctgctgatagcttcctctttcacttatgtgttctgccttcatgtgggaaagtactactttatttccaaatcagtataaacaaggtctttatccaatgtacaaatgattctgcccttgatttctaccttgtggtatatttcctatactcagtagcccctcttct

SEQ ID NO: 463365 - DNA, 4678 bp, Homo sapiens
tgtgttgcactgagccgctgtctccaggccgaggcccagcagtgaggccggggacctgtttatagggcctggggcttccagaagggagtgactcccagttgggtcccccatctgtgagccagacacctgaggacaggcctctctcagtgcctacgggctggcagacagctgcctggcaacagcaggtatctaactggtgtgctggccatgggctgatggtggacctgccttctgcacctgtttggggggtcactatagggcaggcctgctttacacagcaggtgaagactggtcaacattgtcacgctgagaagtgactctcagtggtgggagcccttcaagagcactggccacgtcttgttcaccctggcatccctagtgaggcctggcccaagacctcgctgtcttgtccttgggtgacatgagggccggtcttaggtgtcgacttggctaggctacaatccccagttattccatcaacactaatctaggagttgctgtggaggacgcagaggggcatgaggggcgagggtccctggaagacacagtccgttggggaaactcccacgccaagctcagcgcccccctccccgcccagctctgatggccggcctgcccttgctcctgcactggtggcccccaggtctggacccacttgcattccccccacgtccctagtgtcacgccgcagcccagccctgcggctccctcactgctcctctcagggacagaggccgtggctgccttgtgtttcctgcagaatcttcccagcctgtccagggagatgtttctctccttctcctcctcctcctcctcctcctccttcttcttcttcttcttcctccccttcctcttcctcttcttctttggaattaaatgggacttgggctctggagaaagcaagcccagacactgcaacaagctcacagctccatgaagatccagccagggccagccccttagaggccaggggatggattaggtgaccccagaggagccctgctgacacctggattccagctgctttcgtggccatgtgggggtggctgtgcgtgccccgccactgcgtgcgtgggtgtctgtgtgtgttatcggtggggggcgcgtgagtgtggccgcgggtgggtgtgtccgatgtgccccggcttgggaccgcgcccgctgcgcccacttgtggctcctgggagccgccagggggaaccgcgccttcaccgcctctgccgaggacgccgccagataggaggctgatgacatgagggctccgtctcccgagtgatggcagcgcgcgctgcttcgccgcctccgccgctcagccccggactccttacgtcagggtagcggggtcccccctccgcgcgggagccagcgaacagcgagagagcacagcagagcgcgccgcggagccggggcgccctcactgcgctaggagccccactaaacccagcggagcggagcctggcgggaggcagcgccgcggagccagcgccggacgccgcaagcagactccccggccagcgcaagcactccctggccggcgccggaccctcggggcgccggattcgtcttgtgtgccccacgtcatgcgcgcgggcgtccgcggctctcccgaccagccccagcgcggtgggcccaggctcagaggtcccggcgcctctcgctgaagtagttgggtagccggggctgggggtcgccacgtcgggggcgcggccaggacccgcggagccggtccccgagcgcggggagcggggccgcccgcgccgccccaccattacctccccgggcggcaaggaggagctggtggcggtcgcctcccggctgtggcagcggcggcggcgtgcctgcctggcggccgtcggcgtactcttggccatggcgctcgggctgctcatcgccgtgccgctgctgctgcaggcggcgccccgaggcgccgcgcactatgagatgatgggcacctgccgcatgatctgcgacccttacactgccgcgcccggcggggagcccccgggtgcaaaggcgcagccacccggacccagcaccgccgccctggaagtcatgcaggacctcagcgccaaccctcctcctcctttcatccagggacccaagggcgacccggggcgaccgggcaagccagggccgcgggggccccctggagagccgggcccgcctggacccaggggccctccgggagagaagggcgactcggggcggcccgggctgccagggctgcaactgacggcgggcacggccagcggcgtcggggtggtgggcggcggggccggggtaggtggcgattccgagggtgaagtgaccagtgcgctgagcgccaccttcagcggccccaagatcgccttctatgtgggtctcaagagcccccacgaaggctatgaggtgctgaagttcgatgacgtggtcaccaacctcggcaatcactatgaccccaccacgggcaagttcagctgccaggtacgcggcatctacttcttcacctaccacatcctcatgcgcggcggcgacggcaccagcatgtgggcggacctctgcaagaacgggcaggtccgggccagcgccattgcacaggacgccgaccagaactacgactacgccagtaacagcgtggtgctgcacttggattcaggggacgaagtgtatgtgaagctggatggcgggaaggctcacggaggcaataataacaagtacagcacgttctcgggctttcttctgtacccggattaggggcgcggggggtgcgaggcggggtggctgcaggccgcccggtctccgcccgggcgcggctccttggcaaaggccactctcgattcataacacttcctgacatctcctttggaaaagacaaatccctgcgtcctccctgccccgctcctggcctcagtgcgtctgcgacccaccacgctcagggctgtgctcctggtctccatccccatcccggcaagggaggaagggacgcccgagcccttgaggcggcggcacagactttgcaaacctgattagactggacaggcagggccgggagcctgccctcctcagacagcctcctcccagtgcctagaagcggagggctccgggccctggccagggaggtaggccagagggagcgcgggcttcctggggcgtccttctttgtgacccgaaatacttgtgcagatttccctgtccatcagccaaaaccccacccacagcagaattccagcaaacagaaaattcacctctccacaccgcattccctcctgactcagactcaccgcgatgcattaaattatgtttttagactatgcgttctgttgtctgtatgtcgacacatcctggaccagggctccagatggcctgctgaccactttctcttagaacagctctcccttttctcctctagggctcagctggcacatgatttccagtagtccccccacagccctggtgctccatggcttctcttctccccaccctgggggccagagaaccctgctgagagcctctctgcatggcagttatgacactgttgtaatcctgtgtcaggtggtctgtcttccccatggactgtagacttcacaagggcgctacctggtgtctgtgtgggccaccagagaatattctctgcccccagcacttctaatggtgcctggcacacagtaggtgctcaataaatagtttcagaatggatggatagagggatggaggcatcctgggggatcttgagaaggtaaatcttgaaaacattttgacttcacaatgggatcatagggggttgtcccagcaagctgaatcactgctttctaaccaatgagtctccatctatcccccactgtcacccctagccccgagtttttaaggttggggtgaaagggggcagatatatgtaaaggtgcatttattacaatctttgggtccctggttacatctttaggaatgaccaaaaccttctagctgacacaagcttatgaccactgccatactgcagcttctgggctgctttagcctcccccttggggccttggggatgaccctctgtattctggagcttcttgggcagtagcctcatttccagtagggtcccttggttggtgcttttgctgtgaggattctttcattttcttgaaacgaaaaacatcttttgaaaaattgttgacataatatgcagtagcaaaaaatccaaacaacacagagaaatataaaagagcaaaaattccctctcccttactgcaatgtccttccccagagacaatttgttaacagcttgacttgtattctttcagacttttagaatgcccatatgtgtggctctgaacacgcagagtgtaaaattctaaacactgctccacacctgggtcccccttcatgcttactctcggacaactcagcggtgcacatagagcccctgtttcttttgaccgaggtgcattcattgtactgttgatgatgacctttaataggaggaacaaatcttccaccactgggtctgtgagctgcttccagcattccctggtctagtggaggaagagtctgctgatagcttcctctttcacttatgtgttctgccttcatgtgggaaagtactactttatttccaaatcagtataaacaaggtctttatccaatgtacaaatgattctgcccttgatttctaccttgtggtatatttcctatactcagtagcccctcttct

SEQ ID NO: 463366 - DNA, 3778 bp, Homo sapiens
tgaacctggtacctcagttggaaatgcagaaatcacccgtcttctgcatcgttcatgctgggtgctatagactggagctggttccattaacttcaaatgatgatgaagatgaagataaagagaaaatgcagtgtgacaacaatattaaatcaaagacattacctgatattccctcttcaggatcaacaacacaacctttatcaactcaggataattcggaagtgttatttcttaaagaaaataatcaaaatgtatatggtttagatgattcagaacatatttcttctatagttgatgtacctcccagagaaagccattcccactcagaccaaagttctaagacttctctaatgagtgagatgagaaacgcccagtctattggccgcagatgggagaaaccatctcctagtaatgtgactgaaaggaagaagcgtgggtcatcttgggaatcaaataatctttctgcagacactccctgtgcaacagttttagataaacaacacatttcaagtccagaattaaattgcaataatgagataaatggtcatactaatgaaacaaatactgaaatgcaaagaaataaacaggatcttcctggcttatcttctgagtctgccagagaacctaatgcagagtgcatgaatcaaattgaggataatgatgactttcaattgcagaaaactgtgtatgatgctgacatggatttaactgctagtgaagtcagcaaaattgtcacagtctcaacaggcattaaaaagaaaagtaataaaaaaacaaatgaacatggaatgaaaactttcagaaaagtgaaagattccagctctgaaaaaaagagagaaagatcaaagagacagtttaaaaatagttcagatgtcgatattggggaaaagattgaaaacaggacagaaagatctgatgtcctggatggcaaaaggggtgcagaagatcccggttttattttcaataatgaacagctggctcagatgaatgaacagctggctcaggtgaatgaactaaagaaaatgacccttcaaactggctttgaacaaggtgacagagaaaatgtactgtgtaataaaaaggagaaaagaataacaaatgagcaagaggaaacatactctttatcccaaagttcaggtaaatttcaccaggagagtaaatttgataagggtcagaattccctaacttgtaataaaagtaaagcttctagacagacatttgtgattcacaaattagaaaaagataacttactcccaaaccaaaaggataaagtaaccatttatgaaaacctagacgtcacaaatgaatttcacacagccaatctttccaccaaagataatggaaatttatgtgattatgggacccacaatatattggatttgaaaaagtatgtcactgatattcaaccctcagagcaaaatgaatcaaacattaataagcttagaaagaaagtaaaccggaagacagaaataatttctggaatgaaccacatgtatgaggataatgataaagatgtggtgcatggcctaaaaaaaggtaatttttttttcaaaacccaagaggataaagaacctatctctgaaaacatagaagtttccaaagagcttcaaatcccagctctttctactagagataatgaaaatcaatgtgactataggacccagaatgtgttgggtttgcaaaagcagatcaccaatatgtaccccgttcagcaaaatgaatcaaaagttaataagaagcttaggcagaaagtaaatcggaagacagaaataatttctgaagtgaatcatttagataatgacaaaagtatagaatacacagttaaaagtcactcactctttttaacgcaaaaagataaggaaatcatccctggaaacctagaagacccaagtgagtttgaaacacctgctctttctaccaaagatagtggaaacctgtatgattctgagattcaaaatgttttgggggtgaaacatggccatgatatgcaacctgcttgtcaaaatgattcaaaaataggtaagaagcctagactaaatgtatgtcaaaagtcagaaataattcctgaaaccaaccaaatatatgagaatgataacaaaggtgtacatgacctagaaaaagataacttcttctctctaaccccaaaggataaagaaacaatttctgaaaatctacaagtcacaaatgaatttcaaacagttgatcttctcatcaaagataatggaaatttatgtgattatgacacccagaatatattggagttgaaaaagtatgttactgataggaaatctgctgagcaaaatgaatcaaaaataaataagctcaggaataaagtgaattggaagacagaaataatttctgaaatgaaccagatatatgaggataatgataaagatgcacatgtccaagaaagctatacaaaagatcttgattttaaagtaaataaatctaaacaaaaacttgaatgccaagacattatcaataaacactatatggaagtcaacagtaatgaaaaggaaagttgtgatcaaattttagattcctacaaagtagttaaaaaacgtaagaaagaatcatcatgcaaggcaaagaacattttgacaaaagctaagaacaaacttgcttcacagttaacagaatcttcacagacatctatctccttagaatctgatttaaaacatattactagtgaagcagattctgatccaggaaacccagttgaactatgtaagactcagaagcaaagcactaccactttgaataaaaaagatctcccttttgtggaagaaataaaagaaggagagtgtcaggttaaaaaggtaaataaaatgacatctaagtcaaagaaaaggaagacctccatagatccttctccagagagccatgaagtaatggaaagaatacttgacagcgttcagggaaagtctactgtatctgaacaagctgataaggaaaacaatttggagaatgagaaaatggtcaaaaataagccagacttttacacaaaggcatttagatctttgtctgagatacattcacctaacatacaagattcttcctttgacagtgttcgtgaaggtttagtacctttgagcgtttcttctggtaaaaatgtgataataaaagaaaattttgccttggagtgctccccagcctttcaagtaagtgatgatgagcatgagaagatgaacaagatgaaatttaaagtcaaccggagaacccaaaaatcaggaataggtgatagaccattacaggacttgtcaaataccagttttgtttcaaataacactgctgaatctgaaaataagtcagaagatctatcttcagaacggacaagcagaagaagaaggtgtactcctttctattttaaagagccaagcctcagagacaagatgagaagatgaagtgaatttatggattctggtttttctgaattttcaaagcataaggaatcaaaacagaaatatagtatcaagaagatgaaatgcttaatgaaaaggttttttttttgtttctttggcctttcatggagtgttgatttgtccattcttaatgtttattaataggtatatgtgcataaaatagctattttgtaacattaaactttttgagtcattttggtcatcatataacttaccttcctgtttatttaagcttctttttacctagtagcctttaaccaaacaataaccttttaaccaaataaaatgtgttaataaatacctttgcattggttatcttgtatactaggctgtcttgttttgctgtctgtttttaa

SEQ ID NO: 463367 - DNA, 3628 bp, Homo sapiens
tgaacctggtacctcagttggaaatgcagaaatcacccgtcttctgcatcgttcatgctgggtgctatagactggagctggttccattaacttcaaatgatgatgaagatgaagataaagagaaaatgcagtgtgacaacaatattaaatcaaagacattacctgatattccctcttcaggatcaacaacacaacctttatcaactcaggataattcggaagtgttatttcttaaagaaaataatcaaaatgtatatggtttagatgattcagaacatatttcttctatagttgatgtacctcccagagaaagccattcccactcagaccaaagttctaagacttctctaatgagtgagatgagaaacgcccagtctattggccgcagatgggagaaaccatctcctagtaatgtgactgaaaggaagaagcgtgggtcatcttgggaatcaaataatctttctgcagacactccctgtgcaacagttttagataaacaacacatttcaagtccagaattaaattgcaataatgagataaatggtcatactaatgaaacaaatactgaaatgcaaagaaataaacaggatcttcctggcttatcttctgagtctgccagagaacctaatgcagagtgcatgaatcaaattgaggataatgatgactttcaattgcagaaaactgtgtatgatgctgacatggatttaactgctagtgaagtcagcaaaattgtcacagtctcaacaggcattaaaaagaaaagtaataaaaaaacaaatgaacatggaatgaaaactttcagaaaagtgaaagattccagctctgaaaaaaagagagaaagatcaaagagacagtttaaaaatagttcagatgtcgatattggggaaaagattgaaaacaggacagaaagatctgatgtcctggatggcaaaaggggtgcagaagatcccggttttattttcaataatgaacagctggctcagatgaatgaacagctggctcaggtgaatgaactaaagaaaatgacccttcaaactggctttgaacaaggtgacagagaaaatgtactgtgtaataaaaaggagaaaagaataacaaatgagcaagaggaaacatactctttatcccaaagttcaggtaaatttcaccaggagagtaaatttgataagggtcagaattccctaacttgtaataaaagtaaagcttctagacagacatttgtgattcacaaattagaaaaagataacttactcccaaaccaaaaggataaagtaaccatttatgaaaacctagacgtcacaaatgaatttcacacagccaatctttccaccaaagataatggaaatttatgtgattatgggacccacaatatattggatttgaaaaagtatgtcactgatattcaaccctcagagcaaaatgaatcaaacattaataagcttagaaagaaagtaaaccggaagacagaaataatttctggaatgaaccacatgtatgaggataatgataaagatgtggtgcatggcctaaaaaaaggtaatttttttttcaaaacccaagaggataaagaacctatctctgaaaacatagaagtttccaaagagcttcaaatcccagctctttctactagagataatgaaaatcaatgtgactataggacccagaatgtgttgggtttgcaaaagcagatcaccaatatgtaccccgttcagcaaaatgaatcaaaagttaataagaagcttaggcagaaagtaaatcggaagacagaaataatttctgaagtgaatcatttagataatgacaaaagtatagaatacacagttaaaagtcactcactctttttaacgcaaaaagataaggaaatcatccctggaaacctagaagacccaagtgagtttgaaacacctgctctttctaccaaagatagtggaaacctgtatgattctgagattcaaaatgttttgggggtgaaacatggccatgatatgcaacctgcttgtcaaaatgattcaaaaataggtaagaagcctagactaaatgtatgtcaaaagtcagaaataattcctgaaaccaaccaaatatatgagaatgataacaaaggtgtacatgacctagaaaaagataacttcttctctctaaccccaaaggataaagaaacaatttctgaaaatctacaagtcacaaatgaatttcaaacagttgatcttctcatcaaagataatggaaatttatgtgattatgacacccagaatatattggagttgaaaaagtatgttactgataggaaatctgctgagcaaaatgaatcaaaaataaataagctcaggaataaagtgaattggaagacagaaataatttctgaaatgaaccagatatatgaggataatgataaagatgcacatgtccaagaaagctatacaaaagatcttgattttaaagtaaataaatctaaacaaaaacttgaatgccaagacattatcaataaacactatatggaagtcaacagtaatgaaaaggaaagttgtgatcaaattttagattcctacaaagtagttaaaaaacgtaagaaagaatcatcatgcaaggcaaagaacattttgacaaaagctaagaacaaacttgcttcacagttaacagaatcttcacagacatctatctccttagaatctgatttaaaacatattactagtgaagcagattctgatccaggaaacccagttgaactatgtaagactcagaagcaaagcactaccactttgaataaaaaagatctcccttttgtggaagaaataaaagaaggagagtgtcaggttaaaaaggtaaataaaatgacatctaagtcaaagaaaaggaagacctccatagatccttctccagagagccatgaagtaatggaaagaatacttgacagcgttcagggaaagtctactgtatctgaacaagctgataaggaaaacaatttggagaatgagaaaatggtcaaaaataagccagacttttacacaaaggcatttagatctttgtctgagatacattcacctaacatacaagattcttcctttgacagtgttcgtgaaggtttagtacctttgagcgtttcttctggtaaaaatgtgataataaaagaaaattttgccttggagtgctccccagcctttcaagtaagtgatgatgagcatgagaagatgaacaagatgaaatttaaagtcaaccggagaacccaaaaatcaggaataggtgatagaccattacaggacttgtcaaataccagttttgtttcaaataacactgctgaatctgaaaataagtcagaagatctatcttcagaacggacaagcagaagaagaaggtgtactcctttctattttaaagagccaagcctcagagacaagatgagaagatgaagtgaatttatggattctggtttttctgaattttcaaagcataaggaatcaaaacagaaatatagtatcaagaagatgaaatgcttaatgaaaaggttttttttttgtttctttggcctttcatggagtgttgatttgtccattcttaatgtttattaataggtatatgtgcataaaatagctattttgtaacattaaactttttgagtcattttggtcatcat

SEQ ID NO: 463368 - DNA, 3718 bp, Homo sapiens
tgaacctggtacctcagttggaaatgcagaaatcacccgtcttctgcatcgttcatgctgggtgctatagactggagctggttccattaacttcaaatgatgatgaagatgaagataaagagaaaatgcagtgtgacaacaatattaaatcaaagacattacctgatattccctcttcaggatcaacaacacaacctttatcaactcaggataattcggaagtgttatttcttaaagaaaataatcaaaatgtatatggtttagatgattcagaacatatttcttctatagttgatgtacctcccagagaaagccattcccactcagaccaaagttctaagacttctctaatgagtgagatgagaaacgcccagtctattggccgcagatgggagaaaccatctcctagtaatgtgactgaaaggaagaagcgtgggtcatcttgggaatcaaataatctttctgcagacactccctgtgcaacagttttagataaacaacacatttcaagtccagaattaaattgcaataatgagataaatggtcatactaatgaaacaaatactgaaatgcaaagaaataaacaggatcttcctggcttatcttctgagtctgccagagaacctaatgcagagtgcatgaatcaaattgaggataatgatgactttcaattgcagaaaactgtgtatgatgctgacatggatttaactgctagtgaagtcagcaaaattgtcacagtctcaacaggcattaaaaagaaaagtaataaaaaaacaaatgaacatggaatgaaaactttcagaaaagtgaaagattccagctctgaaaaaaagagagaaagatcaaagagacagtttaaaaatagttcagatgtcgatattggggaaaagattgaaaacaggacagaaagatctgatgtcctggatggcaaaaggggtgcagaagatcccggttttattttcaataatgaacagctggctcagatgaatgaacagctggctcaggtgaatgaactaaagaaaatgacccttcaaactggctttgaacaaggtgacagagaaaatgtactgtgtaataaaaaggagaaaagaataacaaatgagcaagaggaaacatactctttatcccaaagttcaggtaaatttcaccaggagagtaaatttgataagggtcagaattccctaacttgtaataaaagtaaagcttctagacagacatttgtgattcacaaattagaaaaagataacttactcccaaaccaaaaggataaagtaaccatttatgaaaacctagacgtcacaaatgaatttcacacagccaatctttccaccaaagataatggaaatttatgtgattatgggacccacaatatattggatttgaaaaagtatgtcactgatattcaaccctcagagcaaaatgaatcaaacattaataagcttagaaagaaagtaaaccggaagacagaaataatttctggaatgaaccacatgtatgaggataatgataaagatgtggtgcatggcctaaaaaaaggtaatttttttttcaaaacccaagaggataaagaacctatctctgaaaacatagaagtttccaaagagcttcaaatcccagctctttctactagagataatgaaaatcaatgtgactataggacccagaatgtgttgggtttgcaaaagcagatcaccaatatgtaccccgttcagcaaaatgaatcaaaagttaataagaagcttaggcagaaagtaaatcggaagacagaaataatttctgaagtgaatcatttagataatgacaaaagtatagaatacacagttaaaagtcactcactctttttaacgcaaaaagataaggaaatcatccctggaaacctagaagacccaagtgagtttgaaacacctgctctttctaccaaagatagtggaaacctgtatgattctgagattcaaaatgttttgggggtgaaacatggccatgatatgcaacctgcttgtcaaaatgattcaaaaataggtaagaagcctagactaaatgtatgtcaaaagtcagaaataattcctgaaaccaaccaaatatatgagaatgataacaaaggtgtacatgacctagaaaaagataacttcttctctctaaccccaaaggataaagaaacaatttctgaaaatctacaagtcacaaatgaatttcaaacagttgatcttctcatcaaagataatggaaatttatgtgattatgacacccagaatatattggagttgaaaaagtatgttactgataggaaatctgctgagcaaaatgaatcaaaaataaataagctcaggaataaagtgaattggaagacagaaataatttctgaaatgaaccagatatatgaggataatgataaagatgcacatgtccaagaaagctatacaaaagatcttgattttaaagtaaataaatctaaacaaaaacttgaatgccaagacattatcaataaacactatatggaagtcaacagtaatgaaaaggaaagttgtgatcaaattttagattcctacaaagtagttaaaaaacgtaagaaagaatcatcatgcaaggcaaagaacattttgacaaaagctaagaacaaacttgcttcacagttaacagaatcttcacagacatctatctccttagaatctgatttaaaacatattactagtgaagcagattctgatccaggaaacccagttgaactatgtaagactcagaagcaaagcactaccactttgaataaaaaagatctcccttttgtggaagaaataaaagaaggagagtgtcaggttaaaaaggtaaataaaatgacatctaagtcaaagaaaaggaagacctccatagatccttctccagagagccatgaagtaatggaaagaatacttgacagcgttcagggaaagtctactgtatctgaacaagctgataaggaaaacaatttggagaatgagaaaatggtcaaaaataagccagacttttacacaaaggcatttagatctttgtctgagatacattcacctaacatacaagattcttcctttgacagtgttcgtgaaggtttagtacctttgagcgtttcttctggtaaaaatgtgataataaaagaaaattttgccttggagtgctccccagcctttcaagtaagtgatgatgagcatgagaagatgaacaagatgaaatttaaagtcaaccggagaacccaaaaatcaggaataggtgatagaccattacaggacttgtcaaataccagttttgtttcaaataacactgctgaatctgaaaataagtcagaagatctatcttcagaacggacaagcagaagaagaaggtgtactcctttctattttaaagagccaagcctcagagacaagatgagaagatgaagtgaatttatggattctggtttttctgaattttcaaagcataaggaatcaaaacagaaatatagtatcaagaagatgaaatgcttaatgaaaaggttttttttttgtttctttggcctttcatggagtgttgatttgtccattcttaatgtttattaataggtatatgtgcataaaatagctattttgtaacattaaactttttgagtcattttggtcatcatataacttaccttcctgtttatttaagcttctttttacctagtagcctttaaccaaacaataaccttttaaccaaataaaatgtgttaata

SEQ ID NO: 463369 - DNA, 544 bp, Homo sapiens
agtattctgctttagcagctggttgttgaggctactgaggtggtcaaccctctcctggagcctgtggagcaccgagatgggaaagttttcatgcctgggaacaaggtccttttgcacctcaacctcatccggaaccgcatcacagaggtggggctggagggcttcctcgccacggtgcagtatcagatgcagttctccaaggccaagagtgcatccaagggtccagtggggctgctgtggctgtccctggctaaaaattgcttcgccccacaatgtcctgcgtacgccataatccaggagctgatgttgccaagggatcccatcaaggccaaactcagggaggatgaggccatggcattcttcccctagccccctcccacctgcttgcctctaagactcggggctacagaagcacctcctgtccctgtgtggggtgacctccctgggggagatctcagaccaataacaaagtctgttgctatacttttccttgaggtcgtctgaaaactttcttccagaactacttggaacatttagattttgc

SEQ ID NO: 463370 - DNA, 482 bp, Homo sapiens
tgtctggtgtgtcaggtgccaatgaggcctgtggtgctaagaggccacctgtctgtaacttccaccagggaaccgcatcacagaggtggggctggagggcttcctcgccacggtgcagtatcagatgcagttctccaaggccaagagtgcatccaagggtccagtggggctgctgtggctgtccctggctaaaaattgcttcgccccacaatgtcctgcgtacgccataatccaggagctgatgttgccaagggatcccatcaaggccaaactcagggaggatgaggccatggcattcttcccctagccccctcccacctgcttgcctctaagactcggggctacagaagcacctcctgtccctgtgtggggtgacctccctgggggagatctcagaccaataacaaagtctgttgctatacttttccttgaggtcgtctgaaaactttcttccagaactacttggaacatttagattttgc

SEQ ID NO: 463371 - DNA, 1772 bp, Homo sapiens
acgccaccgcggacgggtcggatccggtccctggacgcggaacagagatcccctgattcagccacccccagactgagccccgtagagtgcgttcttaccttcctgccccgacgaaggtcccagagacgctgcggacaacaccagcatgtcgagcgagcagagcgcgccgggggcctcacccagggccccgcgtccggggacccagaagtcttctggcgcggtgaccaaaaagggagagcgcgcggccaaagagaagccagcgaccgttctgcctcccgtgggggaggaggagcccaaaagccctgtgctggtggatggggagaaggaattataggagctggagaaacaacatcttctggaagggaagacaagacagtatacaatcccctacagaggagtaccagtgctccggggtcctcgagaccgacttcgccgagctctgcacgcggtggggctacacggacttccccaaagttgtcaaccggccccgcccccacccgcccttcgtcccctccgcctctttgtcggaaaaggccaccttagacgatccgcggctgtcggggtcctgcagcctcaatagcctggagagcaaatacgtgttcttccggcccaccatccaggtggagctggagcaggaggacagcaagtcagtgaaggaaatctacatccgcggttggaaggttgaggaacggattctgggtgtcttctctaaatgtctgcccccgcttacccagctacaggccatcaacttgtggaaggtggggctgaccgataagaccctgaccaccttcatcgagctcctgcctctctgttcatccacgctcaggaaggtgtctctggaggggaacccactgccggagcagtcctatcacaagctcatggccttggacagcactccccgcccttccttgtccccctaccatctcggcaagggccctcgatttctgcccctacatcctcagaccagaccgccccctcaagcgctcaagtctcccatattccggcggacgccctgtaccttttccagcgacccacattctccctccggctgccccaggattgcgcacttgtctctgcggaacaataacatcgacgaccgcggggcgcaactcctgggccaggcgctgtccacgctgcacagctgcaaccggaccctcgtctcgctcaacctgggtttcaaccacatcggtgacgagggcgcaggctacatcgcggacggcctccggctgaaccgttccctgctctggctgtccctggcccacaaccgcatccaggacaagggcgccctgaagctggctgaggtcctgcgcgccttcgagctgacacacaccgaagtggtggagcgccgacgcctcctgctggaaaaagggacacaggagcgctcgcgatcgaggtaaccatccctgaacagaagccaagcagggcaaaagggatcaagatcgggagcagagagaagcgcagcatcctcctggagtccgagaaaaattgcttcgccccacaatgtcctgcgtacgccataatccaggagctgatgttgccaagggatcccatcaaggccaaactcagggaggatgaggccatggcattcttcccctagccccctcccacctgcttgcctctaagactcggggctacagaagcacctcctgtccctgtgtggggtgacctccctgggggagatctcagaccaataacaaagtctgttgctatacttttccttgaggtcgtctgaaaactttcttccagaactacttggaacatttagattttgc

SEQ ID NO: 463372 - DNA, 3841 bp, Homo sapiens
ggggcatttcccacggatgtctaaaaagtctgaggacagtctcctgtactctctccggggtacactaacactgttgatgcttggcagggtggcaagtatacagagtgaacctggtcaacagaacctccttgttcagcagccgctggggaggaagaggggcctgaggcagctaagacgtcctctactatcacgtcagaaaactcagactgaacccagaaatcgccaaggggctcggctgtcaaccactcgcaggagcattcaacctaaaacgaagccgtctgcggatcagaaacgatctgtgaccttcattgaggctcagccagagccagcagctgccccaacagatgcgcttcctgcaacaggccaactacagggctgtagcccagccccttctaggaaaccagaagcaatggacgaaccagtcctcacatcttctcccgccatagttgttgcggatctccacagcgtgtctcccaagcagagtgagaacttccccactgaagaaggagaaaaggaggaggacacagaagcacaaggtgctactgcacacagtccactctctgcccaactctctgaccctgatgacttcacaggcctcgagacatccagcctcctacagcatggagacactgtccttcatatcagtgaggaaaatggcatggagaacccgctactatctagtcagttcacctttactcccactgagctggggaaaacggatgcagtattagatgagtctcatgtttaattctgtatcttgtaagctctgcaggtatagagaagacatgaaagtgatctctctactacaagttcaatacttttgcttgaaaaagattaattacaaaatagcactttacttctaatgggtggcacaaatctgaataggttttgctgccaatacacatgatgtttcataaacatcttaaaagtcaatggctaaaaggatttagttgtgtgaaaatcacaaaaccagggaggaataagcggaaagagccatttcactgcacattgtttatgattcaagaagccttcagcagttaaaaatatatactattcattgctgctttcatagaaatattaacaaatgatatgatctaaaaatagaatgcaattttttgagattactcacattatacatctcatgcaaatatttatttttatagtttaaaaaatatcaattcaggttggctatacaagtagcaatttacataaaaaaataattaataggaaaaatattactttggggagactaaataacaagcctgcagccatttttgttttgagtaacaatacagccatttagaagaagaaaaaaatactatatagagagctgtggacttttagatatttatttttcaactatcattttcattgcatgttgtaaatcaaaatgcagatggcataagatcatcccatttcataatctatcacattagaatattacagaatattctagaaatcatcagaaataattctgaattaagaacctaaacagcctatacaattataaaaactaaatgtatatataatcacttaaaagagatggtattcctattcctagccctgactacatcaataccaagattagaagctattggaaaatgtgattagtaatacttttccttatagtatcctgtgcctgccctggagggcatattttcagatattaaggttagtgttgttagaatcggtttaataaaataacattttcctaatagaaacaatattcttatgatacttggaacatctaagtttataaggaaaaatgtataaagtaagcaatttcttcatagacacctccagtttatatattttgcaaataggcctttaacttgaagttcaattacttcaagaaaagtgtaacacttagaaggcttgtgaggccaacacctagtgtgttactgatcctatggtagggctgtgcatcacgtggttcacaattgaatttcaaaattttaacagtttacattagaaaactgttacctaacaaccaagcatatacaaactcatatacatacttaaattggtacggtggtgtatgtgtgcgtgcgtgtgtgtgtgtatgtgttgtagtcctcaagatgaagttaaatatagactttaattaccctgcaatgaatttaaaacacattctgtatgcttaaactttgagtgcgttggctgtgaaatgtatacatatataaagaggatacctactaaacccaccttaatcataaaggaaaattattttttgttagaattgcttattaaataggcatactttatactgtggtttataatttcaaatataacttggggttatggtcctattcactaagagaatgaaagatatccatgagttaaaagaacaaaactaaaaatttcagatctaacaattgaaagaaaattgaggcagtaaatgacctcttttactcttttatgttttacaatattatcatgttatttacagttaatgctgaaataattctcaagtgcaggaatataaatgttaagtggttttatgattccaagctgatatatttcacctgttaaaaattatgctgctaaattagcattagaggccttatgtttggtaattacaagtgtctgggctattggcgcgtctctatatatgtgtgtgctttgttccagtttcttcaaattatctatgtataattgtatgaaatatttaaatagcaaagaagtcaaagaagattgttaaatattcaacaagaatcataaatacctttatatgtattttaaaagtattgggctgttctgaacatgattatgctggtctgtctgccttttagcctgactccttcactcttgtgtgtgaagtctattagcaactttcaataagctaagcaatgttgtaacttgcaaaaaagcctccactctgagaaacagggccttatagagtaggaatgttttcatactgggactactgaaattttgcagatgtgtgcatctgttccatttaaggtgcccttaaatgtgttgaatgtaatgtgttgaatgtttatgtgtaatggctaaagtatctatatgtatgtgcataaaactgtcacaagatgtattctcaggaatactgttacctggagtttgaaaggaataactattaaaaaaaaaagttggggaagattagaaaaaagctcaagataaatgttcaaaatattattaagtacatgactaaaagctaattactacatatgataaatgcagtgttggtaatagtagatcatttcttaagccatgatacttaatgatatttatcttattcagaggaaaaacaaaaaaggtacccacttcccatgtagaaaaaattagactcagcaaagaggttgcttcttctgaaattagcttttgagagaccttggaataaaccatgtgttatccatgatagtatgactcagatccaattaaaacagtttaaattctggatataggatctcctatagcaaaacattttactttcatttttcagtatttgctgctttctagaattctattagataagctatgtcatttttctgaaaaagaaactgagttattgagtgtattaagacaaggcactgagaactacagtgtcaaaatcaaagggcataaatgggcatggcagtgctggtggaaaaatctgtggtactggtgatctggttagggcctgttgcacaggctgggagtaactggtttgctgtttcaagcctccaagagtaccttaaacaaggtgatagctcctctcttctttagcattatattcctttagtcaacaaagaactttctccactctgctgcccagctctgagagtatctgagatgagaataggatgtgtgtggaggggcttttagggaagaaagggtc

SEQ ID NO: 463373 - DNA, 3396 bp, Homo sapiens
tctggaataccttcaaagaaagacaggcacaaacaagcccagactgtaaagactgcaataaatacctaactcttcaaagcccagaccctgaagaacattcacaagcatcaagaccacccaggaaaacatgacctcaccaaaggaactaaataagacactggtgaccaatcctggagaggcaggtatttgtgggaaatacattgagcagccccactttaatagtcctggtgactcatttgagagaggaactccctcccgtagcctaggattctccctccagggcctgcccatcagcatccttgcatatttagaacgacaccttgggagaaatgcatctcgcagtgacacttcagtgactcagacgctttgtatacagagaaattccagtgactatgaaatgatgaagaaaaacgccgtcattgatctcatgggggcagaaggcatggagggaggtgcttcaggaaacctgcattctcgaaaacttgttagctttacattgtcagatcttagggcagttgggctaaagaaagggatgttcttcaatcctgacccttatcttaagatgtcaattcagccaggaaagaagagcagtttccccacctgtgcccaccacgggcaggagagacggtctactatcatcagtaacaccaccaatccaatttggcaccgagagaaatattccttttttgcacttcttactgatgtcttagaaattgaaattaaagacaaatttgccaagagccgtcccatcatcaagcgttttctggggaaactaaccattccagtccagaggctgctggagcgacaagccatcggctacaaccttggcagaaggctcccagctgaccacgtgagtgggtacctccagtttaaagtggaggttacgtcttctgttcatgaagatgcctctccagaagctgttggcacaatacttggagtcaattctgtgaatggagacttaggtagcccttccgatgacgaggacatgccagggagccatcacgacagccaggtgtgctctaatgggccagtttctgaggacagtgctgccgatggaacccccaagcattcattcaggactagctccactctggaaatagacacagaggaattaacctctacgtcttcaaggacctcacctcccagaggacgtcaggattcactcaatgattacttagatgctatcgaacacaatggccactccaggccggggacagcgacctgctctgagaggtccatgggtgcctctccgaaactgaggagtagttttcccactgacacaagactcaatgccatgcttcatattgattcagatgaagaagatcacgagttccagcaagacctgggttacccatcttccttggaggaggagggaggcctgatcatgtttagcagggcatccagagctgatgatggaagcctgacatctcagacaaagctggaggacaaccctgttgagaatgaggaagcctccacacacgaagctgcttcctttgaggataagccagaaaatcttccagagcttgcagagagctccttacctgcaggcccagccccagaggaaggtgaaggcggcccagagcctcaacccagtgctgaccagggcagtgctgaactgtgtggctctcaagaggtagatcagcccacaagtggcgcagacacagggacttccgatgcatcaggaggaagccgaagagccgtcagtgagaccgagtctctcgatcagggctctgagccttcccaggtgtcctctgaaacagaacccagtgatcctgccaggacagagagtgtgagcgaagccagcaccaggcctgagggagagagtgacctggaatgcgctgacagctcctgcaatgagagtgtgaccacgcagctgtcctctgtggacacacggtgctcctctcttgagagcgcacggtttcctgaaaccccagccttttcttctcaggaggaggaagacggagcctgtgcagcagagcccaccagcagtggccctgccgaagggtcgcaggaatccgtgtgcactgctggttctttacctgtggtacaggtgcccagtggggaggatgaagggccaggggcagaatcggccactgtacctgaccaggaggagctgggggaggtctggcagcggagggggagcctggagggagctgcagctgctgccgagagcccaccgcaagaagaaggcagtgctggggaggcccaaggcacctgtgaaggggcaactgcccaggaggagggcgctactggaggttctcaagccaacggccaccagccactgcgatcactaccttcagtgcgccaggatgttagccggtaccagagggtggacgaggctctcccaccaaactgggaggcacgcattgacagccacggcaggatcttctacgtggatcacgtaaacagaaccacgacgtggcagcgaccgacagctcccccagccccgcaggtgctgcagagatctaactccatacagcaaatggagcagctgaaccggcgatatcagagtatccgcagaaccatgaccaatgagaggcctgaggaaaataccaatgctattgatggggcaggggaggaagctgactttcaccaagccagtgcagatttactgagcactcagcttcgcaagtttgttgatgattatgtgctaggcactgagctaagacctagggatacagagatgacagcaactgtgggccctggcatcccagacttgagagcaattataatgtcataaccagaattacaagtgcaataatggatggctatagaagatacactgctggagtggacgattaactccaaagggaaggcacatggaaggggccatagacaggtttggatttgagattagttttaaaggctgattaagagcttgtcccagaaacaagatgggcaggagtactctaggtagaagaagcatcatttgcaaaacaatcgattcgtgaagctgcaagtctgtcttgataattactgcagaagttctaaaactggattattagtattgtaagcaattcggtgttgctggtgtattgagaacataggacactagtgaaagtcagatttgagcctgggaagggatacagaagctaggctacacaaacctaaactcatatatgggacaattctaggaggtgacaggctttcatgcaaggcagaatgggctaacatttagagttgtcactgtaacacagaaaaaaatcatgctttaataggaagagactcagacttggagtcagaaggcacaagctcccctttgttttttgttcatttgttcatgccttcatttaatcagtatttattaaatgcctgtgatttgcctggtacattctagactctgggaatagagtggtaaataagacagagtagaatatagttaacagactagtgaat

SEQ ID NO: 463374 - DNA, 751 bp, Homo sapiens
cccatagagatgtcttgccctctgttgcactgtgaattggggcaaagaccacatctagagcctaggtctccccaaacccaggcctcctgcatctcctattgtttcagcttgtttctctggtttcctcagccttactccccactctcagaatctgttttggcctcgtatgctgccccctggtcaaaagccctggctgctcgtgcactgataacttcatcttttcggacatctgggaactaccgccacaatgtctggaaaaaaaatgacttcaaactaatgcagcagaggcaaaccatggtttggccaaaaatggaacagaatttacaagggaaaagggaagttcctggagtaatatggtcagatgaggatggaactggtgaatgagcagaagagaaggttggaagagtgcagtggtgatgacagccctccgctgctccttccccagaggaaggagctccaagtttattcacccctcttttaccatgaggcagagggaaaacaatgacaaatacacagtaaacttcgttatcaacaaacagaagttgttaccaaggcaacagaacaagagcatccctgcatccagccatcacagtgtgaagtgagtttcagatgaggagatgccttgaggggcaaggagacccttcaggaaaaagctgacctgataaaggaatcaaggagctgccatcccaactgatgtcttttttccctttctcaataaagagaagagcttgcaagagccctgaaagacaga

SEQ ID NO: 463375 - DNA, 2807 bp, Homo sapiens
ggaggcctggcctctctgtggcactgcccctcacccctctgggctgcagtgactcccagaggtgggatctcattggtccctgagcgcctggcaggactgacaggcgtgggttgatgaacatgaacaggtggggcgggcctacagcaaggagcagcaccagcgcctgtgtgtgtactgtggccgctgctcggccccgggcggtgcactttacctgaaccgtccttccaggcctcccaagccatctgcaggaagtgctgtttccatcccaggcctgagatggtggaaaggctggggactccagggacacagggctggcaggcgggtgaggtgggcaagtacccccggcagtcgggctccggagcccgccttcttgaccaggccgctggcagtgagccagccgggttccgtttccatcgcgggccttatccggggcgtattccttccaggtgcggcctccggggaagcccagtccccagcctggaggtgacgaggccggcgcacccaccaggggtcgctgcaggcaagagctggaggcctgaaggcagtgcggcccccagcaagctgggcctgtgtgctgctcccatggcggccacggcccccttacccaggacaccaccagcccagcagggaggggctgacgccaggtccaaagagtggcccaaaaaaggccctggggcggggatgctgttgggctcggagcctagcgagcaaggggagacgcaggtccaggctggactgggacagatgagagttatgggatctcaggaacagcagctgcaggaagcggctgctacctttagggctgagagggagtcaacaatgaaggaactaagacttccgccccctcgagtggagccccagaccttcaggaggggatgcagctgctgctggaacaccaaaaactgctgctggtggggagatttgccagcccagcccccttggcccagccaaaaggctcccctgaagcagcccccaagcatgagctggtccggactgccctgaggtcctcctgctgccagcttcctcgtgcggaagacagcctgtggatgcctccagttctgcaagagccttccctggctggcacctgggctgatgcagcagatcctcctgtgggcctgggcttccagaggcttcccagtgtgcctgcccgaggtcacatctccagcaggggcagccctgggttgggaacacgggcctctgattccaagcgagctcctccattcctggcggcttcaggagagctcctgggggtgctccgaggcttgttctcctcttctgtctggatgaataagattctggagaatcaaagacaagaggcctgcaattaaattctattttaaacaagaaatgaagacactgcttaaaataagttctgtggagatatgtgaaatgtaatgttaatgaaggtattgggtatttactgagagccaaatactgttgtaagcttgttacaaggtcctgtatcctcaatccttaaaacaactcccttacattggctctggagaggaagccagatggctgctggctttttccttacaaagcaacacctccagacacctggtttgtggctcgggatgccagaaaatggtgctccttttgcacattgcttaattcacagaccctcactatagaatgtaagacagtagaggaaagcatttttccctcccttatagcagtaaggatattcacatcgtgcaactatcaccaccttcctctccagaactctttcattatcccaaactgaaactctatgtccattaaacaataactcaccactcctccttccctccagcccctggcaatcaccgttgtatcatctgtccttttgaatctgactgccttaggctgtagctccctatgccaccacctcgatgccagtcccactccaaccagtaagaaccagagcatctaccccacactgggcatggacactgaaagccaaaacaccctactgtgtgtatgaacctcacttgatgttattcctgtcttcatcagcacgactttattttcccaggagtcaccatcaagcccaggcagatggcttgatagttcttataggaacttctggaaagactcatctactctctgatggaaaacatcaacaggtgctggtgatgctggtggcagctgttgacaccaggcaccacttctgatagctgtcggctgtccagatttcaaaaatctcattgttcttgtcatttgttcctctgggtgtgcaggttgattagtcataatggtaattctatgccttttgctagtggttgtcaaaatgtcgatatgtgacctaattccagccaatagaggttggagtaaatctgcagaggccattacttctgggaaagatgtttctctgtaagaaaagtaattatcaggaggaaatgcccccccccaactggtgtctttttgtgtgatatcaactattcgatggtatgtggctgatgatggttaagtgcaaggatgcaaagctctggggctcagctctgaaaggtcacctccccatcaaagccaggccgcctccatccagcacatctgcatggggccccttggattttgcctgtgggcttgtgcttgtggcaggcctctgcttgcctgtctctctctgtattgttgggctgtgagctctgttttcctgtgtccccctatcctgttgggctgtgagctctgcctccctgtgcccccctgtcctgttgggctgtgagctccctggtgctgcacacttgtcccttactgcccctccccagtgcagtctttacatggtcgggggcatggtggggaagtccctgaaagcagggccgtttcatgaattc

SEQ ID NO: 463376 - DNA, 823 bp, Homo sapiens
ctctgtgtcccacatccagggcacactgacacagggtgcaagctgccaatggatctaccattctgggatctggaggacaatggccctcttcttctcacagctccactaggcagtgtcccagtggagactaaatatgggggttccaaccccacatttcccctctccactgtcctagtagaggttctctgtgagggctctacccctgcaacaagcttctgtctgaatatacaggcttttccatacatcctccatacatacataggcagaggctcccaagcctcaactcttgcattctgtacacccacaggcttaacaccacatgaaagccaccaaagctatggattgcacattttgaagcagctgcctgagctgtacctaggcccctttgagccgaggctggacctggagcagctgggacacagggagcagtgtcccaaggctgtgcagaatgtggtttacactaatttacattcccgctgacagtgtacaaggcttctattttctccacattctcaccagaatttgttttgttttttagaaacaggctcttgttctgtcacccatacttggagtgcagtggtacaatgatagctcactgcagcctcaaactcctggtctcaagcaatcctctcacctcagcctcccagaaaaaaaaggccttatgaagacattgcaaaaggacaactatctgcaaaccaggaagacagacctcaccagaaatcaaccctgctggtggtaccttgatcttagacttccagcctccagaagtatgagaaaataaatatctgtaatttaagtcacctagtctatggtattttgttat

SEQ ID NO: 463377 - DNA, 475 bp, Homo sapiens
ctgacagaaccagagctgttagagcagggacgcgcgaaaggcgggagtacgggcggcgctggagaacctccgcggcggaggggcctgggggtgggaccgcgcccgcgagcccgccctgaccggggtgtctgtgtgcttgtgaagcgctcccttgttagttccttctgtgagactcgggggagactgaagagggaaatcacctgcggggaatgaacaggaaagcaataagaagatttggaaaagaggcactggctactggaggaagggagaaatcaccgagagagcgaaagatgtaacagaaaaaaaaggccttatgaagacattgcaaaaggacaactatctgcaaaccaggaagacagacctcaccagaaatcaaccctgctggtggtaccttgatcttagacttccagcctccagaagtatgagaaaataaatatctgtaatttaagtcacctagtctatggtattttgttat

SEQ ID NO: 463378 - DNA, 857 bp, Homo sapiens
agtggttttcctttgtccctaccccaattaatgattaatttcctttctggttttccacaaacttcaattgtcagttgcctaagtaacaagctgtgggcaaaagaacaaaggcctttgtgggaagtgttcactccccccatacccaatgcaaatattggcatttatcttttgctgggaaccagtatccaaagtcctacagtctatcgtcctggaggcttagctccactcccacacactcagaccactacttacaaactcattttagggatatgcggcttgagacacagagaggttatgcaatgtgtaaaaggtcacacagctagcatatcacgtgcactttcacacacaccaaccacaagtcctttggcagcctctatccagttagaaccttgtgaacaaggtgtgctgtgctccctctcagttgaaggaaagagttggcaaccgggatgctaatttagaagttctaaggtattctccacctgtaatctattgctccagaattctgcaggaacatttgaactggtaaggaaagaatgcctcaagtgagcatgtgtacaactccagtaaacacactgtgcatgcagcctctcccaaattctggcaggctactgggcatgtggaaaacccatcccaagagaagaatcacgggagaaggaatgcaagaacccagaagcatgccaacatataaaaccctgagtcaaagatcaaactgggaacttggatctcttaagtcacctgcttggcccttttccaagtgtactttacttcctttcattcctgctctaaagtttttaataaacttttcctcctactctaaaatttgccatagtctttaactctgccttatgccctgtggt

SEQ ID NO: 463379 - DNA, 4240 bp, Homo sapiens
gcttttgctataacctttagcggctcgtcggtccggcctctcttccctccctggagggtggggagtgggaccccaggttcctagcttctcattgcatgggtggttcctccggtcttgaagctatttagggggcatcagtgtcatttcattagcgtaaacccagagtcttgctctgtcaccaggctggagtgcagtggtgagatctcggctgactgcaacctctacctcccaagcctgtcaatgcccatgctgtgtggatgcccaaagaatgcccacatggggctgcccccaagagtcaagtccacaaatggcgtttggagtcacagggataagaaatggtttgaaaactttggcctaagaacggttaagtgatatggcatttccctaagaacacttttagttataaaagaattagaaatgtttctaggtaaacgattagttgaaatcaccttgaaaagaagcaatcaggtgtgaaagtcaaagtcacgggctctggagatagacaggacttggtcaaagcctggcattcccattgcccagctgagtgacccttagcaggtcacactcctgcaccaaacctgttttgcatcttcagaaacaaagtttgatctcagactgctgtgctagcaatcagcgagactccatgggcgtaggaccctcggagccaggtgcgggatgtaatctcgtggtgcgccgttttttaagcccgtcggaaaagcgcaatattcgggtgggagtgacccgattttccaggtagagacacttttgacttgatctctgcagtcctcaacatggtcgaagtctgaaatcaagtgtgagcagggccacatgggcccattctgaagacccgaaggagagtccccctttccctcttccagcgtctggcagtcctaggccttctttggttgacggcagcctcacttccatctgtgcctgtgactcacatagccctcttctcaaagtctctgactttctcttctcttaaaagaacacctcggctgggtgtggtggcacacgcctgtaatcccagcactttgggagccccaggcaggtgatctgcctgcctcggcctcccaaagtgctaggattataggcatgagccacagcatggggcccagtttcaatcttttaccaatgaaaacctgaacacaaaacaataattcttaaccaatcatgatgaaacacagtaacttttttttttaataaaaggaagaagaaagtgttgaaaattgacatctatgtttacatatcacagcaacacaaagtgccagcaaaaaaaaaaaaagtggaaaaatgaaagtatcttggccccatgagttttgctctgcttcccactgtcatttattcagtacatgtgtcactagatccaggacttgctctagaagttggaggaagtcaatggcactgtgagaaacgtgaattaccaagggactctgtcatgtccttcgttactcatgtgacttccttacatgaaaggaaaatagatcctggggcctccaaatcactcagctaaagggaaaagtcaagctggatctgcttagggcaaacctgcctcccatttattcaaagtcatcccactcttcactgagataaatgcatatctgatggcctcctttggaaaggctcatcagaaactcagaagaatgcaaccatttgtctcttatctacctatgacctggaatttcagtattaaaccaatgtttatcttgcatatattgattgatgtctcatatctctgtagagactacatgaaaattttgttgttgaaataattcgttgtactgagcttcaattgaaatgcttaaataccttgaaaacatttccatttttgcctttactcaaatcaggtggtggctactttctaatgaatgcaaatcccagtatgtgaaaagtgtgggttaggacaataaaaggggaggtgacaccattttaatggtttctcagaagctgtgctccgatgtccttgggcacatgtcatcagtacctcctgaggttatgtcacaggtgcatgtccttaactttggcaaaataaacttcctaaattaactgagatctgtctcagatattcaggcttcagagctatgccagctaaccccttatgctgaaaacgaggacttagaaggaaagggcaagagagccagacttgctttttccttttttttttttttttttaagtctttccttattcatcaataagccaaaagtagaggttgttagtagaaaatgtgtgcaccaagaagtgaaataaagacagttgagttcatgtgttgtagtgtttccaatgttctgctaagaatgaaatatatatgcatgtacaagccacaaaatacaaattgtgtaattttggtgatgctgcatatgagttaaatgtacttatgtttgtatttaaacgtgaaattgcacaatatgaagagtaatggtaaaattcatgctaatgatttaaaattgtattctttctttactcaaaacgacctcaaggagcaaagtaaaaacaccataacaaattgagagactgtagaaaaagggaaaagccttatcttttactacattccatggcacgtttctcctgctttttgaatgagagcacttacagtttcattttgcatttggctgcaaaaacagcgcagcgccccctgcagggagctgtatcacggtgttctgatcagcctctggggaagtggcctcctctggtccaatcagcttgtggactgaggatcacgtgatacaaaatatggccacccctgcatgaacctggagcaactgccctgggtaggtacccgtacaaggaaaggcaatccttcaagcaataatcttttggcagtctccctcacctctgttcacccctgggtatttttggcattgctgtttttaatgatggggtgtgatgtttcctcagcctgttaaacttcattgtgttattttttaactgcttctgagaaactactaaaatgctgttacctccctttttattggcctaagccacacttttcacatactgggcttttcattcattagaaagtaaccacttattttgagtaaaggcaaaaatggaaatggtttcaaggtatttaagcatttcaagtgaagctcagcacagtgaattatttcaacaacaaaatttccatgcagtctcttagaagaaaaatgtatcttaactaaattttaggacttcacattttgttttgttttgtcttggcttatttgttatttaaatgtgcggatctgtgaaataacatcatttctttttaaaagacagcaggttctaactttagtacttcctgagcaaaaagaactaaggttgcagaaagcttctctttcaggctgtctttctggcattgctgcaggcagtgctgcccttgctgggaggtctccaccatccacattagcctgcatgtctctgtccctttgcttcgtttcccacctctacccacctgcccaccacactctcacacttcccctgcccaaccagaattgccatcaggggctattggtccaatcccaaatgctagtaacagaactgaaaagcccaagtttgaagggaatttcttcttccgtgaagtcccctgggagaaaattttctggaagactcaccatcccagaggctacacagctcaggacaacccctgttcttttaagggaaaagtgaaagcctggacttgtaggttttccccaccagttttcacatggagctgatatcggcatctctgcaaggccaggaggagattgagtgacctctctggaactccgaagtttactttccctgcgttttcgtaacttgttctcagctctttgaactgcatccaagtgcctagttcatgatgccataattgctcaccgggttcaagggcagagctctggtttcatattgtaaaattcagtgcacctgggtaccacataatagctgtgctaagacatgtgtgcattacatcagctatgattcattcctgtgatctagtttagaccacaatctgataacacaaaccaattacttaaactgttagaagatgcttaactggaaaaaacatatctttagttttccttccaactttagtctaaaccatatatatatatgtttttatatatatatatatgttcatattccatatatatgtattccaaatactctacatgagttttaacaacaaaacttgggggaatgggatctaaaatgtatttcccaggtctagcttggatggacttcagggtcattaacaagctgtgccaagcagcatatgaaatc

SEQ ID NO: 463380 - DNA, 5370 bp, Homo sapiens
  misc_feature (2)..(2): n is a, c, g, or t
  misc_feature (4)..(4): n is a, c, g, or t
  misc_feature (15)..(16): n is a, c, g, or t
angntttttctaacnntaaacatggaagtgttaggtatggtgtgaatttagactaactgtgtaagtacagccatgcatgagcaccagcagggtgacccaagtgtatatgctgtgctgcggccgaggctaaaggggtacgtggctctggggtggagaaccgggagacagaggtgcttcgatgagaagaaagacattgattacctggtcaatccctgtctcatggcaggcaagctgggaatctacgtccaggatctggacctgccaacgaggctgagggactctaatcaggcagtgaggctggccttagcaatgcagctgggcttcgaaggcccgaggttcagtggggagaaatccaggcaagaagggtgctgggaagtgtgccaggcccagctgagcaaggagagattctttgaggaaaccactaatgggaatgcgatgatgccgtgtttccgaggatggctgctgctagggagggaagcaggctcgtacctggagggtcaaggtattggagattataaaagtacatttttgcaaattgatgcattccagccctactggaaacatactacttttgagccgcaggggctgggtgaggcagtgaatgtgcggggagaggctgagtccacattccagctgctgctcttccggcctctgaaccatttcctacaacacttttgacaccaaatgttgaggggcgtttttccacaccaaccacttctccaacactggccggtgcccttcaattcagttcaattcgcttcaattctaacacgcagctcgcacaagttaacacaccctcttcacctcagacgccaatcagtcacaaatctcagcctcttgcacttctggcccgtcagctctaagtcagggattcccaagaccccctccttagtttgataatttgttagaagggcttatagaactctggaaagtgctttccttaccattactggttcattatagaggatacagctcataaatggtcaacggaagagctgcccagggcgagggtgggcaggggcgtggagcttctatgtcccagccctgaagcaattcgacaacccagaagccctcagaaccccagggtttagggtttctatggaggttccattatgtactcatgactgattaaatcattggccactggcgattagctcaatccccagcctctcttccctccctggagggtggggagtgggaccccaggttcctagcttctcattgcatgggtggttcctccggtcttgaagctatttagggggcatcagtgtcatttcattagcgtaaacccagagtcttgctctgtcaccaggctggagtgcagtggtgagatctcggctgactgcaacctctacctcccaagcctgtcaatgcccatgctgtgtggatgcccaaagaatgcccacatggggctgcccccaagagtcaagtccacaaatggcgtttggagtcacagggataagaaatggtttgaaaactttggcctaagaacggttaagtgatatggcatttccctaagaacacttttagttataaaagaattagaaatgtttctaggtaaacgattagttgaaatcaccttgaaaagaagcaatcaggtgtgaaagtcaaagtcacgggctctggagatagacaggacttggtcaaagcctggcattcccattgcccagctgagtgacccttagcaggtcacactcctgcaccaaacctgttttgcatcttcagaaacaaagtttgatctcagactgctgtgctagcaatcagcgagactccatgggcgtaggaccctcggagccaggtgcgggatgtaatctcgtggtgcgccgttttttaagcccgtcggaaaagcgcaatattcgggtgggagtgacccgattttccaggtagagacacttttgacttgatctctgcagtcctcaacatggtcgaagtctgaaatcaagtgtgagcagggccacatgggcccattctgaagacccgaaggagagtccccctttccctcttccagcgtctggcagtcctaggccttctttggttgacggcagcctcacttccatctgtgcctgtgactcacatagccctcttctcaaagtctctgactttctcttctcttaaaagaacacctcggctgggtgtggtggcacacgcctgtaatcccagcactttgggagccccaggcaggtgatctgcctgcctcggcctcccaaagtgctaggattataggcatgagccacagcatggggcccagtttcaatcttttaccaatgaaaacctgaacacaaaacaataattcttaaccaatcatgatgaaacacagtaacttttttttttaataaaaggaagaagaaagtgttgaaaattgacatctatgtttacatatcacagcaacacaaagtgccagcaaaaaaaaaaaaagtggaaaaatgaaagtatcttggccccatgagttttgctctgcttcccactgtcatttattcagtacatgtgtcactagatccaggacttgctctagaagttggaggaagtcaatggcactgtgagaaacgtgaattaccaagggactctgtcatgtccttcgttactcatgtgacttccttacatgaaaggaaaatagatcctggggcctccaaatcactcagctaaagggaaaagtcaagctggatctgcttagggcaaacctgcctcccatttattcaaagtcatcccactcttcactgagataaatgcatatctgatggcctcctttggaaaggctcatcagaaactcagaagaatgcaaccatttgtctcttatctacctatgacctggaatttcagtattaaaccaatgtttatcttgcatatattgattgatgtctcatatctctgtagagactacatgaaaattttgttgttgaaataattcgttgtactgagcttcaattgaaatgcttaaataccttgaaaacatttccatttttgcctttactcaaatcaggtggtggctactttctaatgaatgcaaatcccagtatgtgaaaagtgtgggttaggacaataaaaggggaggtgacaccattttaatggtttctcagaagctgtgctccgatgtccttgggcacatgtcatcagtacctcctgaggttatgtcacaggtgcatgtccttaactttggcaaaataaacttcctaaattaactgagatctgtctcagatattcaggcttcagagctatgccagctaaccccttatgctgaaaacgaggacttagaaggaaagggcaagagagccagacttgctttttccttttttttttttttttttaagtctttccttattcatcaataagccaaaagtagaggttgttagtagaaaatgtgtgcaccaagaagtgaaataaagacagttgagttcatgtgttgtagtgtttccaatgttctgctaagaatgaaatatatatgcatgtacaagccacaaaatacaaattgtgtaattttggtgatgctgcatatgagttaaatgtacttatgtttgtatttaaacgtgaaattgcacaatatgaagagtaatggtaaaattcatgctaatgatttaaaattgtattctttctttactcaaaacgacctcaaggagcaaagtaaaaacaccataacaaattgagagactgtagaaaaagggaaaagccttatcttttactacattccatggcacgtttctcctgctttttgaatgagagcacttacagtttcattttgcatttggctgcaaaaacagcgcagcgccccctgcagggagctgtatcacggtgttctgatcagcctctggggaagtggcctcctctggtccaatcagcttgtggactgaggatcacgtgatacaaaatatggccacccctgcatgaacctggagcaactgccctgggtaggtacccgtacaaggaaaggcaatccttcaagcaataatcttttggcagtctccctcacctctgttcacccctgggtatttttggcattgctgtttttaatgatggggtgtgatgtttcctcagcctgttaaacttcattgtgttattttttaactgcttctgagaaactactaaaatgctgttacctccctttttattggcctaagccacacttttcacatactgggcttttcattcattagaaagtaaccacttattttgagtaaaggcaaaaatggaaatggtttcaaggtatttaagcatttcaagtgaagctcagcacagtgaattatttcaacaacaaaatttccatgcagtctcttagaagaaaaatgtatcttaactaaattttaggacttcacattttgttttgttttgtcttggcttatttgttatttaaatgtgcggatctgtgaaataacatcatttctttttaaaagacagcaggttctaactttagtacttcctgagcaaaaagaactaaggttgcagaaagcttctctttcaggctgtctttctggcattgctgcaggcagtgctgcccttgctgggaggtctccaccatccacattagcctgcatgtctctgtccctttgcttcgtttcccacctctacccacctgcccaccacactctcacacttcccctgcccaaccagaattgccatcaggggctattggtccaatcccaaatgctagtaacagaactgaaaagcccaagtttgaagggaatttcttcttccgtgaagtcccctgggagaaaattttctggaagactcaccatcccagaggctacacagctcaggacaacccctgttcttttaagggaaaagtgaaagcctggacttgtaggttttccccaccagttttcacatggagctgatatcggcatctctgcaaggccaggaggagattgagtgacctctctggaactccgaagtttactttccctgcgttttcgtaacttgttctcagctctttgaactgcatccaagtgcctagttcatgatgccataattgctcaccgggttcaagggcagagctctggtttcatattgtaaaattcagtgcacctgggtaccacataatagctgtgctaagacatgtgtgcattacatcagctatgattcattcctgtgatctagtttagaccacaatctgataacacaaaccaattacttaaactgttagaagatgcttaactggaaaaaacatatctttagttttccttccaactttagtctaaaccatatatatatatgtttttatatatatatatatgttcatattccatatatatgtattccaaatactctacatgagttttaacaacaaaacttgggggaatgggatctaaaatgtatttcccaggtctagcttggatggacttcagggtcattaacaagctgtgccaagcagcatatgaaatc

SEQ ID NO: 463381 - DNA, 978 bp, Homo sapiens
ggcctcacagagcctatggtgggagtgagacaaatgggttgacaggtgcccacatggttgccaggcacatttcagagagcaggtgtatgctgctcaggcagccaaagggcctcacctggccaaggtgggccacaaggcagcccagaggaggtggcttcaaaccaagtcctggaggacaagcaggagccagctctaactctattatgggtgtgaagatgggctgtctccaatggcgttattcggcaggcactctgaagtgcttccccaaaccctgttgtccactttcctggacttgagtaatggtgctactagtggctttatttgatcttcattaaatttgggaattgttcttaccaactcagtcagagataaaatattgtttttcatatttccaaagtttcttatgataatggtccagggctggagtctgggatttcctctctcatcctctcccgatatcgggttgaaattttgagagactgcagacaagagcagggttgccgatggaaatcttaaacaagtgggatcgagatcctgaagcgtttcttctaagaattgcaatagatgaaatatggctctgccagtatggtcctgaagacaaaagacaatcaaaccagtggctaccaagaggtggaaagggtccagtcaaagctaaggtggacttgtcaagagcaaagaacttggaaacaattccagaaaacctcagaaataggtatttgaaattcataggagtaagctatgaccataaacttcctagtaagccacgtttagcaatgggcaatcttaaacatgcaaacattcaaaatattggctactgtaaaaaaaagacagtaagtgttggcaagggtttggagaaaaggacacccttatacattgttggtgagaatgaaaattggtacagccgttgtggaaaaccgtatggagattcctcaaaaaattaaaaatagaactaccatatcatctggcaatcccacttcc

SEQ ID NO: 463382 - DNA, 3298 bp, Homo sapiens
gctggttcctttaaaagaccagtaaaacagataaaaaatcaaatggggcttccgcccggcatgccggaccgcgcatgcgccgtcggcagcgtcgcgcgcgccctgtcgcgcagccggcgctacgtgtgcgcccgggacgcggacgcaagccgccgacggaggaggccttttaactacggcctctccatcgaagaaaaaaatgaaaatgatgaaaactcattaagcagttcctctgacagtagtgaagacaaggatgaaaaaataagtgaagaatgtgatattgaagaaaagactgaagtgaaagaagaaccggagcttcaaacaaaaagggaaatggaagaaagaacagtaactctagaaatccctgaagttctgaagaggcagctggaggatgattgttactacattaatcggaggaaacggttagtgcaacttccatgccacaccaacatcataacgattttggaatcctatgtgaagcattttgctatcagtgcagccttttcagccaatgagaggcctcgtcaccatcacgctatgccacatgccagcatgaacgtgccttatatcccagcagaaaagaatattgacctttgtaaggagatggtggatggattaagaataacctttgattacactctcccgttggttttactctatccctatgaacaagctcagtataaaaaggtgactgcatctaaggtttttcttgcaattaaggaaagtgccacaaatactaataggagccaggagaagctctctcccagcttacgtttgttgaatccatccaggccgcagtctacagagagtcagtcgaccagcggtgaaccagccacccctaaaaggcgcaaagccgagccgcaagcagtgcagtctctgaggcggtcctcgccccacaccgccaactgtgacaggctttctaagagcagcacctcacctcagcccaagcgctggcagcaggacatgtccaccagtgtgcccaagctgttcctgcacctggaaaagaagacacctgtgcatagcagatcatcttcacctactctgactcctagccaggaagggagtcctgtgtttgctggctttgaagggagaagaactaatgaaataaatgaggtcctctcctggaagctcgtacctgacaattacccaccaggtgaccagccacctccaccctcttacatttacggggcgcaacatttgctgcgattgtttgtcaaacttccagaaattcttggaaaaatgtcctttactgagaagaatctgaaggctttattgaagcactttgatctctttgtgaggtttttagcagaataccacgatgacttcttcccagagtcagcttacgtcgctgcctctgaggtgcattacagcaccaggaacccccaggcagtcaataagtgttgatggttctgtaagaacaactgctccatctagcatggtgttctgagttccaggtaaaaaattaacaaggtggtgggtttttatccagagcacaaaacaaagtgcccaccagggggctttgacagaggtgtgccctgttgtttgagttccccatgtactgtagttactctgtttagaattatttcctaggtgcctgaaagtgttctgacatgacacttgctactttgtaggccatctgtgatggcaggtaaaaagcaactgttcacagtgaaatgttcatggaagtgtacataggttaggccatttcagcagacattgcagttagtcagcaagaaccacattgtttcgttatttgttagcattaaacaaaattttttttgcaaattggtttcattctcttgatgaagctgagcaactgtccaacaaggtttagtttgtacttgaaaactgcaaagtagtctcaaagtattttagagggaatccatattgatggcaaaagaaaatttgcagctataatttgcttctgacggttccttctctgtgaaacattatttttggtgatctaaagaaagcattgcctttcttgtttgcaattttacagctatacttttttgtgtaatgttacggttccctttctgtaaaatgttctttttggtgatctaaataaagcctctcttgtttgaaaaaaaaattaacttggagtcataactacagatataatgacgattggaatataagagaatgctacgtattcatttaaaccagtaaatttgaaagtcttgacaaaaatgattacttaggaaaatatatattatataaactggctccccctgaaaaagtaggtattcctcattgtggcacctgacagccccaaaggtagaaattaaaactaacccacatatttattgcacactatgctgacattttaatgtaaattttagaccacataagatttagtctttagagtcagaaattccttaggtgctagcccacaaattgctacataagagaaaacagaaaagatttcactttctgtgatcctaatagaaagcccacagagacatatcttcccactgtggcttcagtagcatcaaataggaaagtgataatactgtgagagaatgacgtgccacccacaatatctgaagtacaaagacaaagctggatgtatttttggttagttaatttgagcaaaacccgtaagtgtccagatggattcttcctagattatcataattctcttgcatgtccatgaaaggataaggtatgtcacaaggctaagagcttgaactgtgctagtccaaattgagacgtgctctaagtgtgaggttagagcactggagtttgaagacttaatatgtaaaaataaatgtaacatatctcattaataattttcagcattggttaaatgtcgaactgacaatattttagatacattgggttaaataaaatgtttttaaaataacttcacctatttctttttacttttaaaaaatgttaatattttaaaaacttaaaatgaccaatgtgtctcacatatttttaatggacagtgatgctcttaaaagtattacctctatggcatggcatatgtcaaaaactcatggtcttttttagctattctttgatccaatatccaaggcttagcttcatgtatccaagcagttacaggcctctactaaattagtcaaagcatcttttggtcttgtactaggattacctttaaatctgatgttaatatatgcagcaaatccctactgttaatagaaaccacccaacattttttctgccgtttactaatttgattgttactctttccctcacatattaccatattcctatgtacacactcagtctggcagccttctgttactcttatccaatgaaggagaagctc

SEQ ID NO: 463383 - DNA, 1355 bp, Homo sapiens
gtctcataggaactaacggagacagtcaggacggtttggaaaatgctgcaccagaagtgtaacaatggaggatttcatctggcagaaaagtacagaaagttcttcctggcagaaggaatagcatgggtaaagacagatgtcaaactgtatggtttgcttgggaatgacaagcagtttgatgcgactggtgtaggccacatagtggggaagggagtggcaggggatgaggagaaaggggtacactgggggcaaaatctgaaggacttgatcccccagccaatggagccatcagaggtttacagcagtgtagggagtggcactgatagaagagatacagctgctgccacggaggcccaacatctgagttcagaatctaaagaaaaaacatcagcacaaaaatcagggcacccttttggaatcttgaaagcagactttaccatctcaactctgatggacccagaagagatgaaagaccaatttctgagacagatccaggaagtcttaaagcttacattaggtcacgaacaatttagactgaaatgggtcagcttcgaagtgaacaaaaaatagcacaattcttggatatgcagtttctgtttcatgcaatcttctctggattttgagtaaattttaattttttaatccctagtagaacaagattaggaagaactcgacatgtgccaaaaagcacagacctacaactaacacaaaacaagactacacatgaaacctgcatccctggattttacagaatgaaacagggatgcaggagaagatgggtgtatttgggaacaatcatgttgggaatgacaaatgaacttctattaagaaattaaaataaaaaacctgaaccaaacatcaaaaatcctgaaaacaaaccccattaatctaactggaaaattacaagaggatggtagtggtctaggaagctaagtggggctacatttcctaataaaccagatgaaactttctttacctgtcacaagttattaaagagatttcaaattctgcagaattcgaaagtaacagttttatcacaatacatgctaatgctagttatttttcctaaattgaaatcttattacatggaagttgggaaattctaggacagactgttcttaatgttaaaatatatttttagaagaatattccggcatacatttcctttcttgtttctcttcaagtgtcctagtcacccaggtgcatgctagaagacagcaatatgtcaaatatagtagcaactttagtctgaaatgtttaaagttaaagtttatttgtattctttgtaggaatatcaataaaagacctcaaacgtatctatatctgtacatgtacaagaactgtcaaaaattatt

SEQ ID NO: 463384 - DNA, 1807 bp, Homo sapiens
ctggagacatctgtgcttattcggaaatgccctcagatgcagctgttgtgcggctacacaccccaggaaagcggacaacatcaatacataaatgggcacagctgtgttccagtaacactttatttacaaaccagagggtggggcagattggacctgcaggcatcatcttctgcaaaaagcttttcctgaatctctcagtcaaagaaaaggcccctcatgttctatgtgacctgagtgacctagaataccttgatgaagagttccatcagagcctgcagtggatgaaagacaatgatatccatgacatcctagacctcacgttcactgtgaacgaagaagtatttgggcagataactgaacgagaattaaagccagggggtgccaatatcccagttacagagaagaacaagaaggagtacatcgagaggatggtgaagtggaggattgagaggggtgttgtacagcaaacagagagcttagtgcgtggcttctatgagatgagaaactttgctcagtaccaaattgctagtcttcaccaaactctgggcatggcccatgtgtcctcatgttcaatccagttttgatcagccttctctttgatcctttttttctccaaaggggactaaacatcactgaaatggtaaacagtaagattttatctgcagagtcgtttatttggctttcgtaattgaacagctcagcagaataagatggccctagttgtatggtttctggggaacacaggagaattaaatttatatatgtgatttttatgtgtagtgcccttgggcaggtgatatctttctatatgacttttaagatattacaacctgaggagtgtggatagccgtgttgtgtgattcaaactgaatcagctattactgatgcaggtaaggaaccatcagtcaacttctggttactatcaccttcataaaaaagaatggatgatgttcaggaattaccttggaaggattaaccaggaattaacacagaatgggatgttcttttaggaccctaatgctctaaaagataaaattacaacctatttttctttatatgatagcataagtaaaatttggggctgttaatatgttggaaagtgcttaaaattacatgtttttataatagggatgcaggcattccaaaataaatgaataaaaatacatgcatctctctcgcctcttactgaaagtattaatctaattttatagtaatgattactttttaatattaaggctctgtaaaaaaattatttctaagatttcagtagaacacaggtggtgtatttttttaagcttttaatttctcttcaccaacctcagtcattacgttcaccacacagtgtgtcacagttaatagtggtatttcagtttttgcgttgatttaagcttcatatttatttaatgtgacttttaatggagaaataataatgggagatgcttgctgttagcattaaggttatacagctctcacttcaccttatatgtaatttttttttcaaagtaaataatgcagattgttgacatcctagaaatggtttctgggtggtattatatggggcctaggactctgaactgggactagttgtttattttctgggaagtctgtattcttattctcaactgaacccctgactcttttgttgtattttttatgattccgaaatgctttgagggaaagatattttaatgtgtacaatttgttttattttcatactgatctctatttttgtttaaaaccatgttgcatcatgaaatcacttaatccaaaataaatcttctttaaaaaaaatagattatgacttttc

SEQ ID NO: 463385 - DNA, 1142 bp, Homo sapiens
ctggagacatctgtgcttattcggaaatgccctcagatgcagctgttgtgcggctacacaccccaggaaagcggacaacatcaatacataaatgggcacagctgtgttccagtaacactttatttacaaaccagagggtggggcagattggacctgcaggcatcatcttctgcaaaaagcttttcctgaatctctcagtcaaagaaaaggcccctcatgttctatgtgacctgagtgacctagaataccttgatgaagagttccatcagagcctgcagtggatgaaagacaatgatatccatgacatcctagacctcacgttcactgtgaacgaagaagtatttgggcagataactgaacgagaattaaagccagggggtgccaatatcccagttacagagaagaacaagaaggagtacatcgagaggatggtgaagtggaggattgagaggggtgttgtacagcaaacagagagcttagtgcgtggcttctatgagatgagaaactttgctcagtaccaaattgctagtcttcaccaaactctgggcatggcccatgtgtcctcatgttcaatccagttttgatcagccttctctttgatcctttttttctccaaaggggactaaacatcactgaaatggtaaacagtaagattttatctgcagagtcgtttatttggctttcgtaattgaacagctcagcagaataagatggccctagttgtatggtttctggggaacacaggagaattaaatttatatatgtgatttttatgtgtagtgcccttgggcaggtgatatctttctatatgacttttaagatattacaacctgaggagtgtggatagccgtgttgtgtgattcaaactgaatcagctattactgatgcagggtaacaagaggccaatctttaactgcaaccaaatagcaactataacaatgagcacagacaactgcaaaaacaccaagcaatgagaagaatatgaggaagcactgctggttcagtggcagaattctcgcctcccacgcaatgagaagaatctttgcttgataggtaagcaatgttttcatcctaagcaatataattgtgttatagatagtaaatctgatattttgcattaaaagtaaatggagttttttttt

SEQ ID NO: 463386 - DNA, 1120 bp, Homo sapiens
taaggacggaggccattgccatgtgaagaagaacctaccttccgtcttcccaccctgacccactgagaaacctcaagctttggacttgtccatgctgccctctaaccctagatcacagttctgagtgtgaatactgccagcccagaagagaacattcatgctggatgcagtggctcacacctgtaatcccagcactttgggaggctgaggtgctttctggcatgtcctcacctggttattgccaagaactcagcagtgaccaagttcttggtaggcacccacgcctttgaattcctggtgaagtggagggttcctggaaaggccttcggaaacagaaggccactaccaggcttggtgatcacccagccacattcctctccacccccaggcattaactgcatactcacttcgtggtgtagtgggagctgcttcagaggacaaaagtctgacactcctgttatttggcaaatcccatggcttctctgcgactcagtctccatgtctgtaatatggggttttacctaattcagggctgctgtgagaagtgtgagctagtgtgtatttggagagaacaagtacttaataaatgagccatctctttcctccccatgcccgtcttaaactttagaatgatcctgcctggcgggcgggcgagtccccgacgcggctgccgccgccgcccgcggcagagggcacggcggttcccacgctcgggccctggttcgggggcgttctcgggacggcgtggccgcgctcaccaccaccgcggaggccgggctgtaattaggataattgcgctgctcccagcctggggcagctcaggaccccggctgcaccgcgctggcccgggacgggcgggggcagggggtggcggggcccgagcgatacagcccctggcgcagtccgttcctctagacagtggtggtttcaagtctctgggtctttgcatatgctgcagccgcacgtcaggatatccttttccagggccacctggtaaactcctctcacccttcaaggtcctccacaagcccttggctcagtgtttggtgctgcgggaacaggagtggaaggaacacatttttcccctcaaggagcactagtaagggtaggaagcaggtct

SEQ ID NO: 463387 - DNA, 1828 bp, Homo sapiens
agtctcacacgccctgagcagatgaaccggtccctcggtccggtctgccctcccgcaccggcgcctttgggctcagcgggccagtggccagatggcgagagttctggatctcatcagctttgtcctcgtcacccctctgggagttcagcctcctaaggctgtgaaacagcccaaaaggcccggacacgctactccaaaacgtctctcctgggctgtgtgaacaataagagctatttggggacgacaggaaaagatatggcccatagaagggctcctgaaatctaaccttgcgactctttaaaagtttcttgtcccttgtggaaaaggtgccgttttggttttggggaatgggaggtcccttcagacaattcattttagccaaaccctcgcttttgagaaggggaagaaatgggattattgtaacaccatacagtactaatttcaaaataaatcatctagaatagaggagagagagagtccccaaataaacaaccatttaatacctctactcggcgctatcaccttttttgcttcaggatttgaccaagagagcagagattatgtttttctgtcctttcttcactgtttacatcacagtaccccaagagaagcacttctgcctttaacttgatacattggaatcgctatcacagatagtgtttttgtattatttttaagaaatatcacacaccttcctaaactcttggcagagaagaattctttttagttgttagcaccctcctgctactgagatctcagcttctgtttagaagacctattgttgtctttccactgattggaatttgctgcctctgaactgggtttaatctgtaatcgtcttttcagcctactaaatagtaaccccagtcctacagagagtgaatttctagctaccacagggggatttaggttagcatgtgccaatctaaagggatctcttaaagcctttcccttctcagaccaggcctctgtaccctgctaggaaaaacagattaatctgctcctcctgcttttcctcctcctcccttcttctcactcctagggaaccttccacaacagaaggttttagcgactgttgctaggcaaacatgccaacttccttgtttaggtgaagcgagtaactcaacttccattgcaagtaacctagataatgtaatttctttgaactattaatagttataccacagttgaataagtggatgtgtttgttcctcttgactggaccaggtgagtgccattggcccaagaacagcaaacgattgactggctggcttcctatgaaagaacttggagcatttctcttttcatcatctggaaactcttactgctctctggggctctctcttcctgccatcaggggccctggaaaaccagagtttactagtgagaatggaattgtagcaaaggaagtagaaaatttgagagagatttcactttctcttttaacccttctaaccatattattctttacaagggtccccaagccccaggccatggactggtactggtctgtggcctgctgggaaccaggctgcacagcaggagtgaagcgcctctcttcagctgacagcagtctccagagttttgcagctgtgatccagcaatcaatacacctggcagctggggtgccagaccacagcatccactagaccaggggtccccaacccccaggccacagactggtactggtccatggcctgttaggaactgggccacacagcaggagggtttatgtatgttattttatctctaaaattacattgtatttcttggaaaagccactagtaaccatgaatctactctttgtctttatgagatccacttcttt

SEQ ID NO: 463388 - DNA, 3558 bp, Homo sapiens
tgtaaatgaggaagctgaaactactgcaaatgaggtccaacagtcaacaaaagccaaaatcacctagaggaatatggcaggccttgcagaatggccatctctggccatggtccactgcagttttcctgcacctaaaccctctgggctccacacagaaggtagtcaaataattgaaaatattcctgcagattcacttttagaaggtggtcaagtaattaaaaatattcctgaatattcactttcagaagggggtcagataattaaaaatattcctgcagattcatttttagaaagtggaccaggacaatctccagaggtagaagaacatgtctctaaaaaacacttcgaagctgatgagagagattttccaattaaaaaaaatagtagtaccaaaaagaaacatttaataagcgaagtacctaactccaaatcaggttcaagtggcactgtacatgactacattatgaggcaaatattcactgcaccaatattctcagaattggagatagaagtgaaagagccaagtgaaacaccaatgaacttggaaaatcaattacctacaccttggaagagaagtttgtcatcacatattctatttcatgaagaaaatgctgatgaaatagaattgccacagcccagatctgctacaagccagataatacaagcatttcctatagatacacttttagaatctgggataatcaaagtgatagaattagataaagaacaccataagagttctttgctgggtacggggatcacttctcctaaaggaaacctaaaggattcccaagagtattattcagaaatcagaagcgagacagaacctctttctgagcagagtatacccatcattcccaaagacactacttctgttagtagagctgaatttatacaggaagaccaaaatatgttcccacaagattcaagttattattcaatagcaaataaagaactgtatttgccaagaaatggtcagaggctttgtaaagacaaaaatgatctcagttctactttagaaagtttaactaactcattaatggataaacttagtgaatcagatgaaataatgttaaaatcctttttaaaaaacatcttcaatgtttttttcaaatataatcattctgaaagaagaggacaaccagaaaaagaattagaaagactaattcaaccttcttttacaagtgacacagaacaccttgaagaactccaagaggattttgataaagcagacaaattagacagaaaacctattttgagtccaaagttgcgtgtgtttctagaagaactctcagagtcagaagtaaaacatttaaaatctgaattaagtaaacaaatccagcattaccttgtagaaagactttcagaatcaggacatatcaccaaggaggacttaccaaaaatctatcaaaatctgtatctgatgaatgagaaagcagagcagaaagggccaaacagttttcaggggaaatattctgaaactgtgaaagaaatcatgtcttttgtcaacaatttcaatcatcatttcatagataaacatttggaaataaagctgagatcttttttaaaagagattctccaaaactatttcctaaaaaacatttcagaaagcagtttatttaatgagacagcatctgagactatatacccaaacatatcttctctaaggactaaaagtgtctcaatatcttttcatgaactagaacaagatatttcaaaggggagttttggtagaaggtttgaaataaacatgaaatatcctttaagtaaatctctacaaaactatctgatagctttatcagaaaatgaattattacatctaaaagctgatttaagcaaacacctccagagtctttttatagaaaaactttcaaaatcaggactaatgacaaaaaagcaattagaagggatcaaccagcatataaatttgcttaattctagttctataccattaaaatatataaaaacacatttaccttttagagatgactgtcactttgtggagaagcattcagaaaagcaaaataaatattcaagaattgttcaacaaaccactttacaaacggtttctgaggataaacttagagaagcagaattgattcgagagaaagaaaagaaatattttcccttacagaatttaaagggaaattcatctttaattaaggaacagaaaagttattacactaaggaagaagctaaaacaccaagtttaatcaaagtacaaccttcttccaatgaaaatatccaggcaagtccattaagtaagtcatcagaaatacttacagatatactgcttaagaaactaaggaaagaacatgtattcacgcagcttcctcaagcagaaaattctgttcataaaacagagattcaagacccatatagttggggtggtaaatcaaaaataactcaatcaaaagcttggtgtgaaaagacactgaaaatgaagtcccttgatagaaaggagcatgtaaacatctataaatggactgttcaggaaaaacctgaagcagtattaacatcgtatccaagaattcctaatgccagaatgccaagggaagatgagtacttaaacagaatcactttcccttcctggcaaagtagcactttaactcatttcaatacagagactggggaaaaatcaaaattagaagaccagtattgtcagacattgaaaggaaataataacaataataaaaagcatttagtaacatttgcacaatacaaaaaagaaatacaaactctttatataaaaccagatgaaatttgcagtgaaaaatgtgccaagttccctgaaatacagtcattccaatataaggttgtagaagatgagaaaaacttgaaaccacacctcttcccagaattatttaagatagaagatctaaaacccaaggtccgaaaagaaagagaccgtgtcgcccaaccaaaaaagtcatttaacaagatagtcaggatactaccaaccacactgcccaccacaagaattcacctaaagaagtctgttccaaggacactgcttcactggactgcaagaagaactatacatgattgttcagataaatttgaggatttacatgacatgacctcatttacacaccttaaaaaagtaaaatcaagatcaaggcttttaggaaaaagctcagatgatatccataaccatgccagacactctgcaagaccatatactgctccggaggttaacaagcaacgagaaagctacagtggaaagtttacaagtcgtcgaatggtttcatcaggcttagttcatataaatgataaaacatcagattatgaaatgcataaaatgcggccaaaaaaaattaaaagaggatattgaaaaatgttcgctcatttgtgatattataaaacatgtttaactcagaatgatatgtgaggccagcagtcagaatatcacttctccattaacaaaatggtttggagatctcttcttttgtgtgacagaagtcagcaaccaaatttcatcttgttagaaccattttgttttgattaaaatgaaaaacaaacacatttgatgtaaatgtgtttttgttcatgaacctt

SEQ ID NO: 463389 - DNA, 615 bp, Homo sapiens
gtgtgttatagaaatgcagtattttgaggcaaacttctggagtactaaatctgaattggaaaggactgataacatctctttcaactcatagctgattcaggattgttcagataaatttgaggatttacatgacatgacctcatttacacaccttaaaaaagtaaaatcaagatcaaggcttttaggaaaaagctcagatgatatccataaccatgccagacactctgcaagaccatatactgctccggaggttaacaagcaacgagaaagctacagtggaaagtttacaagtcgtcgaatggtttcatcaggcttagttcatataaatgataaaacatcagattatgaaatgcataaaatgcggccaaaaaaaattaaaagaggatattgaaaaatgttcgctcatttgtgatattataaaacatgtttaactcagaatgatatgtgaggccagcagtcagaatatcacttctccattaacaaaatggtttggagatctcttcttttgtgtgacagaagtcagcaaccaaatttcatcttgttagaaccattttgttttgattaaaatgaaaaacaaacacatttgatgtaaatgtgtttttgttcatgaacctt

SEQ ID NO: 463390 - DNA, 1051 bp, Homo sapiens
aagttgcttcatcttggaattttttttaaaacttggattgcctcaatcagtgtatacaaagtttctggttgatgactgtagttaccaaaatttataccaatgcttatacttttttttttctttttcttttttttgagacagagtctcactgtgtctcagctggagtggagtgcagtggcacgatcttggctcactgcagcctccgtctcctgggttcaagagattctcctgcctcagcctcccaagtagctgggattatagatgagcaccagtatgcccagctaagttttgtatttttagtagagatgggatctcaccatgttggccaggctggtcttgaactcctgacctcaaatgatccgcctgcctcagctgcccagagtgctgggattacagaattttcaattcacaaatcatctgaaaaacaggaaattttggagaaacatgcttatgataacaaacaagggatctatcgtgtggtatagaagtttacacaaagaggcatctgattttaagtttttgtttttttttttttttttttttttaccgttctgggcttctggctgcattctaggaagatcattccttaaaagaaatagccatatggcttataagggactatatcttaagactatgtgtcttctgcagttctttgcatagagtcaacgttgaaggacaagcaacttcaaatttccaagcaacaaaattatgttcgggtggttttctgaaagcgagatcttaagaaccacctgtatcagaatcccatgaagagcttgtttagtgtgcaaatttacagattgtcccccctcagaaatgctcatttaggagttcctgtcctttgcggggacatggatgaagctggaaaccatcattctcagcaaactaacacaggaacagaaaaccaaacactgcatgttctcactcaaaagtgggagttgaacaatgagaacacatggacacagggaggggaacgtcacacaccagggcctgtcgggggtgggaggtaaggggagggagaggattaggacaaatacctaatgcatgtggggct

SEQ ID NO: 463391 - DNA, 975 bp, Homo sapiens
cgcttctagtaggccaaactcccaggtgacccccgcaagaaacgcggtccggagagggtctggccccactgctggggcaagggctctaggcgcccggaccccacgcccgcagcctgcggagaacgtgccgacaaggacctgtagggccccactccccctcctccctccctcggcgcagcccggcccaggggtctgtcctcccaggcccaggaaaggaggaaacccacttccgccgcgtccatgatctcccgcggcttctcctgactcttgcggctggcgctggcgctgggcatcgggacacggaactgggcagtggacaccaccctccctcgcaggcttccgtaagaaagtaatttgaaggccttccctgacttaaagtggatgctgctttggaaagcactggaaaaatggatcctgtctttcttagccaaggactggtctcttttctccaatgtgtccctaacagagtggtgaggctggctcttcccaccagtacaggaagatcattccttaaaagaaatagccatatggcttataagggactatatcttaagactatgtgtcttctgcagttctttgcatagagtcaacgttgaaggacaagcaacttcaaatttccaagcaacaaaattatgttcgggtggttttctgaaagcgagatcttaagaaccacctgtatcagaatcccatgaagagcttgtttagtgtgcaaatttacagattgtcccccctcagaaatgctcatttaggagttcctgtcctttgcggggacatggatgaagctggaaaccatcattctcagcaaactaacacaggaacagaaaaccaaacactgcatgttctcactcaaaagtgggagttgaacaatgagaacacatggacacagggaggggaacgtcacacaccagggcctgtcgggggtgggaggtaaggggagggagaggattaggacaaatacctaatgcatgtggggct

SEQ ID NO: 463392 - DNA, 777 bp, Homo sapiens
cgcttctagtaggccaaactcccaggtgacccccgcaagaaacgcggtccggagagggtctggccccactgctggggcaagggctctaggcgcccggaccccacgcccgcagcctgcggagaacgtgccgacaaggacctgtagggccccactccccctcctccctccctcggcgcagcccggcccaggggtctgtcctcccaggcccaggaaaggaggaaacccacttccgccgcgtccatgatctcccgcggcttctcctgactcttgcggctggcgctggcgctgggcatcgggacacggaactgggcagtggacaccaccctccctcgcaggcttccgtaagaaagtaatttgaaggccttccctgacttaaagtggatgctgctttggaaagcactggaaaaatggatcctgtctttcttagccaaggactggtctcttttctccaatgtgtccctaacagagtggtgaggctggctcttcccaccagtacaggtgctaaaaggataataccaaggaaaactatgggtgggggcagtgaatggccagcatgcctataatcccagcacttgaagccaggagttcgagaccagcctggaaacaaagcaagaccctgtgtctaaaaaaatttttttaaaaataagctgggcatggtggcacgtgcctatagtcccagctactcagctactcgggagaccaagctctgtttctggcaggaatctgacaccacttactccttgggtagaaactcccccaagtctgaactatgtgatt

SEQ ID NO: 463393 - DNA, 358 bp, Homo sapiens
tttttgagatggagtctcactcttgtcacccaggctgcagtgcaatggtgcgatctcggctcactgcgacctctgcctcccgggttcaagtgattcttctgcctcagcctcccaagtagctgggattacagcccaagctgtccacttggagagacatctggccagccccccgttgttccagccatccccagttcaggcatcagacatgtggtgaagaagccatcctagatgcccagccccagctaccatctgatgcaaccacactgctcaccccgagcaagaactgcctgcaggagcctagtattatcctctctcacagaaccatggcagggaataataaattgttgtttgaagccac

SEQ ID NO: 463394 - DNA, 785 bp, Homo sapiens
cgcttctagtaggccaaactcccaggtgacccccgcaagaaacgcggtccggagagggtctggccccactgctggggcaagggctctaggcgcccggaccccacgcccgcagcctgcggagaacgtgccgacaaggacctgtagggccccactccccctcctccctccctcggcgcagcccggcccaggggtctgtcctcccaggcccaggaaaggaggaaacccacttccgccgcgtccatgatctcccgcggcttctcctgactcttgcggctggcgctggcgctgggcatcgggacacggaactgggcagtggacaccaccctccctcgcaggcttccgtaagaaagtaatttgaaggccttccctgacttaaagtggatgctgctttggaaagcactggaaaaatggatcctgtctttcttagccaaggactggtctcttttctccaatgtgtccctaacagagtggtgaggctggctcttcccaccagtacaggaagatcattccttaaaagaaatagccatatggcttataagtgttctttcctgtatgaagcccaagctgtccacttggagagacatctggccagccccccgttgttccagccatccccagttcaggcatcagacatgtggtgaagaagccatcctagatgcccagccccagctaccatctgatgcaaccacactgctcaccccgagcaagaactgcctgcaggagcctagtattatcctctctcacagaaccatggcagggaataataaattgttgtttgaagccac

SEQ ID NO: 463395 - DNA, 2508 bp, Homo sapiens
tcatttccgggtccttccaaactcagctgggtgggaaaacttgaactgaatggaatcgaaccaaatggaagcccctaggtctgatcctacccactcggaacggaaggtgaggagaaaaaaacctaagagtgggagttggatctggatttctgtctttttcgaagttcggcagcactctggccccaggcaagttatgcttagatgctcccaaccagaaaatcgtgagaagcctggcgacactgggcagacgcctcccttccgcctgcccggaagacgcgagggcttgatccaaaggagggctgcagccgctgggactccgcctcgggggctcctgccgctcaatcagcaccagtgccctcgctcctccaccttcagttggttgttctgcccggcctttaggtccggggtccggatagaagctgagcaccagcgggttcccggccaacgggtgtggaggggtgcattgggccaggagccgattcgcagcgcccgctgcgcctgcactgtgcagacagacctggctttggatgagggatgactatcgtatcaggacttttaaaataaagtaactgagctttaaggagacaggaggaaaaaaccaaagcagcccccaactaccccaaactcgtcggatttgggagcgcgccgaaacatagcaggaagaaggcaggaaaaatcgtcctggcatttatgccttgaacaccctcccttccccacccccgcacccttgtcccgcccctaccccgaccgcaccgcggcggccgctgcatcgctaccggtgagcgtggcaggcggcttgctgcgggggccgccactgttgctgcgggcagccgagaagtacccgcggacccccaagtgcgcgcgctgtcgcaaccatggcgtggtgtcggccctcaagggccacaaacgctactgtcgctggaaggactgcctgtgcgccaagtgcacgctcatcgcggagcgccagcgtgtcatggcggcgcaggtggcgctgcgcaggcagcaggcgcaggaggagaacgaggcgcgcgagctgcagctgctctacggcactgccgaggggctggcgctggccgccgccaacggcatcatccccccgaggcccgcctacgaggtcttcggttcagtgtgcgccgccgacggcggggggacctggagcgggagcgcccgcggggaccggaggcggagcagctggcgcagggggctcagaggccaagttgcagaagtttgacctgtttcctaagacgctgctgcaggcaggccgcccgggcagcccgctgccgccgccggtgaagcccttatcacccgacggcgcagactcggggcccgggacgtcgtccccagaggtgcggcccggctcaggctcggagaacggcgatggcgagtccttttctggttcgcccctagctcgggcctccaaagaggcaggtggcagctgcccaggcagcgctggccctggcggcggcggcgaggaggacagcccgggctccgctagccctctgggctctgaatccggttcagaggctgacaaagaagagggtgaggccgcgccggcgccagggctgggcggaggctcgggtccacggcagcggacgccgctggatatcttgacacgcgtgttcccaggccaccggcgaggcgtcctggagctggtgttgcagggctgcggcggcgacgtggtgcaggccatcgagcaggtgctgaaccaccaccgtgggggcctggcggccggcctgggccctgcggcgcccccagataaggccgccgtgggtgctgcagcagctgcagacgacgcgtggcccagccgcgtcgacgccgccgccgccgccgccgccgccgccggggggcctgggctgcctgcgccgctgcaggcggggcccgccgcacctccgcaccacagacccttgctggccggcgccatggcgcctggggcgctgggctcgctgagcagccgctcggccttctcgccgctgcagcccaacgccagtcacttcggtgccgacgcgggcgcctacccgctgggcgcgccgctcggcctcagccccctgcgcctggcctactccgcggcggcggcgcacagccgcggtctggccttcatggcgccctactccactgccggcttggtgcccacgctcggcttccgcccacccatggactacgcctttagcgatctcatgcgtgaccgctcggccgccgctgctgcggcggtgcacaaggagccgacctacggcggcggcctgtacgggcctatggtcaacggcgctccggagaagcagtagggcgaggggcctggcagccggccggtccccaaacaggaaccccagccctgttcccgcgggccatcgacccctcttcgcccagcgctctctctgcgccctggctgggcgtcttctcactctaaggtggtttttgggttttgtttaggagggtgggtggggaaggctgagcaaagggggagcagctacagacaggtgcaggtgttctcggagggggtgcgcggcctgggtc

SEQ ID NO: 463396 - DNA, 2190 bp, Homo sapiens
tcatttccgggtccttccaaactcagctgggtgggaaaacttgaactgaatggaatcgaaccaaatggaagcccctaggtctgatcctacccactcggaacggaaggtgaggagaaaaaaacctaagagtgggagttggatctggatttctgtctttttcgaagttcggcagcactctggccccaggcaagttatgcttagatgctcccaaccagaaaatcgtgagaagcctggcgacactgggcagacgcctcccttccgcctgcccggaagacgcgagggcttgatccaaaggagggctgcagccgctgggactccgcctcgggggctcctgccgctcaatcagcaccagtgccctcgctcctccaccttcagttggttgttctgcccggcctttaggtccggggtccggatagaagctgagcaccagcgggttcccggccaacgggtgtggaggggtgcattgggccaggagccgattcgcagcgcccgctgcgcctgcactgtgcagacagacctggctttggatgagggatgactatcgtatcaggacttttaaaataaagtaactgagctttaaggagacaggaggaaaaaaccaaagcagcccccaactaccccaaactcgtcggatttgggagcgcgccgaaacatagcaggaagaaggcaggaaaaatcgtcctggcatttatgccttgaacaccctcccttccccacccccgcacccttgtcccgcccctaccccgaccgcaccgcggcggccgctgcatcgctaccggtgagcgtggcaggcggcttgctgcgggggccgccactgttgctgcgggcagccgagaagtacccgcggacccccaagtgcgcgcgctgtcgcaaccatggcgtggtgtcggccctcaagggccacaaacgctactgtcgctggaaggactgcctgtgcgccaagtgcacgctcatcgcggagcgccagcgtgtcatggcggcgcaggtggcgctgcgcaggcagcaggcgcaggaggagaacgaggcgcgcgagctgcagctgctctacggcactgccgaggggctggcgctggccgccgccaacggcatcatccccccgaggcccgcctacgaggtcttcggttcagtgtgcgccgccgacggcggggggacctggagcgggagcgcccgcggggaccggaggcggagcagctggcgcagggggctcagaggccaagttgcagaagtttgacctgtttcctaagacgctgctgcaggcaggccgcccgggcagcccgctgccgccgccggtgaagcccttatcacccgacggcgcagactcggggcccgggacgtcgtccccagaggtgcggcccggctcaggctcggagaacggcgatggcgagtccttttctggttcgcccctagctcgggcctccaaagaggcaggtggcagctgcccaggcagcgctggccctggcggcggcggcgaggaggacagcccgggctccgctagccctctgggctctgaatccggttcagaggctgacaaagaagagggtgaggccgcgccggcgccagggctgggcggaggctcgggtccacggcagcggacgccgctggatatcttgacacgcgtgttcccaggccaccggcgaggcgtcctggagctggtgcagcccaacgccagtcacttcggtgccgacgcgggcgcctacccgctgggcgcgccgctcggcctcagccccctgcgcctggcctactccgcggcggcggcgcacagccgcggtctggccttcatggcgccctactccactgccggcttggtgcccacgctcggcttccgcccacccatggactacgcctttagcgatctcatgcgtgaccgctcggccgccgctgctgcggcggtgcacaaggagccgacctacggcggcggcctgtacgggcctatggtcaacggcgctccggagaagcagtagggcgaggggcctggcagccggccggtccccaaacaggaaccccagccctgttcccgcgggccatcgacccctcttcgcccagcgctctctctgcgccctggctgggcgtcttctcactctaaggtggtttttgggttttgtttaggagggtgggtggggaaggctgagcaaagggggagcagctacagacaggtgcaggtgttctcggagggggtgcgcggcctgggtc

SEQ ID NO: 463397 - DNA, 2782 bp, Homo sapiens
atgctgtgaagtcataggaacccccaccctggggacacaacccctggtcactgagtgatgtatatctgtttttaacaggatgtcgtgtcaagatttccaacagaaattcatcgccatgtttatatgtagcgaaattccaattaccctggaccatggaaacacactccacgaaggatggtcccaaataatgtttaggaagcaagtgattctaggaaacactgcagtaacagctctttctgatgcaggaggacctcggaatgatgctcaattcaacttctctgtgcaagagccaatggaaggcaccaatgttgtcgtgtgcgtcacagttgctgtcacaccatcaaatttgaaagcagaagatgcaaaatttccactcgatttccaagtgattctgcggttccgggagaaatttccacccgtgtttttttcctcgttcagaaacactgtccaaagctcaaataataaattccgccgcaacttcaccatgacttaccatctgagccctgggaactatgttgtggttgcacagacacggagaaaatcagcggagttcttgctccgaatcttcctgaaaatgccagacagtgacaggcacctgagcagccatttcaacctcagaatgaagggaagcccttcagaacatggctcccaacaaagcattttcaacagatatgctcagcagaggctggacattgatgccacccagcttcagggccttctcaaccaggagcttctaacaggacctccaggggacatgttctccttagatgagtgccgcagcttggtggctctgatggaagtatcctttgcggtcatccctcccatgctctgagcacccctcagctctgtgggcttccccagagacctaattaggacagtagggaacccttttcccactcagtattttctcttcttccctgtccttgagtttctggggattctctactaactcactaacataccacagcaacaatgataatagttaccatctatcaagcacctactatgtgctgatcagtgtactggggtgtgtgtgtgtgtgtgtgtgtgtgtgtgtgtgtgtgtgtccttataattcttgaagcaatccctctgatacaaaaaagtatcatctcataatacagtagaagaaacaggagttcagagaggttaagtaatttgcccagatcacacagctagtcaggactcatgctcagatttgaagttggagctttcagcctccaaagtcgatgctctaaccttatcctaaaccgcccctttatagcaccgttgggaactattttcccttttacccattcacttcccactggaggagtctccattatttaaatttcttacttcaacaagtccccaattcaatcaagataactaccaccaaaacatggaaaactgcctggtctacacagcagttgcaccccagcattgctatgctgcattcacagcgggagacgctgggcagaggcagttcagagactcactccaggcccgtggctacaagtgtaggaccaagaattgaaccccagactcctgaccctcctcctgatttccattccccagtgagccatcctcttcctgcgtacccctggcttggcaagcagaagaggctgactccatgagtgtagacccccagatgctgccctgccagcccctcactcggcagtgtgctgtctcctgagacgcattgccccgctcctgcaccgttgacaaggctgaattgggactgtgaagccggccattgtgaaacaagagggcttttttgatgaaatcataaatcaggccctgtctctgctggctgtgctttggaatctatcagagacacagcccatctcccacagaggaatccaaatggtcctcacagtgccacggcccggggatggcagcccctctgcaccttgcacgctggctggttcactcttaactccttacccagctgaaagtgaatgggcggctagaccaagaggagtttgcgcgactgtggaagcgccttgttcactaccagcatgttttccagaaggttcagacaagccctggagtcctcctgagctcggacttgtggaaggccatagagaatacagacttcctcagagggatcttcatcagccgtgagctgctgcatctggtgaccctcaggtacagcgacagcgtcggcagggtcagcttccccagcctggtctgcttcctgatgcggcttgaagccatggcaaagaccttccgcaacctctctaaggatggaaaaggactctacctgacagaaatggagtggatgagcctggtcatgtacaactgaagcaaagaggaaagcagacccatggctcaggacaagctcccagtgatcactcaagaatctggctctcattctaagaggctgtgctgcccagtatggtggttgtgataaatctaaaccagccctgcatgaaacagagtccaagctgtctcccaacagcctgggttcggtccttggctggcccaggcccagttaagcctgtggccaccaagcagctcatctgagcactttgggatgtattcagcctacgttgccctggaaaaggaagcaggagatgtctccctgtgggaaaggagaagagaagttgtctctgagtcccctgtcaccagttggattcatttcttggaagagccagaatgagccactttgaccaccctcgggtgctatgggtgacacaagagctgtccactgggtgtttgcagaataattacactatcttatgtctggatcctgatgatttcacagctaaatggcaaaaataaaacatgtttcccataa

SEQ ID NO: 463398 - DNA, 1067 bp, Homo sapiens
  misc_feature (449)..(449): n is a, c, g, or t
taagctgggttacttatatttttactacagaggagttatagatgttctttgtatattgtagatacgaattccttatatatgtgatttgcaaaatttttctccccttctgcaggttgtctttgcagtttttgatgccatcatctgtagcatatgagtctttaattttgatggagtctaatttatctattgttttcttttgtcacatatttttggtggtatagctgagaaatcattgcccaacccaaggtcaaactatttattctgttttatagtttagctcttacatttaggtctttgatccattttgagatcattttttatatggtgtgaagtaacgttctaatttcattcttttgcattcattcatttgtcccagcaccagttgctgaaaaaactattcattctcctgtttctttgtcttggaacccttttcaaaaatcaatttaatntaagaatgtatttatggacgttcctttctgttcaattgatttatgtgtgtatcttatgccagtatcacactttgttgattgctacaattttatagtaacttttgaaattaggaagtgtgagttttccaactttattttacttttcaagactattttggctcttctgggttccttgcatttacatataaattttagaatcaatttatcagcttctgggattttgatagagattacattaaatctaaaggtcaatctggggaatattgccatcttcacaatataaaatcttttgttccatgcgtctcttcatttttctatatcttctttaatttttttgaacaatgatttacagttttcagtgtagaagtcttacactttccttgttaaatttattcctaactattgtagtttgggatgcaattttaaataaaattgttaatattattttcagattttcattgctagtgtacagcaataaaaattatttttatattgatcttatatcctgcaaccttgctaaacttgtttattagttccaatatttttaaagggcttccttagaattttatatattcaaaagtcatgtaatctgcaataaagttttatttttccactcca

SEQ ID NO: 463399 - DNA, 727 bp, Homo sapiens
tgaactcaagcttggggcaggacaggtgggggggtgccctttaaggaattttgaagaatggggtagggtcatccattaaggggccatgggcacgttggggtctgtcagccttgccagcaggaagtgccagtgcttcctttactgtgggatgatccagaacagcatctttggaatggggccccacttccatggtcactcaaaggaaggagtttctttactcacccttggccctctgcatttgcacccccgtgtctttctctaggacaagctcccagtgatcactcaagaatctggctctcattctaagaggctgtgctgcccagtatggtggttgtgataaatctaaaccagccctgcatgaaacagagtccaagctgtctcccaacagcctgggttcggtccttggctggcccaggcccagttaagcctgtggccaccaagcagctcatctgagcactttgggatgtattcagcctacgttgccctggaaaaggaagcaggagatgtctccctgtgggaaaggagaagagaagttgtctctgagtcccctgtcaccagttggattcatttcttggaagagccagaatgagccactttgaccaccctcgggtgctatgggtgacacaagagctgtccactgggtgtttgcagaataattacactatcttatgtctggatcctgatgatttcacagctaaatggcaaaaataaaacatgtttcccataa

SEQ ID NO: 463400 - DNA, 2669 bp, Homo sapiens
atgctgtgaagtcataggaacccccaccctggggacacaacccctggtcactgagtgatgtatatctgtttttaacaggatgtcgtgtcaagatttccaacagaaattcatcgccatgtttatatgtagcgaaattccaattaccctggaccatggaaacacactccacgaaggatggtcccaaataatgtttaggaagcaagtgattctaggaaacactgcagtaacagctctttctgatgcaggaggacctcggaatgatgctcaattcaacttctctgtgcaagagccaatggaaggcaccaatgttgtcgtgtgcgtcacagttgctgtcacaccatcaaatttgaaagcagaagatgcaaaatttccactcgatttccaagtgattctgcggttccgggagaaatttccacccgtgtttttttcctcgttcagaaacactgtccaaagctcaaataataaattccgccgcaacttcaccatgacttaccatctgagccctgggaactatgttgtggttgcacagacacggagaaaatcagcggagttcttgctccgaatcttcctgaaaatgccagacagtgacaggcacctgagcagccatttcaacctcagaatgaagggaagcccttcagaacatggctcccaacaaagcattttcaacagatatgctcagcagaggctggacattgatgccacccagcttcagggccttctcaaccaggagcttctaacaggacctccaggggacatgttctccttagatgagtgccgcagcttggtggctctgatggaagtatcctttgcggtcatccctcccatgctctgagcacccctcagctctgtgggcttccccagagacctaattaggacagtagggaacccttttcccactcagtattttctcttcttccctgtccttgagtttctggggattctctactaactcactaacataccacagcaacaatgataatagttaccatctatcaagcacctactatgtgctgatcagtgtactggggtgtgtgtgtgtgtgtgtgtgtgtgtgtgtgtgtgtgtgtccttataattcttgaagcaatccctctgatacaaaaaagtatcatctcataatacagtagaagaaacaggagttcagagaggttaagtaatttgcccagatcacacagctagtcaggactcatgctcagatttgaagttggagctttcagcctccaaagtcgatgctctaaccttatcctaaaccgcccctttatagcaccgttgggaactattttcccttttacccattcacttcccactggaggagtctccattatttaaatttcttacttcaacaagtccccaattcaatcaagataactaccaccaaaacatggaaaactgcctggtctacacagcagttgcaccccagcattgctatgctgcattcacagcgggagacgctgggcagaggcagttcagagactcactccaggcccgtggctacaagtgtaggaccaagaattgaaccccagactcctgaccctcctcctgatttccattccccagtgagccatcctcttcctgcgtacccctggcttggcaagcagaagaggctgactccatgagtgtagacccccagatgctgccctgccagcccctcactcggcagtgtgctgtctcctgagacgcattgccccgctcctgcaccgttgacaaggctgaattgggactgtgaagccggccattgtgaaacaagagggcttttttgatgaaatcataaatcaggccctgtctctgctggctgtgctttggaatctatcagagacacagcccatctcccacagaggaatccaaatggtcctcacagtgccacggcccggggatggcagcccctctgcaccttgcacgctggctggttcactcttaactccttacccagctgaaagtgaatgggcggctagaccaagaggagtttgcgcgactgtggaagcgccttgttcactaccagcatgttttccagaaggttcagacaagccctggagtcctcctgagctcggacttgtggaaggccatagagaatacagacttcctcagagggatcttcatcagccgtgagctgctgcatctggtgaccctcaggtacagcgacagcgtcggcagggtcagcttccccagcctggtctgcttcctgatgcggcttgaagccatggcaaagaccttccgcaacctctctaaggatggaaaaggactctacctgacagaaatggagtggatgagcctggtcatgtacaactgaagcaaagaggaaagcagacccatggctcagacctcctggtgaccattctctatgtgccaatataccttcgaagtatacagttcttcacgcagccgacctgtgatcaatatcacctaaaactcgattgttttggtaaacagtatttaatctcccattcatgtaccttgaagtcaagagacagacactgtctccataaataatgttgtagcataaatatttcctgatgaacgcttgatgctttctaatgatcgcaaatgaatactgcagagatcatagttaatttgacccaatcatatttccttgagttctcctttcactcctttttaaaaacagaacatttgattattttcagttttattgtgtctgttccaatctgcatgac

SEQ ID NO: 463401 - DNA, 663 bp, Homo sapiens
tgccctgccagcccctcactcggcagtgtgctgtctcctgagacgcattgccccgctcctgcaccgttgacaaggctgaattgggactgtgaagccggccattgtgaaacaagagggcttttttgatgaaatcataaatcaggccctgtctctgctggctgtgctttggaatctatcagagacacagcccatctcccacagaggaatccaaatggtcctcacagtgccacggcccggggtgagtaacccgaggggaggtcacatttgctggacccctgcaaagcggacaggtctctttcagccttcttcctactcatggctccccttccagttctcagaggttaatgcttttcccttcattagtcatcactgaacccatcatacggcatggccagggctggctttaacatgcccacgagatgcattccctctacacttgtgcacgcaggactctatgtgctcgcctgtggctgctgcttctggggttgccatgacccttcgtgctcctccccaacttctggagccagagggcccactccaactggtgaaggccgtgttctagacccctctcttccctcagatgcaagtgatattggcctcctttcctcagggcttccttcttccaattgcccatttttctttgtaaaacaaatctaagccagg

SEQ ID NO: 463402 - DNA, 3272 bp, Homo sapiens
  misc_feature (2654)..(2654): n is a, c, g, or t
atgctgtgaagtcataggaacccccaccctggggacacaacccctggtcactgagtgatgtatatctgtttttaacaggatgtcgtgtcaagatttccaacagaaattcatcgccatgtttatatgtagcgaaattccaattaccctggaccatggaaacacactccacgaaggatggtcccaaataatgtttaggaagcaagtgattctaggaaacactgcagtaacagctctttctgatgcaggaggacctcggaatgatgctcaattcaacttctctgtgcaagagccaatggaaggcaccaatgttgtcgtgtgcgtcacagttgctgtcacaccatcaaatttgaaagcagaagatgcaaaatttccactcgatttccaagtgattctgcggttccgggagaaatttccacccgtgtttttttcctcgttcagaaacactgtccaaagctcaaataataaattccgccgcaacttcaccatgacttaccatctgagccctgggaactatgttgtggttgcacagacacggagaaaatcagcggagttcttgctccgaatcttcctgaaaatgccagacagtgacaggcacctgagcagccatttcaacctcagaatgaagggaagcccttcagaacatggctcccaacaaagcattttcaacagatatgctcagcagaggctggacattgatgccacccagcttcagggccttctcaaccaggagcttctaacaggacctccaggggacatgttctccttagatgagtgccgcagcttggtggctctgatggaagtatcctttgcggtcatccctcccatgctctgagcacccctcagctctgtgggcttccccagagacctaattaggacagtagggaacccttttcccactcagtattttctcttcttccctgtccttgagtttctggggattctctactaactcactaacataccacagcaacaatgataatagttaccatctatcaagcacctactatgtgctgatcagtgtactggggtgtgtgtgtgtgtgtgtgtgtgtgtgtgtgtgtgtgtgtccttataattcttgaagcaatccctctgatacaaaaaagtatcatctcataatacagtagaagaaacaggagttcagagaggttaagtaatttgcccagatcacacagctagtcaggactcatgctcagatttgaagttggagctttcagcctccaaagtcgatgctctaaccttatcctaaaccgcccctttatagcaccgttgggaactattttcccttttacccattcacttcccactggaggagtctccattatttaaatttcttacttcaacaagtccccaattcaatcaagataactaccaccaaaacatggaaaactgcctggtctacacagcagttgcaccccagcattgctatgctgcattcacagcgggagacgctgggcagaggcagttcagagactcactccaggcccgtggctacaagtgtaggaccaagaattgaaccccagactcctgaccctcctcctgatttccattccccagtgagccatcctcttcctgcgtacccctggcttggcaagcagaagaggctgactccatgagtgtagacccccagatgctgccctgccagcccctcactcggcagtgtgctgtctcctgagacgcattgccccgctcctgcaccgttgacaaggctgaattgggactgtgaagccggccattgtgaaacaagagggcttttttgatgaaatcataaatcaggccctgtctctgctggctgtgctttggaatctatcagagacacagcccatctcccacagaggaatccaaatggtcctcacagtgccacggcccggggatggcagcccctctgcaccttgcacgctggctggttcactcttaactccttacccagctgaaagtgaatgggcggctagaccaagaggagtttgcgcgactgtggaagcgccttgttcactaccagcatgttttccagaaggttcagacaagccctggagtcctcctgagctcggacttgtggaaggccatagagaatacagacttcctcagagggatcttcatcagccgtgagctgctgcatctggtgaccctcaggtacagcgacagcgtcggcagggtcagcttccccagcctggtctgcttcctgatgcggcttgaagccatggcaaagaccttccgcaacctctctaaggatggaaaaggactctacctgacagaaatggagtggatgagcctggtcatgtacaactgaagcaaagaggaaagcagacccatggctcaggttgtctttgcagtttttgatgccatcatctgtagcatatgagtctttaattttgatggagtctaatttatctattgttttcttttgtcacatatttttggtggtatagctgagaaatcattgcccaacccaaggtcaaactatttattctgttttatagtttagctcttacatttaggtctttgatccattttgagatcattttttatatggtgtgaagtaacgttctaatttcattcttttgcattcattcatttgtcccagcaccagttgctgaaaaaactattcattctcctgtttctttgtcttggaacccttttcaaaaatcaatttaatntaagaatgtatttatggacgttcctttctgttcaattgatttatgtgtgtatcttatgccagtatcacactttgttgattgctacaattttatagtaacttttgaaattaggaagtgtgagttttccaactttattttacttttcaagactattttggctcttctgggttccttgcatttacatataaattttagaatcaatttatcagcttctgggattttgatagagattacattaaatctaaaggtcaatctggggaatattgccatcttcacaatataaaatcttttgttccatgcgtctcttcatttttctatatcttctttaatttttttgaacaatgatttacagttttcagtgtagaagtcttacactttccttgttaaatttattcctaactattgtagtttgggatgcaattttaaataaaattgttaatattattttcagattttcattgctagtgtacagcaataaaaattatttttatattgatcttatatcctgcaaccttgctaaacttgtttattagttccaatatttttaaagggcttccttagaattttatatattcaaaagtcatgtaatctgcaataaagttttatttttccactcca

SEQ ID NO: 463403 - DNA, 887 bp, Homo sapiens
atgctgtgaagtcataggaacccccaccctggggacacaacccctggtcactgagtgatgtatatctgtttttaacaggatgtcgtgtcaagatttccaacagaaattcatcgccatgtttatatgtagcgaaattccaattaccctggaccatggaaacacactccacgaaggatggtcccaaataatgtttaggaagcaagtgattctaggaaacactgcagtaacagctctttctgatgcaggaggacctcggaatgatgctcaattcaacttctctgtgcaagagccaatggaaggcaccaatgttgtcgtgtgcgtcacagttgctgtcacaccatcaaatttgaaagcagaagatgcaaaatttccactcgatttccaagtgattctgcggttccgggagaaatttccacccgtgtttttttcctcgttcagaaacactgtccaaagctcaaataataaattccgccgcaacttcaccatgacttaccatctgagccctgggaactatgttgtggttgcacagacacggagaaaatcagcggagttcttgctccgaatcttcctgaaaatgccagacagtgacaggcacctgagcagccatttcaacctcagaatgaagggaagcccttcagaacatggctcccaacaaagcattttcaacagatatgctcagcagaggctggacattgatgccacccagcttcagggccttctcaaccaggagcttctaacaggacctccaggggacatgttctccttagatgagtgccgcagcttggtggctctgatggaactgaaagtgaatgggcggctagaccaagaggagtttgcgcgactgtggaagcgccttgttcactaccaggtacgggcacattctctgt

SEQ ID NO: 463404 - DNA, 539 bp, Homo sapiens
taattttcatgtattttatttcactcaaataactaaaacatgatcatttcaacatgtaatcagtataaaaactattattgtgatattttacaatttttggggtaccatcttaaaacccagggggcactttaccttaattcagaccagccacacttgaagtgctgcagggttacacatggcttgtggctaccatgttggacagcacaggttctctggtcagatgggatatgaaaaatataactggtggccagtggtccttcacttgccagctactcacctgctgtgtgacgctgggatgggcgcttgccctctctgatgcatcttggtgatgggaacacgcttgatgaatgacagcccattgtcagggtctcatcctccaaagctgtgtgtatcacttactttttgcagactcggaaaaagccggctgttctctaccgcttcttgctagaaacaatggcctatgttaaaaataacttgtcaagaatcagaatcgctgcttgcaacttggcaggtgagcagagagacgtctcctgactcaa

SEQ ID NO: 463405 - DNA, 1748 bp, Homo sapiens
ctgcccaatgtcctcccttccagttcatgagcggcccagttctgtaccaggagaagctgctgaagccggcagctttgctgctggagaagggtgccgaccaggaggaagacgaggccctgcgggtgctgtccctgcgcgccctcggcaacatggccctgggcgcccccaagaaggtgaagcagtaccggaaggtcttgctggagaagtgcctgggccccctgagggagcccgtgagcaacagcgtgactgccgagggcatggaggccctgaccaagatcctggctgagctccgggaaggggatgtggggtcctctttcgacgccatgtctgagcagtgcaggatcttcttcgacaacgagagcgagctgctgcgtctgaaagccttcatcctctttggaaagctggcaagggtggtcgggatgtccaagaagcatttcttcaaaggggaggtgaagaaggcctggatccccctcatgctgcactcccaggacccctgctccaatgcagcccaagcctgtatggctaccatgtttcagtgtgtgcacttctggggctggaagtccctggagcatccctcagggccaagtgataccgctactgatgacaagatgaccgttttccagacaaccatgtgctccatcctggtgaggaagccaaagggggaaccagcccgtcccaggtggccacacgctggcttggagctggggggtcgagattgccacagctctttcttggggccctatgtttaccttccacacatgccatgtcgagaccggcactgtgcagcagaaatagaaggcaagtcatgtgcctatttcagctgtctgatgtttcttttagtaggcacatccagaaaagtgcagaggtgaaactaattttcatgtattttatttcactcaaataactaaaacatgatcatttcaacatgtaatcagtataaaaactattattgtgatattttacaatttttggggtaccatcttaaaacccagggggcactttaccttaattcagaccagccacacttgaagtgctgcagggttacacatggcttgtggctaccatgttggacagcacaggttctctggtcagatgggatatgaaaaatataactggtggccagtggtccttcacttgccagctactcacctgctgtgtgacgctgggatgggcgcttgccctctctgatgcatcttggtgatgggaacacgcttgatgaatgacagcccattgtcagggtctcatcctccaaagctgtgtgtatcacttactttttgcagactcggaaaaagccggctgttctctaccgcttcttgctagaaacaatggcctatgttaaaaataacttgtcaagaatcagaatcgctgcttgcaacttggcaggaattattatgaagcagatgtctacacattatctgaaaaagctggacttcccagcattacggaattccctccaggaactacagctggacccggatcccggggtcaggagggcagccctggagacgctcacagtcttggatagctgtagtcagcatgggtttctggcttcaccccaaggaatgtcctaggtggtccaaacataagacgtaaactgtcttcttagtgccaaatgcaagccctttttaatttagtttgtaagaagtttagtttgtaggaaaaacactattgtaaaataactagtatccttttgtttccttccgttgaaataaacctccactgtcgttggagtagacttgtgactgtaa

SEQ ID NO: 463406 - DNA, 1077 bp, Homo sapiens
  misc_feature (1)..(2): n is a, c, g, or t
  misc_feature (5)..(5): n is a, c, g, or t
  misc_feature (7)..(7): n is a, c, g, or t
  misc_feature (11)..(12): n is a, c, g, or t
  misc_feature (16)..(17): n is a, c, g, or t
nnagngnaganntgannaagctggcaggggtggaaatacatcaagggcttgcaaattgcctgcctgaaggaaagaaacacagactggttctattctctttacccagtagtaagtaaatctggcatgagagagagagagacagacagacagactctaggaaagaaaaaaagtgagttgtttgacacaaaggggaggttctgtatctatgttccttatctgaatacagtcagaatccgatggcttcaggttggcctccctaggatggcactttactcccaagtcctggtcattgtcaccaaaacgcagagctccccctgccctgctcttacccaagtctcccttctcagttctgatcatccatcctacctggagctttggaggcaggttgccttgttagcagggccagctgtttctccagaatttttaaatggagtgattgaatttaaacaagtcaacattttgatttcaaacatcaaaaaaggtgtccagaaatctcaagaatttgagacatcctaaggaactttaagtgctgtgagccacaagtaacatcaagaaaagacagggatgaagaaccgcacttacaagctaagtgtaagctcatcctacacatgtcatttggaccagaccaaggctgctgtcatggaggacccacaccacagcttgggaaccattcatctaccagagggtcacatgacttcaaatgactcttctaggggccacctgccatgatagggtaccagctcttcctctgaattcccaatccatttcttgagaactactgtttctaataagaggggaagaaggtcatgtgggaatcagttaaatcacgtgtggatagaagacaagttccagctttgtgggaaatcctgtagccttcgccaggtacaccctgacaatctcagaactgatcagagtttttgttccatgtgagatacccacgccactttaaaaaacaaactatcctgacatctaattactttgtgaatgattgtaatggcaataacaatagagatggaagaattttggaaacaatactagtttcacagctttcatgtgagatgccaaggttttagcatc

SEQ ID NO: 463407 - DNA, 2151 bp, Homo sapiens
  misc_feature (1)..(2): n is a, c, g, or t
  misc_feature (5)..(5): n is a, c, g, or t
  misc_feature (7)..(7): n is a, c, g, or t
  misc_feature (11)..(12): n is a, c, g, or t
  misc_feature (16)..(17): n is a, c, g, or t
nnagngnaganntgannaagctggcaggggtggaaatacatcaagggcttgcaaattgcctgcctgaaggaaagaaacacagactggttctattctctttacccagtagtaagtaaatctggcatgagagagagagagacagacagacagactctaggaaagaaaaaaagtgagttgtttgacacaaaggggaggttctgtatctatgttccttatctgaatacagtcagaatccgatggcttcaggttggcctccctaggatggcactttactcccaagtcctggtcattgtcaccaaaacgcagagctccccctgccctgctcttacccaagtctcccttctcagttctgatcatccatcctacctggagctttggaggcaggttgccttgttagcagggccagctgtttctccagaatttttaaatggagtgattgaatttaaacaagtcaacattttgatttcaaacatcaaaaaaggtgtccagaaatctcaagaatttgagacatcctaaggaactttaagtgctgtgagccacaagtaacatcaagaaaagacagggatgaagaaccgcacttacaagctaagtaagattaaacccagcatggagatatatgaattaatatgaactctgagaaagaaattggtcagctaaaaaatatatggctttcctgaatagacaaaagaacaaagattttccctttgagattcggcaggaagcttgcaccgagtgaaggatttataaagattataggagataacacaaagctattttatctctttaaaaaaaatcaaaggtgtaagctcatcctacacatgtcatttggaccagaccaaggctgctgtcatggaggacccacaccacagcttgggaaccattcatctaccagagggtcacatgacttcaaatgactcttctaggggccacctgccatgatagggtaccagctcttcctctgaattcccaatccatttcttgagaactactgtttctaataaggatttgctcaaaatggatttgcaaagagaaaaaaaatttaatgtcacactgccatgataagtcaaccaaccatctcatgtatcaaaggagagaggcagagaaagaaaaggaggaggataaagaagaggaggaggaggacgaaaggaaaaccaagaggaggggaagccacttcttactttggattaatgtgaaactaaatagtttactacattttaagtgggaaaatgttagttgaaaagatatttgtcaaccacaaacatttgaaagggaagcattccaaagattttcactgtttatgttcaaattacaacatgtgcagaaagttgtgcaactgaaaatcctttcaaacaacagctacaaaagagattggtcagttaggacaggaatagaaagtggaaacttagaagactggctactccttgtgtatgattgctggggtgagtctgtgctgagaactttttacaaagggtgtcctttgctgatatgagaggggggtgtcaaacttttgagtgatcactgtgggtcctcagcttagacatcttctctggcccaagatggcaccccttgctctctttccatgggacacagggaccttgccatccttccatcttataagccttctgtcatgatttttacttcatcctagatagccttaatttgggccaggtctccaggttcctccactttcttctgtcccatccatacccctcaccaatcctctgtaaattcctttccaggattttactgagaactacagagaaacaggctgggaataacaaacatggggagttatgtagttaacatacactttgacatcacctagtcattttcctgagtatatagataactctgttattactggttataaggtccatgagaagcctttatccttttctggaaaccaagaaagcacctgccctccctcagtcctaaggggagaatctttatgggtgtaacaataaaatggataatgggaaattctgatgtcctcaagcatacattcagatgtccccaatgagcatcatttgtatatcaagggaactccagagagatgatccacaattcagtgtgtccctttggccagtagagaggtcaccttagtctggaaataatgatgataataatgttaaagaaacctaactaaacaag

SEQ ID NO: 463408 - DNA, 141 bp, Homo sapiens
taccagctcttcctctgaattcccaatccatttcttgagaactactgtttctaataaggtactgtttctaatacctttccaacaatggtttattcatttatccatacatttaaaatacagattttttttagcatctgccat

SEQ ID NO: 463409 - DNA, 5307 bp, Homo sapiens
tgctctggctaagactttcagttctgtgttggaaaagagtgaaccacttctcccactccgtgggatatagacttgaatattatgtactggaaatgaagaggaaagaccaaaatcatgaattatttaggagacagaatccatatgatttgggaactgatattgtggtatgaagtatcaattggctgggaaggaggtgtttatgtacaaacctgtggtcacacattacatatagattgtcataaatcttacatggaatcattacggaatgaccaggttcttcagggcttctcggtggacaaaggagaattcacgtgtccactctgtaggcagtttgctaacagtgttcttccatgttatcctggaagcaatgtggaaaataacccttggcaacgtcctagcaacaaaagcatacaagatctcataaaggaagtggaggagctgcagggacgaccgggagctttcccagtaagcatcagtatcttaatgatgccacaacccttacgcaaagaagttactgttggcactggctttcaacagaagacgaagttcatgctcaaagaggatgcaatacatgaaattaaccaaacttactgaatttaattcagtagaaacagagtttaaaaactatatcataaagtaactccctcagtcttgctggtcatttctaggttcttgctgtaatagtgctgtactggatgtcttgtacatatagctattttttttcttttggattatatccctggaaagaattcccaggggtgggaattacttggtcaaaaaacatgatttacatatgtttatttacatataattatgtaatttatatgctgtcttttaaagaagtgttggaatagctttgaccaactacccagtttcattgtgaatccagaggtgtacagttttacccaaattttgaagaattgaagctcatatgcttgaaaaataatataatcacagttttactctactcattaaaaattatttccaatgtaaattttttataattttcagtgaccagtgtaaccaatattttaattttttcagagtacatgtgatgcagaaaagtcttacgaagtattactgagctttgtgataagtgaactatttaaaggaaagttataccatgaagaaggaactcaggaatgtgcaatggtatgtttctgcaaaaatcagatgtagcggttatttagtaaaaaatttacattttcttgccattatgaatgtaatttttaaaaactctttattgtagactgacttgttcaaattttcttttttaactttaggttaaccctattgcttggtctcctgaatccatggaaaaatgcttacaggacttctgcttaccttttctcagaatcaccagccttcttcagcaccacctttttggggaagatttacctagctgccaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaagaccgggatcttaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcgtatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactatgaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtatttgtgcagtgtaatcactactatttctgctcggtttcctaaaaggaaaaaaaaggcgcagtggtgatgaccctcatgaatgagccacgcttctgcattcttcttagaaactgctgtgaaaaacaatttatgtttgcagggtttaaaaatcagtaaaaatgggaatgattgagctaaaacccactctatgagaaggaagattactgaaaagcatgtgacatattgctacaaagattttttttcctaaatgattcagtaattgaatgattatttaatatatagtgctatcaagcaatccctggtactttggacttccatggcttgttatataaaattacatttttacatgtaaaaataaactaaacaaatctaatgataaaatatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgatcgttatgaataccagaccatttgtaagtgtggttgaagagcaaaatgctaattgacatctctagtaaatactgttacaggattcatgaacttgaataattctacagtttgaaactctgatgctatatatacatggtataatgtattcagactttgattactacttatttaaaatggaatgttttatggttgtgcatatggatgtgaagtgaaaatattagccttaactttaaaatttgggtgtttgatagtgtttattttgatattggtgaattagtcaccagtaaattttaaaaaagcacttggttgaaaattgtacttgaatacatacatgcatgctgctaaactagaactttaatttttccccataacttttataagtcccatttataaacccacttttaaaaataacaggtccaagttagagtgatgtgtgtatattattcaaaaaaatgtactggtgtgatatcttgtatgaatgatcatttaaatacagtacattactgtagaagctaaattgatctttataattaagcagaaattacaaaactaggaataatcaacattgtaagatatgttaataaaaacctgctgtcatttggtttgtgaaaggtccttaaaatgtttactgcttacatgtttttttttcccccaaagatattgacagtaatatatgtgagtgaacatggctgaaaagatcaaagcacaacataattagtagttgctttagggtggagtaagtgtaaagggtttgctttgctttttttcttttatttgcagagtgagttcttgcttcttcagtccttgtctcataatcaatgcacattctttgctaagtgtgtgtgtttggtagggggagaaggaaatgggtatgtagatctgaggaattgtgatctctgttcttttctgaaagttcccagccagacttcagaaatgtttagtgctttatgagaatgtttattttgagtggtttgcattcttgtttgaattgacagtcctcacccctacctctccatcctgaagctcaccagccatttatcagctagcagtccatttctcttcagacctttctctgttttatgtattccgatatttactgatttctgtgacttagaaaaagatgctgactaaaagcactgaaggcttagaggaaacagcaatatgggaagagatgtggtctaagactctctgtattatctccaggattctaattgctgactctcaaatggctgttgatggcttatatttgagatcatatttggggttgggggggacacaaagcatggttttaaccactagaatcaaatcaccgagagaagatgaattcattggtgaggatgcctgatgattgatgattgtgggagagcagatgacttatgactgtgtctcagtcccattcacagcacatagttctttcctctgccttatgatctggctagatgatatcaagcactgcttagttcaacagggatgagctggagtgggcaaaacagcaacatgatcacttctctatttatgacacttcaagctccctattaattaggcatatcaggtatggaagagctatgacctgccatcttagtg

SEQ ID NO: 463410 - DNA, 3916 bp, Homo sapiens
ctagcagtgagtctttaaactgctcgtctgagcagccaggaaattgggtgttatggttattaccataactctcaaagaacgaaaacagttgagttcagaactaggagctggtgctgctatagacaggttcatggctggctgtgacacatgccagctgattgatgtcatagaacatcaggagaccatcaaaaagcatatcaaaatgcaaaaggacaagttgggaccatttctttcaggagccaatagatctccctcactagaccccgtgcactactgctgcacagaagaagagagaagaaaggttttgaataattgtatcatgggtagtttttggattccactacttgtgggctacttctgctggataaatgtgttgcctacatacagtattctcttaaccctgcttctcaaaatcctatattttctgttgtcaagtcaagaattacaaagccacactttggcatggagaatactactctacagttactcatccttaatgacctgtagtacagaaaagtgaaaacattgtggaggagataaattaccaaaatagaagataagctgaaaaggcaatggaaaatatatcatacatatcaaagttgctcatttatgctattttgccataacaatgcatacaactgaagcacttcccttctccattggagttttgtctctagaggtattaaatattaatcttataaagaaaagaaagcaaaaaaaaaaaaccctgaacacatgttaataggttagggttttaagagcaaatcacaaaagcagaataagtacttggaggaaaaaaacaggaagagagagaaagagggagagagagagagaggtggggtaaattgtggaccctccttttaaagaaacaaaattttccacagagttgcattaatacttaaattggactaactccatgtgaatcctcgtaagaaatactatttcctttcaattaactcatctatcctacaattacatgtcatgaaatctaaaggcaaatatgtttacccagtaagggaataacattcgaggcaaaagtgatgtcacaaacagatgggaattccaagtaatactgagtcatggttctaggggaataaaacaattactttacagctcagtgcaatgtagtatttaaagaaaaggtatttcaatagaatagcccagacaattattcaacatttaacagagattatattagtctagatatgttaatttggattttattctgttttttatttatgttaataggtttggttactggtttaaagaaatattagaagtttatcttttatttttacaaatagattaacatttgtcttagagggagttctgcccttcatggataatacctttacctgctaaatctagatttctttttctataaataatttttttgccctttgggagcaatgaatatgtatgatttagatattatacctctatgtttctccaaaacctttcaagtcactcttattgcttacaattgtatgggcttagagctttagatttttagcttaaagtttttcagtgtgttaaaatgcaaatatatagaaaacgttgatgaaccacaacaagccatttgtatcctggtgtaaaatagaagctcagaaagccagtttgataagggaaaggagaagaatgggaggtcactctgtattggggcagggaaggggaagagcggagagcctctggtgttgaaatgcctgcgtcacaactgtacttcagtccagtcccgttgaacatattaacacaagtatttgaagaaaagatgctagctcctattcatgatgaacaagaaaacttagtcataagccaccttagtggccatcaccctattattgtgtaaatattaggtttcctgcttgtaaagaatttgctgtttggttcctttcaggcctgtttgcgtgttcccaactgctatgtggccaagaataagtaagtttatgtaacgttccaaagaaactgctcaaaaccgtggctcattttaactaagatatgaatagaaggcagaaatgaattcacaaacacttctttcacatgcactgcaaaatataactttttactcctccaggccaaaatggtcttaaccattgaagtaattatagctcacaactataatttaaagttagatctggttgattctaaattcacacaggaaaataattcactcatcttactggaacattgacgtaaataactttataaaacccatacagtttcagcaatcctagaaagtgttgtgaatccaaatagaaacagttgataaattaataagacagttgataaaataatttagtaagacaacaataattgtctaccatttattggttaaagtattatgcttgacactttataaatattacctatttaatcgttacagcaatctttaatattggtatccttatttacaaagaaaatgagtgcagaaaggacaagtagttttcgtgaaaccacttggaagtggaggagaagggttttgaactcccatcatctcaagctcatgctttgccatctcaccacagtgaaatgatggaaaactcaagtctgcaaaccttaaattttcaatcaaagggaggaaaccttgggcaaatgaagaggtcatggattgagtgtgagccttcacaaactcctccttgtatcttaagtctgctggagtactggcctgactccactcactcactgtgtacttcgtttgaaactaacaaacaatacagtgactgtcagtagatgttgcctcctcagtctacagagccaacaaaaattatggaaaagtaagttacttcactggagtttgagatgtaaattctgaattgatcatgctgtttctttaaaattcccaagtaaaattttctactcaattcacaaagtatttttaaaatacttgctttatttttatttcttctgttttccattccactaatatttgcttatctttattaatgtctgcttccaagttcttttactttgataaactttttccagtttttatgatgcatcttatctcaccaatgataagaaaatacagatatatttattattcgcaccagtgaaaaactgtcctaaactgaccctggcttacagatgtaccactggatcttggactaaatgcaaagaagaacagcagaatggttggtggagattcctatgctttcgacccatggcggggtcactaagtcaggtgaatcacctcccacccctaaagattcccacccagttatgccttctaatgtgctgttcacagtttatcaactgattctgaaattctgagacttaacagttttaaactgactgtttatgtttcttatttatgcttttgcctaccccatcagtctaaacctgatccctgatttctctccattttgttttaacttcatttgaaactcacgactttaaagtgactgtacgttagttttgaccacaactaaacctggctaataaatggctccactttctttctcactttctttcttttaagaaataaacttttcactttgaaataattataaaatttgtaccatttactttggataatgaagttatgtttattttaggaatgcaagattggttaaacattccaaaatcaatctaattcttactatttcaacagaatagaggagaaaaatcatgtgatcatctcaagaaatgtagaaaaggcattttaaaaagtgaaacttccacttttgacaaaaaagcttagtaaacaattacatcttcattctctggttagtagcaaataacaagaaacactatctcctaaagaaaacaagaaagccttaggttacctaaactcaccttctaaacttgtttcacttcaaaaaggtaaaataaaatattcatgtgctaccattatgtggtttaacaaagaggaaggcatttcctcttacacatattaatccatgattgtccataggcttat

SEQ ID NO: 463411 - DNA, 4013 bp, Homo sapiens
ctagcagtgagtctttaaactgctcgtctgagcagccaggaaattgggtgttatggttattaccataactctcaaagaacgaaaacagttgagttcagaactaggagctggtgctgctatagacaggttcatggctggctgtgacacatgccagctgattgatgtcatagaacatcaggagaccatcaaaaagcatatcaaaatgcaaaaggacaagttgggaccatttctttcaggagccaatagatctccctcactagaccccgtgcactactgctgcacagaagaagagagaagaaaggttttgaataattgtatcatgggtagtttttggattccactacttgtgggctacttctgctggataaatgtgttgcctacatacagtattctcttaaccctgcttctcaaaatcctatattttctgttgtcaagtcaagaattacaaagccacactttggcatggagaatactactctacagttactcatccttaatgacctgtagtacagaaaagtgaaaacattgtggaggagataaattaccaaaatagaagataagctgaaaaggcaatggaaaatatatcatacatatcaaagttgctcatttatgctattttgccataacaatgcatacaactgaagcacttcccttctccattggagttttgtctctagaggtattaaatattaatcttataaagaaaagaaagcaaaaaaaaaaaaccctgaacacatgttaataggttagggttttaagagcaaatcacaaaagcagaataagtacttggaggaaaaaaacaggaagagagagaaagagggagagagagagagaggtggggtaaattgtggaccctccttttaaagaaacaaaattttccacagagttgcattaatacttaaattggactaactccatgtgaatcctcgtaagaaatactatttcctttcaattaactcatctatcctacaattacatgtcatgaaatctaaaggcaaatatgtttacccagtaagggaataacattcgaggcaaaagtgatgtcacaaacagatgggaattccaagtaatactgagtcatggttctaggggaataaaacaattactttacagctcagtgcaatgtagtatttaaagaaaaggtatttcaatagaatagcccagacaattattcaacatttaacagagattatattagtctagatatgttaatttggattttattctgttttttatttatgttaataggtttggttactggtttaaagaaatattagaagtttatcttttatttttacaaatagattaacatttgtcttagagggagttctgcccttcatggataatacctttacctgctaaatctagatttctttttctataaataatttttttgccctttgggagcaatgaatatgtatgatttagatattatacctctatgtttctccaaaacctttcaagtcactcttattgcttacaattgtatgggcttagagctttagatttttagcttaaagtttttcagtgtgttaaaatgcaaatatatagaaaacgttgatgaaccacaacaagccatttgtatcctggtgtaaaatagaagctcagaaagccagtttgataagggaaaggagaagaatgggaggtcactctgtattggggcagggaaggggaagagcggagagcctctggtgttgaaatgcctgcgtcacaactgtacttcagtccagtcccgttgaacatattaacacaagtatttgaagaaaagatgctagctcctattcatgatgaacaagaaaacttagtcataagccaccttagtggccatcaccctattattgtgtaaatattaggtttcctgcttgtaaagaatttgctgtttggttcctttcaggcctgtttgcgtgttcccaactgctatgtggccaagaataagtaagtttatgtaacgttccaaagaaactgctcaaaaccgtggctcattttaactaagatatgaatagaaggcagaaatgaattcacaaacacttctttcacatgcactgcaaaatataactttttactcctccaggccaaaatggtcttaaccattgaagtaattatagctcacaactataatttaaagttagatctggttgattctaaattcacacaggaaaataattcactcatcttactggaacattgacgtaaataactttataaaacccatacagtttcagcaatcctagaaagtgttgtgaatccaaatagaaacagttgataaattaataagacagttgataaaataatttagtaagacaacaataattgtctaccatttattggttaaagtattatgcttgacactttataaatattacctatttaatcgttacagcaatctttaatattggtatccttatttacaaagaaaatgagtgcagaaaggacaagtagttttcgtgaaaccacttggaagtggaggagaagggttttgaactcccatcatctcaagctcatgctttgccatctcaccacagtgaaatgatggaaaactcaagtctgcaaaccttaaattttcaatcaaagggaggaaaccttgggcaaatgaagaggtcatggatatgatatgaaaatattttatgattttgcatgtgagaagctactgcatagatgaattcaactgcaggatcccttttaaaaaatatgtatcttcaagattgagtgtgagccttcacaaactcctccttgtatcttaagtctgctggagtactggcctgactccactcactcactgtgtacttcgtttgaaactaacaaacaatacagtgactgtcagtagatgttgcctcctcagtctacagagccaacaaaaattatggaaaagtaagttacttcactggagtttgagatgtaaattctgaattgatcatgctgtttctttaaaattcccaagtaaaattttctactcaattcacaaagtatttttaaaatacttgctttatttttatttcttctgttttccattccactaatatttgcttatctttattaatgtctgcttccaagttcttttactttgataaactttttccagtttttatgatgcatcttatctcaccaatgataagaaaatacagatatatttattattcgcaccagtgaaaaactgtcctaaactgaccctggcttacagatgtaccactggatcttggactaaatgcaaagaagaacagcagaatggttggtggagattcctatgctttcgacccatggcggggtcactaagtcaggtgaatcacctcccacccctaaagattcccacccagttatgccttctaatgtgctgttcacagtttatcaactgattctgaaattctgagacttaacagttttaaactgactgtttatgtttcttatttatgcttttgcctaccccatcagtctaaacctgatccctgatttctctccattttgttttaacttcatttgaaactcacgactttaaagtgactgtacgttagttttgaccacaactaaacctggctaataaatggctccactttctttctcactttctttcttttaagaaataaacttttcactttgaaataattataaaatttgtaccatttactttggataatgaagttatgtttattttaggaatgcaagattggttaaacattccaaaatcaatctaattcttactatttcaacagaatagaggagaaaaatcatgtgatcatctcaagaaatgtagaaaaggcattttaaaaagtgaaacttccacttttgacaaaaaagcttagtaaacaattacatcttcattctctggttagtagcaaataacaagaaacactatctcctaaagaaaacaagaaagccttaggttacctaaactcaccttctaaacttgtttcacttcaaaaaggtaaaataaaatattcatgtgctaccattatgtggtttaacaaagaggaaggcatttcctcttacacatattaatccatgattgtccataggcttat

SEQ ID NO: 463412 - DNA, 1197 bp, Homo sapiens
cctagagctgccgtggatcccaaatgcctgtccagtttggatctctgggaggcctggctcttagctttccccaggatcccgtctcttttaaagcaatgtgtattcttacagcaaattcccattacttgtgggtggttgagaggatcttacattctttaacatccaaaggttctgtcataccatccacattttcagacaggttggtcagattcattagatggaatcctaccatccggattgctcagaaccccagcctagggggctgtgactccatgtgggagtctgaacctcctcaaggggcctcagctaagcagcaagggggtggagagagcagctcagagctcagggacacagagcttctgcactccgcccctctgctggtcctgacttcggagacttagaaatgggctgtcctcagcggtgctctgacttcaggaagccagtgaaccggtgtctgagtcactgcagttagcttgagtctctcccagacccagccattcatccacatcaaataaagacagtccaggccccagctgggcctgccccggggcacctcacaacactcctgggagaggaaatcctgagtcaacctggctgggaaccaactggaaaccagggactttagtcatggctgtctgctcttgggcgggccttgctgtgctacctgcttcatctgaagtaccggtgacaagtcttccacctccaggtgtctttctgtgaaaacgtttcattgcgagtagctaaaagaaggcaagataaggaaactgaggcatggaaaagttacacaactttccctcactgctcagaaaacagggccctggagacagatcgctaccctcccacctgagttcagaatcaccctgcaaaccgcctcctggtagataagagatgtacaaagaatcatcaaaaagatgccaacaagaagtgaaattccacgaggaacttgaaaaatatgttcgcctgtctatctcagggctctggttccagctctagctctgtgtctagtgatttccttttgggtttgtttgttgcttatcctgtagatcattggctgccaaaaatgagacaaagatgtggtcctggattgtaccatctttctctgctttaaagtcagtacaaatcacttaaaaacaaaatgaaacaaaacatgttgcctggcccttcaggggaagctgagcctgctggtcaggagccagg

SEQ ID NO: 463413 - DNA, 546 bp, Homo sapiens
tgtttgtacaactcttgttttctcttttttaaaaataataaaacagtaaatgaagaaaagacacagagaaggatgtgacatgcctgggccgtggagcactctgagatctcatcgcggacaccactgcccacacctccatcccgtcctgcgcaggccgacactcactgacgttgaaggctgccttcagtgcctggatgtctgcggccaccccagacatgcggtagatgcccacctcctccatgcctcggcgctcgatctcctccacgcactggcgcacgatgtagggcaccttggacctctctctcctgtccaccaaccaatgaaaggatgaagggacttcagcatacagacatgatgaaatatgcctcatgcataaaaattcatgacaacatgtcatttgcaaaaacacagacgaaccatgcaggaaaaatgccagggaaaagtgcatggcagcttcctcctcagcactcagggcccagacaggagcggttttctccccaggacacagctccaagtcgtccagaagcctccgtgatgcccctcctg

SEQ ID NO: 463414 - DNA, 2305 bp, Homo sapiens
tgtttgtacaactcttgttttctcttttttaaaaataataaaacagtaaatgaagaaaagacacagagaaggatgtgacatgcctgggccgtggagcactctgagatctcatcgcggacaccactgcccacacctccatcccgtcctgcgcaggccgacactcactgacgttgaaggctgccttcagtgcctggatgtctgcggccaccccagacatgcggtagatgcccacctcctccatgcctcggcgctcgatctcctccacgcactggcgcacgatgtagggcaccttggacctctctctcctgcgggaggagggaatgttctcagtgtcctaacagccctgcttgggccataacacaggagacctgctccctatgtgcacacccggaggtggggtgaggacggtgatgaaggtacccaggtctggggctgcacacagagccttctgcatgcctgtcctccctctgcaagctctgtcctcattgcatgtgctttctcaggaacctttcaagcggccagaacccctgcaaatcacacatgacctttgtgggaaggtcaggaggcctgtctaagtcaagtcagcacgggaagggcatctgacagattccaggcctggggtgagcagcctgtgcccccggctgggaggtcagacccggtgttggtcctgccacccacgtgctgtgtgagaggagaatccgtgacccctgccctgggccttaacacacatccgacgaatgaatgaagggttgcctcagcaccggtgctccaagtcctgcgatgctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggctcatgtgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctgaggaagcaaatgaattctcagaggaagtggtctgtgtctgcatgaactgctctcaaaccaacaaataggcttctcttggcaactgactcgtgacaaagggttcaagattgtttgaaaaaaaaaaaggggggggggggacagggaggcagtaggtcctggaaaagtaaattctttattttacaataagaaagtgattacatattttatttttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcggagatcgccccactacactccagcctggtcaacagagtgagactctgtctcaaaacaaaaaaaaaaaaaaaaaaagaagaagtcattcccaacattgctcatcaaattatgaccataaatttccaggatcagactaacggctaaagagactgatgcatcaacaccaggcagagaataaagcagattttttttgttttgttttggagagcctctaggaacttgaaaaatacatatgccacactcttaagacccggtggttcttaatcagggatgttcattaaaatgctggaaaactctaaagatttccaggtcccatccaaggagattttgcttctgattgactggctagtggcctggccattggtattttgaaaaatccctccaagtgattcttttacatcccagctagaaaaccctaaattaaaggtgaaaaaccagacaccaagtggcatttaaataaatgtcaactttaactccacaaagcatctggttgcatgtggacagaaagagaaggaaagagggccctatatctggataacttggaaatgtgctccccctagcaagatatctaccaaaattaaaaccatatttgaggatgctggcactgtgagcaatatataaatgatgcatgtaacatcatttaatatgatcttatttttaaaaatgagtagagtggtgttttctagctgttagtgtttccaaatatcaatgt

SEQ ID NO: 463415 - DNA, 3432 bp, Homo sapiens
gacaacaggttgagcatgcagctcttctttgcaactgggtctgaaagagctgcaggaggcagtgggtcactcccctgggttacgacaagccggagacctctcccgaggtggtcacatggagcgcccgggacacgagtccttgcgcagtttaggcttgtcatcatcgtcacacccacagcgctggccgccagtgaggaccctgtgaggggcacctgtgtggggtgtgaaccacctgaacgccttttctctgcctcgcaggggtcagcagcacccggcaaacagcagcaggaggagccgctagagcagctgctcatgggcagagctgccctcgggcaactcctgccaccaccccctccccagggagcccaaggcaggggaggctcagcatggaatgaaacaggggagtgagggacacaaggaggtgggaagtgggagggtcccagccccaccaagtacgcagagaacccctcgttgtcctggacaccacaggggcacctgcaggctgggagaccaggtcctctgtgcatgggcccgggaggcagacctgccctaagggtgatgcacaggctacaggtgctgcacgctccagcgcccactctagacatcagcctccaggttgactaagggtcaggtcatgtttgaaaccatgcttggctggaccaggacccatggcaagagcacctgggcaccagtgtttagccctggtctgcaggaaggaggacagcagactttaggaccccacagcacggcagtgctgaccatttcacccacttggcctccttgagaaatatggatggggacccctctggggatgggcaaggccttccaggataggctcagttttggtcccctgctttttgaggttgggttaaaattccgaccatggcagaggaagcacagctcaggttcccacacctcacttttcacagcctctgagggcagcagtgcacgtggaggagacgtctcccatgaggccaaggcctccagtgctcaccgatgccctctgcgaagttggggtagaactcgtcagtgaagaggggctcgggcagctcacggaaatacagcttcagcgtgcctgcgatggcgttcacgtccatctcgctcatcatcaccgacacgtccttgttatctggaaagagcacggaaatgcagcggcctccttgaagatcctgataaatgaagaaaagacacagagaaggatgtgacatgcctgggccgtggagcactctgagatctcatcgcggacaccactgcccacacctccatcccgtcctgcgcaggccgacactcactgacgttgaaggctgccttcagtgcctggatgtctgcggccaccccagacatgcggtagatgcccacctcctccatgcctcggcgctcgatctcctccacgcactggcgcacgatgtagggcaccttggacctctctctcctgcgggaggagggaatgttctcagtgtcctaacagccctgcttgggccataacacaggagacctgctccctatgtgcacacccggaggtggggtgaggacggtgatgaaggtacccaggtctggggctgcacacagagccttctgcatgcctgtcctccctctgcaagctctgtcctcattgcatgtgctttctcaggaacctttcaagcggccagaacccctgcaaatcacacatgacctttgtgggaaggtcaggaggcctgtctaagtcaagtcagcacgggaagggcatctgacagattccaggcctggggtgagcagcctgtgcccccggctgggaggtcagacccggtgttggtcctgccacccacgtgctgtgtgagaggagaatccgtgacccctgccctgggccttaacacacatccgacgaatgaatgaagggttgcctcagcaccggtgctccaagtcctgcgatgctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggctcatgtgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctgaggaagcaaatgaattctcagaggaagtggtctgtgtctgcatgaactgctctcaaaccaacaaataggcttctcttggcaactgactcgtgacaaagggttcaagattgtttgaaaaaaaaaaaggggggggggggacagggaggcagtaggtcctggaaaagtaaattctttattttacaataagaaagtgattacatattttatttttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcggagatcgccccactacactccagcctggtcaacagagtgagactctgtctcaaaacaaaaaaaaaaaaaaaaaaagaagaagtcattcccaacattgctcatcaaattatgaccataaatttccaggatcagactaacggctaaagagactgatgcatcaacaccaggcagagaataaagcagattttttttgttttgttttggagagcctctaggaacttgaaaaatacatatgccacactcttaagacccggtggttcttaatcagggatgttcattaaaatgctggaaaactctaaagatttccaggtcccatccaaggagattttgcttctgattgactggctagtggcctggccattggtattttgaaaaatccctccaagtgattcttttacatcccagctagaaaaccctaaattaaaggtgaaaaaccagacaccaagtggcatttaaataaatgtcaactttaactccacaaagcatctggttgcatgtggacagaaagagaaggaaagagggccctatatctggataacttggaaatgtgctccccctagcaagatatctaccaaaattaaaaccatatttgaggatgctggcactgtgagcaatatataaatgatgcatgtaacatcatttaatatgatcttatttttaaaaatgagtagagtggtgttttctagctgttagtgtttccaaatatcaatgt

SEQ ID NO: 463416 - DNA, 1633 bp, Homo sapiens
gctttgaaatgcgataaagccggtatggtttggttcagggcgcccagggtttgtgacacccgcctatctgttacactgatgctgttacacaactgtctgggaattcatctgtgtcctcgtgtgtgcaacgatgccaacctaccccaaagtggacaattggatgaagaagttggcttccaggatgatgctcagtttggttctttacaacatttggccacagagtttcccatgatggggcagttaatgggcaaagaaaaagaccttcttttcatggccaggaactttttgggagcctccgtttttaacagcagtaacttgctctacactgactctgagctggcccacatccctgaaggtatggtcttaatgggattagggaaaccatggctgacagggcttccttgggatgacttctcagcacaaatgttctgcctccctggatccagcccagagacttgacttgggataggaaaagagtgaaaggtgaacgaaagaccataaaccacttctctatgtttcctacaaatgctggggtgtctattattctgcatagtggggcgcattaagcaaattctcctttttcaggatgactgaagctgaatttctgtttacttttgtttatgcatctccgttaaaccaggatcatatcctcaacccccaaagaggaacaggccacctttgccatcatgctcagcctggtcaccagcctgaggctttcacagccacccagatcttcccctcacctttctcctggagtgtagagattccatattctctttcatctggctcctgacatcacttctccgtattgactgtggggctcttttttggcttggatttttctctttgttaagaccctgtgggaccacagaaagcagaaaatagtcattcaggggagcttgcttcctgacttcctcagctgatgttgttggttacatctgcaaccatactgcgatacggtgtagcactggcatcatgggtaagattcgtccccttatgtgaataagtctaatgacggtactgctgttgatgatcaaatatatcaagaagctaagtgaaagcctcctcaggatataatactgatggaaaatgactggcctgaggaaacactagatttcattaatcgtcatctaattgctatgttaaatagttctggccaggtacggtggctcacacctgtaatctcagcattttgggaggctgatgtgggaggatcacttgaacccaggagtttgagagaccagcctgggcaatataatgagatcctgtctctacaaaaactaaaagctgaaaaataaaattagtcaggtatggtggtgtgcacctgtacttccagctacttaggaggctgaggagagaggatcacttgagcttgagctcgggagatcaaggctacagtgagctgtgatcacaccactgcactccagcctgggcaacagagatcctgtctctaaaacgaaaacaaaacaatagttctgcacaagtgtatcatgagatatagatggtagtagaacaagtcatcatatcaggacaaaaatatgaaaatgtatgtaatgactttctagatagataagttgtttcttttttaaaatttaattttaattgaaaataaaaattttatatatttgttgtg

SEQ ID NO: 463417 - DNA, 1415 bp, Homo sapiens
  misc_feature (1)..(1): n is a, c, g, or t
  misc_feature (9)..(9): n is a, c, g, or t
  misc_feature (11)..(13): n is a, c, g, or t
  misc_feature (16)..(16): n is a, c, g, or t
nccaatttncnnncanactttcgacgaaacaattcgaaagcccatcagtttgggttgtggccatactgtctgcaagatgtgcctgaataaactccaccgcaaggcttgcccatttgaccagaccactatcaatacagacattgagctcctccctgtgaactcagcattgctgcagctcgtgggtgctcaggagaaaaacttcttcaacccaaaggacatggatgaaaaacccacagctaacatactgaatggtgaaagactagatgctttttctgtccctgagcagcagcctattactttgtgtagtggggttgaagacacaaagcattatgaggaagccaagaaatgtgtagaagaattagcattgtacttaaaaccgctcagcagtgctagaggagtgggtctgaacagcactactcagagtgttctgagtcgcccaatgcagaggaagcttgtgactctagtccactgtcaactagtagaagaagaaggcaggattcgtgccatgagggcagctcgatctttaggtgaacgaacagttacagagctcattctccagcaccagaatcctcagcaactctcttccaatctttgggcagcagtaagggctaggggatgccagttccttggaccaggtacataattaactttaggtatttattctgctgcaggaagttcattcattttgatagaagtttttcttaaatttattaatcactttatctgttttctttataaaatatatagaatgtaatacaaaattgctcacaaaaatggtgtaaaagtgtgttgctggttaatcttaactgtattgccagttaattgaatagctgcagaaatgattaaatattccccttctaataaatggatttatcttatctatgtacttgataaattttggttttgcccaactttccctagcaatgcaggaggaagctttaaagttggttctgctggccttagaagatggttctgctttgtcaagaaaagtattggttctgtttgtggtgcaaagattggagccacggtttcctcaagcctctaaaactagcattgggcatgttgttcagctcctttatagagcctcctgtttcaaggtcaccaaacgtgatgaagactcttctttgatgcagctgaaagaagaatttagaacctatgaagctctgcggcgagaacatgactcccagatagtgcagattgctatggaagcaggcttacgaattgcaccggaccagtggtcctctttgctttatggagaccagtctcacaaatctcatatgcagtccattattgacaagttgcagactccagcctcttttgcacagagtgttcaggaactaacaattgctctccagcgaactggagacccagcaaacttgaaccgactaagaccccatttggagctgttagcaaac

SEQ ID NO: 463418 - DNA, 2354 bp, Homo sapiens
  misc_feature (1)..(1): n is a, c, g, or t
  misc_feature (9)..(9): n is a, c, g, or t
  misc_feature (11)..(13): n is a, c, g, or t
  misc_feature (16)..(16): n is a, c, g, or t
nccaatttncnnncanactttcgacgaaacaattcgaaagcccatcagtttgggttgtggccatactgtctgcaagatgtgcctgaataaactccaccgcaaggcttgcccatttgaccagaccactatcaatacagacattgagctcctccctgtgaactcagcattgctgcagctcgtgggtgctcaggagaaaaacttcttcaacccaaaggacatggatgaaaaacccacagctaacatactgaatggtgaaagactagatgctttttctgtccctgagcagcagcctattactttgtgtagtggggttgaagacacaaagcattatgaggaagccaagaaatgtgtagaagaattagcattgtacttaaaaccgctcagcagtgctagaggagtgggtctgaacagcactactcagagtgttctgagtcgcccaatgcagaggaagcttgtgactctagtccactgtcaactagtagaagaagaaggcaggattcgtgccatgagggcagctcgatctttaggtgaacgaacagttacagagctcattctccagcaccagaatcctcagcaactctcttccaatctttgggcagcagtaagggctaggggatgccagttccttggaccaggtacataattaactttaggtatttattctgctgcaggaagttcattcattttgatagaagtttttcttaaatttattaatcactttatctgttttctttataaaatatatagaatgtaatacaaaattgctcacaaaaatggtgtaaaagtgtgttgctggttaatcttaactgtattgccagttaattgaatagctgcagaaatgattaaatattccccttctaataaatggatttatcttatctatgtacttgataaattttggttttgcccaactttccctagcaatgcaggaggaagctttaaagttggttctgctggccttagaagatggttctgctttgtcaagaaaagtattggttctgtttgtggtgcaaagattggagccacggtttcctcaagcctctaaaactagcattgggcatgttgttcagctcctttatagagcctcctgtttcaaggtcaccaaacgtgatgaagactcttctttgatgcagctgaaagaagaatttagaacctatgaagctctgcggcgagaacatgactcccagatagtgcagattgctatggaagcaggcttacgaattgcaccggaccagtggtcctctttgctttatggagaccagtctcacaaatctcatatgcagtccattattgacaaggtaggaccttttttgttccttacttcttagactaatcttggcattttggtaattcatttaacaaatgtatattaaagtgaatactgtatagcttttgtaaattgtatttatagccagtgtcatgtcataaccaatcacgttataataccactttgttcatttaaagatttgattagtttatattttttattttacttattttatattttattgtatttttactagaatcacagagatgaaggccaactctagagaccactctacatttaatttagagaaatagagtcaaatagtaagagtaacctaaaaaaaaaataatgaacatttactaaaatcttaatatgtatctagtggttttaaataattcatttaatcctctcaacagccctgtattatccattttagacaaagacaaagggaagttaatatgtttttccagcatcacatagataataaatgacagaagtggatttgaacttgaccattctcagtgtagagtacactaaccttttaccagactattcccccccaccttttttttttttttttttttcctatttctaaagatagaattccttgaatgggttagttcactttaatatttatttaatactttttatactgttgctcatttcatcaggaaaatagatttctctgggcttctttatgtttcttctttctcccgtcacaaaattgtgttgtattttaccattcttacctcttccaaatctcgtttttctcatttttttctgtattatgtatccttagttgcatttccttgatcctgtttttgccctctccatgatatcttgttccttcaagtatcctgtcttgtatatctttacttaggctttttctgctccttctccgtaacctgaaaatatacccaaccttcatttttcaacttgcacttacatctaagttattttagcttctctgtgtttattcctactactgatctgaagctctcttaatattcactagtagattcccagtctctgattccaaaagctttgtcttagtctttaaatcactcccatttgttttcagcatttc

SEQ ID NO: 463419 - DNA, 1666 bp, Homo sapiens
accagaagagcaaatggttgttgattgatccacatttttactgtaagcagaaacttaggacccaagattataatgctgcagaggatgctgatcgatgtgttcttcttcctgttcctctttgcggtgtggatggtggcctttgcgtggccaggcaagggatccttaggcagaatgagcagcgctggaggtggatattccgttcggtcatctacgagccctacctggccatgttcggccaggtgcccagtgacgtggatggtaagcctgacttggctcagatggaaacagcttggaggaggcatttgctccctgaaccaacccccagggctgccccggagaccgcacttcagaagcacgcgcgtgaaacggagtccaacataacagagtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaatgaagacaatgagactctggcatgggagggtgtcatgaaggaaaactaccttgtcaagatcaacacaaaagccaacgacacctcagaggaaatgaggcatcgatttagacaactggatacaaagcttaatgatctcaagggtcttctgaaagagattgctaataaaatcaaataaaactgtatgaactctaatggagaatcgactactaaatgagagattttcagacccctgggtacatggtggatgattttaaatcaccctagtgtgctgagaccttgagaataaagtgtgtgattggtttcatacttgaagacggatataaaggaagaatatttcctttatgtgtttctccagaatggtgcctgtttctctctgtgtctcaatgcctgggactggaggttgatagtttaagtgtgttcttaccgcctcctttttcctttaatcttatttttgatgaacacatatataggagaacatctatcctatgaataagaacctggtcatgctttactcctgtattgttattttgttcatttccaattgattctctacttttcccttttttgtattatgtgactaattagttggcatattgttaaaagtctctcaaattaggccagattctaaaacatgctgcagcaagaggaccccgctctcttcaggaaaagtgttttcatttctcaggatgcttcttacctgtcagaggaggtgacaaggcagtctcttgctctcttggactcaccaggctcctattgaaggaaccacccccattcctaaatatgtgaaaagtcgcccaaaatgcaaccttgaaaggcactactgactttgttcttattggatactcctcttattatttttccattaaaaataatagctggctattatagaaaatttagaccat

SEQ ID NO: 463420 - DNA, 1719 bp, Homo sapiens
accagaagagcaaatggttgttgattgatccacatttttactgtaagcagaaacttaggacccaagattataatgctgcagaggatgctgatcgatgtgttcttcttcctgttcctctttgcggtgtggatggtggcctttgcgtggccaggcaagggatccttaggcagaatgagcagcgctggaggtggatattccgttcggtcatctacgagccctacctggccatgttcggccaggtgcccagtgacgtggatggtaagcctgacttggctcagatggaaacagcttggaggaggcatttgctccctgaaccaacccccagggctgccccggagaccgcacttcagaagcacgcgcgtgaaacggagtccaacataacagagtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaatgaagacaatgagactctggcatgggagggtgtcatgaaggaaaactaccttgtcaagatcaacacaaaagccaacgacacctcagaggaaatgaggcatcgatttagacaactggatacaaagcttaatgatctcaagggtcttctgaaagagattgctaataaaatcaaataaaactgtatgaactctaatggagaaaaatctaattatagcaagatcatattaaggaatgctgatgaacaattttgctatcgactactaaatgagagattttcagacccctgggtacatggtggatgattttaaatcaccctagtgtgctgagaccttgagaataaagtgtgtgattggtttcatacttgaagacggatataaaggaagaatatttcctttatgtgtttctccagaatggtgcctgtttctctctgtgtctcaatgcctgggactggaggttgatagtttaagtgtgttcttaccgcctcctttttcctttaatcttatttttgatgaacacatatataggagaacatctatcctatgaataagaacctggtcatgctttactcctgtattgttattttgttcatttccaattgattctctacttttcccttttttgtattatgtgactaattagttggcatattgttaaaagtctctcaaattaggccagattctaaaacatgctgcagcaagaggaccccgctctcttcaggaaaagtgttttcatttctcaggatgcttcttacctgtcagaggaggtgacaaggcagtctcttgctctcttggactcaccaggctcctattgaaggaaccacccccattcctaaatatgtgaaaagtcgcccaaaatgcaaccttgaaaggcactactgactttgttcttattggatactcctcttattatttttccattaaaaataatagctggctattatagaaaatttagaccat

SEQ ID NO: 463421 - DNA, 836 bp, Homo sapiens
aggcatataatgaatacttatgtgagtctcctgagggcagcagatgattggttgtgtttgttgtctcttttctgggtctagccacctagtgactctactcagctccgggctggcactgggggttgtctgcacggagtactgtgatgtgaaccgtctattggtctctcagccatggataccagttcctgttccagtggaggtggtggggagtgcaatggactccagccttcggagagagtgtgactctgatgacactttgattttggacttctggcctcaaaaaccattaagacgacacattcctctgattttaagccaccaagtttgtggcaacttttatggcaagtccagaaaatggatacaaccatgtctgtccctacgttccacagagacctggaaccaaacccagaacttcacttccctgtgccagaaggattccagtgagcttttcccacaggccctacagtcttctccagagtcacactctgtcacccagggtgaagtgcaatggcacaatctcggctcaccacaacctccacctcctgggtttaagagattctcctgcctcagccttccaagtagctgggattacaggcatatgccaccgggtccggaattttgtgtattcacaacaacatttgctgcattggtacagtgtgacagatacagcactgagtactgacaaactggggatataattattaatgaataaaggcaaaagcatgacacttaaggacataatctagtagactgtaatgtgatggtaaggaaatgcatgtatgcatgtgatatatacatatgatatataacatacataaaataaataattatatata

SEQ ID NO: 463422 - DNA, 467 bp, Homo sapiens
gagcttaccccactcccacaagtgacttaggaattcagaatggttcctggtctttgttctcattttgtccttgaatgttgctttcttctttgtttttttgagatggagtttcgctcttgttgcccaggctggagtgcagtgtcacagtctcggctcactgcaacctctgcctcctggatgcaagtgattctcctgcctcagcctcctgagtagctgggattacaagcatgtgccaccatgctcagaattttgtgtattcacaacaacatttgctgcattggtacagtgtgacagatacagcactgagtactgacaaactggggatataattattaatgaataaaggcaaaagcatgacacttaaggacataatctagtagactgtaatgtgatggtaaggaaatgcatgtatgcatgtgatatatacatatgatatataacatacataaaataaataattatatata

SEQ ID NO: 463423 - DNA, 1349 bp, Homo sapiens
aacagagtaagaccctgccgtaataataataacttttttttttttgagatagagttttgctctttcccccagactagagtgcaatggcgcgatcttggctcactgcaacttgtccccccgggttcaagcgattcttctgccacagcctcccgagtagctgggattataggcgcccactaccacgcctggctaatttttgtatttttagtagagacggggtttcgccatgttggcctggctggcctctaactcgtaacctcaggtgatccgcccgccttggcctcccaaagtgctaggattataggcgtgagccactgtgcccagccaataataacttataaaacatgaaacgatttagtgagaaaagtggccggttttttggggggaattactttctgtcataaagaagatagatgggttctcatgtcttctacattcagtctgttgtgcagtcacatatcatgtagactctggaaaacacctctgtatactggtgaaagaatgaaaagaagcaaataatgccttagtatgattatgaaaaacgttttgacttcacagtgccctgaatgggtcttgggaatctccagggatccctcaggcacactttgagaaccaatctatataaagtgatggttcacaatgattctgaagccttagtttcagaatcatttggggcagcttttcaaaaatgccattcctgccacctaccacaaagattctgattcactgtatctgtgatgggtctcagatctctgcatttttaatctcacgtgattcttaagtatgtggtggaagtacctttcttcaggaaattctgtcctaagcttttaccctgagaaaataaaacctgcatgctttcaccatggacggtgggagactccactgaaacacatctgctagaccactaagtttatccttgtcacccagtttgctcttggaaagagtctgttcccttttgtcactgaaccaatcatgacataaacttgtgctttacctcctatagcacagccgagacaaggctggaacatttaattaaggtttttactaaggactcaggaataacaacagggaaatatctatgtaactagatgacctgacataaaatctatcttctgattgcagtctattgtgagaatgctgcttttcctagctcccagccttccatggggcagaaggctcttttaattaggaagagagggaggacaaaggagagccttttcttttgtccattactcttagaaatgaacaggtacataatagaaaataaataattattgttggtaatgtttacacagcagtgttagagcctctctgtagtgaaacaaaaataatgttcttaccaaaaaaaa

SEQ ID NO: 463424 - DNA, 271 bp, Homo sapiens
gtcgactctacagatccttaaaagtgacactcttctatatctacccagagtctagactaggaagtgccacaccaaaaattgtttctaaagcaaagaatattgaagttgaaaataaaaataatttgtctgctgttccactgaacaacttggaacccattactaatatacagatctggttggccaatggaaaaaggattgtccagaaatttaacattactcatagtaaggcgaaagagaatgaaagacgtagatatagaagagtgcacttttg

SEQ ID NO: 463425 - DNA, 3779 bp, Homo sapiens
cggccgcggaacctgaggcggtctggggcggcggcgctccggctctgaagggctccagccaaacggagcccgcggccaaacggtgcctgcggtgcctgagctgagtgaggccgaggccgggaggccgtgcccggagtaaggcgaaagagaatgaaagacgtagataacctcaaaagtataaaagaagaatgggtttgtgaaacaggatctgataatcaacctcttggtaataatcaacaatcaaattgtgaatattttgttgatagcctttttgaggaagctcagaaggttagttccaaatgtgtgtctcccgctgaacagaagaaacaggtagatgtaaatataaaattatggaaaaacggattcaccgtcaacgacgatttcagaagttattccgatggtgccagtcagcagtttttgaactccatcaaaaagggggaattaccttcagaattacagggaatttttgataaagaagaggtggacgttaaagttgaagacaagaaaaatgaaatatgtttgtctacgaagcctgtgttccagcccttttcaggacagggtcacagactaggaagtgccacaccaaaaattgtttctaaagcaaagaatattgaagttgaaaataaaaataatttgtctgctgttccactgaacaacttggaacccattactaatatacagatctggttggccaatggaaaaaggattgtccagaaatttaacattactcatagagtaagccatatcaaagacttcattgaaaaataccaaggatctcaaagaagtcctccgttttccctggcaacagctcttcctgtcctcaggttgctagatgagacactcacactggaagaagcagatttacagaatgctgtcatcattcagagactccaaaaaactgcatcttttagagaactttcagagcactgatttttgatagactaagtggaaaatttgcagagaaatgatggttgtaagtggacatgcaaaccaaaattggggattggagaagtcagactcactagacttttggttcgagtactattgaactctctcctgatgagaagatgtttagataagtacaagttaagaaagtagcatatgactggaaactatattcagtgcactttctccaaaagactacccagaaaaatagacttattttcaaataccagttatcaagatatattaaatagctgtattgtttagaatcttaatatggtataaattagcatatgtattcacaatattcattcagacatcattcccagacagcagggatttatttaaatgttagctgtctgagtttttaaatagctaatacgaccgggtacagtggttcatgcctgtaatcccagaacttcgggaggccgagacaggcagatcacgaggtcaacagattgagaccatcctggcaaacatggtgaaaccccatctctagtaaaaatacaaaaattagctgggcgtggcggtgcgcaactgtagtcccagctactcgggaggctgaggcaggagaatctcttgaacctggcaagtgtaggttgcagtgagctgagattgagcaactgtactccagcttggcgacagagcaagaccccctctcaaaaataaataaaataaagtaaaataaatataaataattgtggccgggtgcaatggctcatgcctgtaatcccagcactttgggaggctgagatgggaggatcacttgaagccaggagtttaaaaccagaatgatcaacagagtgagacccctgtctatatatttttttaatttaaaaaataaaagaataaaattgtgtagctcagtatagtatcaagattaatctgcctactcacatttctacactttataaaaatgtaataaaagaaaattatctttctaaaaagcctattccctttccattttattttctttcaaaaattatggatttgtttttggctaacatttgggattagccattcatttgccaccactcacttagaatataatgccggtgtgtgtcacattactagtattttttaaatgcatcatataaagtatggttttctgtttctttttcgtttgtttgagatggagtttcgctcttgttgcccaggctggagtgcagtggcgcaatctcagctcaccacaacctccacctcccgggttcaagagattctcctgctcagcctcccaagtagctgggattacaggcatgcgccaccatgcttggctaattttgcatttttagtagacacgggatttcaccatgttggtcaggctggtctcgaactcccgacctcaggggatctgcctgcctaggcctcctgaagtgctgggattacaagtgtgaaccaccgtgcccagctggttttctgtttcatacatcagagtcaacttgtgaatacatttaaagattatttcattttgatatcacgaagaaaaacaggctttatatctcagactttaactaaatccagttagacctcaatttttcactgtcagattaaatccccatacctgaaaataagtttaacatttttttttgcaaatgatctattgaatcagatttaaaatgaagcatgcattgagtgtgccaaggaactaagtggtccatagcagcagtaatgttcatagggtgcgagatgcctgctatgaaacagcaactctcaaacatttttatctcaagaccatttgtttatgtgagctatatatattattatattaaatattaaatttttaaaatatttatttatggccactgtgcccagccaataataacttataaaacatgaaacgatttagtgagaaaagtggccggttttttggggggaattactttctgtcataaagaagatagatgggttctcatgtcttctacattcagtctgttgtgcagtcacatatcatgtagactctggaaaacacctctgtatactggtgaaagaatgaaaagaagcaaataatgccttagtatgattatgaaaaacgttttgacttcacagtgccctgaatgggtcttgggaatctccagggatccctcaggcacactttgagaaccaatctatataaagtgatggttcacaatgattctgaagccttagtttcagaatcatttggggcagcttttcaaaaatgccattcctgccacctaccacaaagattctgattcactgtatctgtgatgggtctcagatctctgcatttttaatctcacgtgattcttaagtatgtggtggaagtacctttcttcaggaaattctgtcctaagcttttaccctgagaaaataaaacctgcatgctttcaccatggacggtgggagactccactgaaacacatctgctagaccactaagtttatccttgtcacccagtttgctcttggaaagagtctgttcccttttgtcactgaaccaatcatgacataaacttgtgctttacctcctatagcacagccgagacaaggctggaacatttaattaaggtttttactaaggactcaggaataacaacagggaaatatctatgtaactagatgacctgacataaaatctatcttctgattgcagtctattgtgagaatgctgcttttcctagctcccagccttccatggggcagaaggctcttttaattaggaagagagggaggacaaaggagagccttttcttttgtccattactcttagaaatgaacaggtacataatagaaaataaataattattgttggtaatgtttacacagcagtgttagagcctctctgtagtgaaacaaaaataatgttcttaccaaaaaaaa

SEQ ID NO: 463426 - DNA, 3242 bp, Homo sapiens
tgcgtggcacttacgcaggacaggccacagacaggaagtgccacaccaaaaattgtttctaaagcaaagaatattgaagttgaaaataaaaataatttgtctgctgttccactgaacaacttggaacccattactaatatacagatctggttggccaatggaaaaaggattgtccagaaatttaacattactcatagagtaagccatatcaaagacttcattgaaaaataccaaggatctcaaagaagtcctccgttttccctggcaacagctcttcctgtcctcaggttgctagatgagacactcacactggaagaagcagatttacagaatgctgtcatcattcagagactccaaaaaactgcatcttttagagaactttcagagcactgatttttgatagactaagtggaaaatttgcagagaaatgatggttgtaagtggacatgcaaaccaaaattggggattggagaagtcagactcactagacttttggttcgagtactattgaactctctcctgatgagaagatgtttagataagtacaagttaagaaagtagcatatgactggaaactatattcagtgcactttctccaaaagactacccagaaaaatagacttattttcaaataccagttatcaagatatattaaatagctgtattgtttagaatcttaatatggtataaattagcatatgtattcacaatattcattcagacatcattcccagacagcagggatttatttaaatgttagctgtctgagtttttaaatagctaatacgaccgggtacagtggttcatgcctgtaatcccagaacttcgggaggccgagacaggcagatcacgaggtcaacagattgagaccatcctggcaaacatggtgaaaccccatctctagtaaaaatacaaaaattagctgggcgtggcggtgcgcaactgtagtcccagctactcgggaggctgaggcaggagaatctcttgaacctggcaagtgtaggttgcagtgagctgagattgagcaactgtactccagcttggcgacagagcaagaccccctctcaaaaataaataaaataaagtaaaataaatataaataattgtggccgggtgcaatggctcatgcctgtaatcccagcactttgggaggctgagatgggaggatcacttgaagccaggagtttaaaaccagaatgatcaacagagtgagacccctgtctatatatttttttaatttaaaaaataaaagaataaaattgtgtagctcagtatagtatcaagattaatctgcctactcacatttctacactttataaaaatgtaataaaagaaaattatctttctaaaaagcctattccctttccattttattttctttcaaaaattatggatttgtttttggctaacatttgggattagccattcatttgccaccactcacttagaatataatgccggtgtgtgtcacattactagtattttttaaatgcatcatataaagtatggttttctgtttctttttcgtttgtttgagatggagtttcgctcttgttgcccaggctggagtgcagtggcgcaatctcagctcaccacaacctccacctcccgggttcaagagattctcctgctcagcctcccaagtagctgggattacaggcatgcgccaccatgcttggctaattttgcatttttagtagacacgggatttcaccatgttggtcaggctggtctcgaactcccgacctcaggggatctgcctgcctaggcctcctgaagtgctgggattacaagtgtgaaccaccgtgcccagctggttttctgtttcatacatcagagtcaacttgtgaatacatttaaagattatttcattttgatatcacgaagaaaaacaggctttatatctcagactttaactaaatccagttagacctcaatttttcactgtcagattaaatccccatacctgaaaataagtttaacatttttttttgcaaatgatctattgaatcagatttaaaatgaagcatgcattgagtgtgccaaggaactaagtggtccatagcagcagtaatgttcatagggtgcgagatgcctgctatgaaacagcaactctcaaacatttttatctcaagaccatttgtttatgtgagctatatatattattatattaaatattaaatttttaaaatatttatttatggccactgtgcccagccaataataacttataaaacatgaaacgatttagtgagaaaagtggccggttttttggggggaattactttctgtcataaagaagatagatgggttctcatgtcttctacattcagtctgttgtgcagtcacatatcatgtagactctggaaaacacctctgtatactggtgaaagaatgaaaagaagcaaataatgccttagtatgattatgaaaaacgttttgacttcacagtgccctgaatgggtcttgggaatctccagggatccctcaggcacactttgagaaccaatctatataaagtgatggttcacaatgattctgaagccttagtttcagaatcatttggggcagcttttcaaaaatgccattcctgccacctaccacaaagattctgattcactgtatctgtgatgggtctcagatctctgcatttttaatctcacgtgattcttaagtatgtggtggaagtacctttcttcaggaaattctgtcctaagcttttaccctgagaaaataaaacctgcatgctttcaccatggacggtgggagactccactgaaacacatctgctagaccactaagtttatccttgtcacccagtttgctcttggaaagagtctgttcccttttgtcactgaaccaatcatgacataaacttgtgctttacctcctatagcacagccgagacaaggctggaacatttaattaaggtttttactaaggactcaggaataacaacagggaaatatctatgtaactagatgacctgacataaaatctatcttctgattgcagtctattgtgagaatgctgcttttcctagctcccagccttccatggggcagaaggctcttttaattaggaagagagggaggacaaaggagagccttttcttttgtccattactcttagaaatgaacaggtacataatagaaaataaataattattgttggtaatgtttacacagcagtgttagagcctctctgtagtgaaacaaaaataatgttcttaccaaaaaaaa

SEQ ID NO: 463427 - DNA, 3086 bp, Homo sapiens
gttgagttcctatgtacgtaatttgagataagtaaagataggaaactgctgatttgttttgatgcgaatgcagaaaataatcttgcctaatctgggcctagaagcagttattctctctccatattgggctttgatttgtgctgaaggtcagcttttggctcctccttcctgggatattggaaacaatgccagctctgtggcttctgccctggggactggggacagagtctctctctgtcgccaggctggagtgcagtggcatgatctcggctcactgcaacctccgcctcccaggttcaagcgattcttctgcctcagcctcctgagtagctgggactacagggtttgtgaaacaggatctgataatcaacctcttggtaataatcaacaatcaaattgtgaatattttgttgatagcctttttgaggaagctcagaaggttagttccaaatgtgtgtctcccgctgaacagaagaaacaggtagatgtaaatataaaattatggaaaaacggattcaccgtcaacgacgatttcagaagttattccgatggtgccagtcagcagtttttgaactccatcaaaaagggggaattaccttcagaattacagggaatttttgataaagaagaggtggacgttaaagttgaagacaagaaaaatgaaatatgtttgtctacgaagcctgtgttccagcccttttcaggacagggtcacagactaggaagtgccacaccaaaaattgtttctaaagcaaagaatattgaagttgaaaataaaaataatttgtctgctgttccactgaacaacttggaacccattactaatatacagatctggttggccaatggaaaaaggattgtccagaaatttaacattactcatagagtaagccatatcaaagacttcattgaaaaataccaaggatctcaaagaagtcctccgttttccctggcaacagctcttcctgtcctcaggttgctagatgagacactcacactggaagaagcagatttacagaatgctgtcatcattcagagactccaaaaaactgcatcttttagagaactttcagagcactgatttttgatagactaagtggaaaatttgcagagaaatgatggttgtaagtggacatgcaaaccaaaattggggattggagaagtcagactcactagacttttggttcgagtactattgaactctctcctgatgagaagatgtttagataagtacaagttaagaaagtagcatatgactggaaactatattcagtgcactttctccaaaagactacccagaaaaatagacttattttcaaataccagttatcaagatatattaaatagctgtattgtttagaatcttaatatggtataaattagcatatgtattcacaatattcattcagacatcattcccagacagcagggatttatttaaatgttagctgtctgagtttttaaatagctaatacgaccgggtacagtggttcatgcctgtaatcccagaacttcgggaggccgagacaggcagatcacgaggtcaacaggatttcaccatgttggtcaggctggtctcgaactcccgacctcaggggatctgcctgcctaggcctcctgaagtgctgggattacaagtgtgaaccaccgtgcccagctggttttctgtttcatacatcagagtcaacttgtgaatacatttaaagattatttcattttgatatcacgaagaaaaacaggctttatatctcagactttaactaaatccagttagacctcaatttttcactgtcagattaaatccccatacctgaaaataagtttaacatttttttttgcaaatgatctattgaatcagatttaaaatgaagcatgcattgagtgtgccaaggaactaagtggtccatagcagcagtaatgttcatagggtgcgagatgcctgctatgaaacagcaactctcaaacatttttatctcaagaccatttgtttatgtgagctatatatattattatattaaatattaaatttttaaaatatttatttatggccactgtgcccagccaataataacttataaaacatgaaacgatttagtgagaaaagtggccggttttttggggggaattactttctgtcataaagaagatagatgggttctcatgtcttctacattcagtctgttgtgcagtcacatatcatgtagactctggaaaacacctctgtatactggtgaaagaatgaaaagaagcaaataatgccttagtatgattatgaaaaacgttttgacttcacagtgccctgaatgggtcttgggaatctccagggatccctcaggcacactttgagaaccaatctatataaagtgatggttcacaatgattctgaagccttagtttcagaatcatttggggcagcttttcaaaaatgccattcctgccacctaccacaaagattctgattcactgtatctgtgatgggtctcagatctctgcatttttaatctcacgtgattcttaagtatgtggtggaagtacctttcttcaggaaattctgtcctaagcttttaccctgagaaaataaaacctgcatgctttcaccatggacggtgggagactccactgaaacacatctgctagaccactaagtttatccttgtcacccagtttgctcttggaaagagtctgttcccttttgtcactgaaccaatcatgacataaacttgtgctttacctcctatagcacagccgagacaaggctggaacatttaattaaggtttttactaaggactcaggaataacaacagggaaatatctatgtaactagatgacctgacataaaatctatcttctgattgcagtctattgtgagaatgctgcttttcctagctcccagccttccatggggcagaaggctcttttaattaggaagagagggaggacaaaggagagccttttcttttgtccattactcttagaaatgaacaggtacataatagaaaataaataattattgttggtaatgtttacacagcagtgttagagcctctctgtagtgaaacaaaaataatgttcttaccaaaaaaaa

SEQ ID NO: 463428 - DNA, 2291 bp, Homo sapiens
ttttcttttttttttttttgagacagagtctcgctctgttgcccaggctggagttgcagtgagctgagattgagcaactgtactccagcttggcgacagagcaagaccccctctcaaaaataaataaaataaagtaaaataaatataaataattgtggccgggtgcaatggctcatgcctgtaatcccagcactttgggaggctgagatgggaggatcacttgaagccaggagtttaaaaccagaatgatcaacagagtgagacccctgtctatatatttttttaatttaaaaaataaaagaataaaattgtgtagctcagtatagtatcaagattaatctgcctactcacatttctacactttataaaaatgtaataaaagaaaattatctttctaaaaagcctattccctttccattttattttctttcaaaaattatggatttgtttttggctaacatttgggattagccattcatttgccaccactcacttagaatataatgccggtgtgtgtcacattactagtattttttaaatgcatcatataaagtatggttttctgtttctttttcgtttgtttgagatggagtttcgctcttgttgcccaggctggagtgcagtggcgcaatctcagctcaccacaacctccacctcccgggttcaagagattctcctgctcagcctcccaagtagctgggattacaggcatgcgccaccatgcttggctaattttgcatttttagtagacacgggatttcaccatgttggtcaggctggtctcgaactcccgacctcaggggatctgcctgcctaggcctcctgaagtgctgggattacaagtgtgaaccaccgtgcccagctggttttctgtttcatacatcagagtcaacttgtgaatacatttaaagattatttcattttgatatcacgaagaaaaacaggctttatatctcagactttaactaaatccagttagacctcaatttttcactgtcagattaaatccccatacctgaaaataagtttaacatttttttttgcaaatgatctattgaatcagatttaaaatgaagcatgcattgagtgtgccaaggaactaagtggtccatagcagcagtaatgttcatagggtgcgagatgcctgctatgaaacagcaactctcaaacatttttatctcaagaccatttgtttatgtgagctatatatattattatattaaatattaaatttttaaaatatttatttatggccactgtgcccagccaataataacttataaaacatgaaacgatttagtgagaaaagtggccggttttttggggggaattactttctgtcataaagaagatagatgggttctcatgtcttctacattcagtctgttgtgcagtcacatatcatgtagactctggaaaacacctctgtatactggtgaaagaatgaaaagaagcaaataatgccttagtatgattatgaaaaacgttttgacttcacagtgccctgaatgggtcttgggaatctccagggatccctcaggcacactttgagaaccaatctatataaagtgatggttcacaatgattctgaagccttagtttcagaatcatttggggcagcttttcaaaaatgccattcctgccacctaccacaaagattctgattcactgtatctgtgatgggtctcagatctctgcatttttaatctcacgtgattcttaagtatgtggtggaagtacctttcttcaggaaattctgtcctaagcttttaccctgagaaaataaaacctgcatgctttcaccatggacggtgggagactccactgaaacacatctgctagaccactaagtttatccttgtcacccagtttgctcttggaaagagtctgttcccttttgtcactgaaccaatcatgacataaacttgtgctttacctcctatagcacagccgagacaaggctggaacatttaattaaggtttttactaaggactcaggaataacaacagggaaatatctatgtaactagatgacctgacataaaatctatcttctgattgcagtctattgtgagaatgctgcttttcctagctcccagccttccatggggcagaaggctcttttaattaggaagagagggaggacaaaggagagccttttcttttgtccattactcttagaaatgaacaggtacataatagaaaataaataattattgttggtaatgtttacacagcagtgttagagcctctctgtagtgaaacaaaaataatgttcttaccaaaaaaaa

SEQ ID NO: 463429 - DNA, 2210 bp, Homo sapiens
gagacggagtcctgctctgtcgcccaggctggagtgcagtggcgcaatctcggctcactgcaacctctgcctcccaggttcaagcgattctcctgcctcagcctcccagcactttgggaggctgagatgggaggatcacttgaagccaggagtttaaaaccagaatgatcaacagagtgagacccctgtctatatatttttttaatttaaaaaataaaagaataaaattgtgtagctcagtatagtatcaagattaatctgcctactcacatttctacactttataaaaatgtaataaaagaaaattatctttctaaaaagcctattccctttccattttattttctttcaaaaattatggatttgtttttggctaacatttgggattagccattcatttgccaccactcacttagaatataatgccggtgtgtgtcacattactagtattttttaaatgcatcatataaagtatggttttctgtttctttttcgtttgtttgagatggagtttcgctcttgttgcccaggctggagtgcagtggcgcaatctcagctcaccacaacctccacctcccgggttcaagagattctcctgctcagcctcccaagtagctgggattacaggcatgcgccaccatgcttggctaattttgcatttttagtagacacgggatttcaccatgttggtcaggctggtctcgaactcccgacctcaggggatctgcctgcctaggcctcctgaagtgctgggattacaagtgtgaaccaccgtgcccagctggttttctgtttcatacatcagagtcaacttgtgaatacatttaaagattatttcattttgatatcacgaagaaaaacaggctttatatctcagactttaactaaatccagttagacctcaatttttcactgtcagattaaatccccatacctgaaaataagtttaacatttttttttgcaaatgatctattgaatcagatttaaaatgaagcatgcattgagtgtgccaaggaactaagtggtccatagcagcagtaatgttcatagggtgcgagatgcctgctatgaaacagcaactctcaaacatttttatctcaagaccatttgtttatgtgagctatatatattattatattaaatattaaatttttaaaatatttatttatggccactgtgcccagccaataataacttataaaacatgaaacgatttagtgagaaaagtggccggttttttggggggaattactttctgtcataaagaagatagatgggttctcatgtcttctacattcagtctgttgtgcagtcacatatcatgtagactctggaaaacacctctgtatactggtgaaagaatgaaaagaagcaaataatgccttagtatgattatgaaaaacgttttgacttcacagtgccctgaatgggtcttgggaatctccagggatccctcaggcacactttgagaaccaatctatataaagtgatggttcacaatgattctgaagccttagtttcagaatcatttggggcagcttttcaaaaatgccattcctgccacctaccacaaagattctgattcactgtatctgtgatgggtctcagatctctgcatttttaatctcacgtgattcttaagtatgtggtggaagtacctttcttcaggaaattctgtcctaagcttttaccctgagaaaataaaacctgcatgctttcaccatggacggtgggagactccactgaaacacatctgctagaccactaagtttatccttgtcacccagtttgctcttggaaagagtctgttcccttttgtcactgaaccaatcatgacataaacttgtgctttacctcctatagcacagccgagacaaggctggaacatttaattaaggtttttactaaggactcaggaataacaacagggaaatatctatgtaactagatgacctgacataaaatctatcttctgattgcagtctattgtgagaatgctgcttttcctagctcccagccttccatggggcagaaggctcttttaattaggaagagagggaggacaaaggagagccttttcttttgtccattactcttagaaatgaacaggtacataatagaaaataaataattattgttggtaatgtttacacagcagtgttagagcctctctgtagtgaaacaaaaataatgttcttaccaaaaaaaa

SEQ ID NO: 463430 - DNA, 682 bp, Homo sapiens
cggccgcggaacctgaggcggtctggggcggcggcgctccggctctgaagggctccagccaaacggagcccgcggccaaacggtgcctgcggtgcctgagctgagtgaggccgaggccgggaggccgtgcccggagtaaggcgaaagagaatgaaagacgtagataacctcaaaagtataaaagaagaatgggtttgtgaaacaggatctgataatcaacctcttggtaataatcaacaatcaaattgtgaatattttgttgatagcctttttgaggaagctcagaaggttagttccaaatgtgtgtctcccgctgaacagaagaaacaggtagatgtaaatataaaattatggaaaaacggattcaccgtcaacgacgatttcagaagttattccgatggtgccagtcagcagtttttgaactccatcaaaaaggggtgagtagccaggtgtggtaggtcaagcctgtaaacccaaaactttggcaggctgtggcgagaggattgcctgagctcaggagttcaaggccagccggggaacatagccagacctcatctctacttaaaaaaagaaaattaccagccagcccagctactcaggattgcttgcacttgggagactgaggctacagtgagccatgcttgcactactgcactccagcctgggcaacagcacgatgccc

SEQ ID NO: 463431 - DNA, 3210 bp, Homo sapiens
gttgagttcctatgtacgtaatttgagataagtaaagataggaaactgctgatttgttttgatgcgaatgcagaaaataatcttgcctaatctgggcctagaagcagttattctctctccatattgggctttgatttgtgctgaaggtcagcttttggctcctccttcctgggatattggaaacaatgccagctctgtggcttctgccctggggactggggacagagtctctctctgtcgccaggctggagtgcagtggcatgatctcggctcactgcaacctccgcctcccaggttcaagcgattcttctgcctcagcctcctgagtagctgggactacagggtttgtgaaacaggatctgataatcaacctcttggtaataatcaacaatcaaattgtgaatattttgttgatagcctttttgaggaagctcagaaggttagttccaaatgtgtgtctcccgctgaacagaagaaacaggtagatgtaaatataaaattatggaaaaacggattcaccgtcaacgacgatttcagaagttattccgatggtgccagtcagcagtttttgaactccatcaaaaagggggaattaccttcagaattacagggaatttttgataaagaagaggtggacgttaaagttgaagacaagaaaaatgaaatatgtttgtctacgaagcctgtgttccagcccttttcaggacagggtcacagactaggaagtgccacaccaaaaattgtttctaaagcaaagaatattgaagttgaaaataaaaataatttgtctgctgttccactgaacaacttggaacccattactaatatacagatctggttggccaatggaaaaaggattgtccagaaatttaacattactcatagagtaagccatatcaaagacttcattgaaaaataccaaggatctcaaagaagtcctccgttttccctggcaacagctcttcctgtcctcaggttgctagatgagacactcacactggaagaagcagatttacagaatgctgtcatcattcagagactccaaaaaactgcatcttttagagaactttcagagcactgatttttgatagactaagtggaaaatttgcagagaaatgatggttgtaagtggacatgcaaaccaaaattggggattggagaagtcagactcactagacttttggttcgagtactattgaactctctcctgatgagaagatgtttagataagtacaagttaagaaagtagcatatgactggaaactatattcagtgcactttctccaaaagactacccagaaaaatagacttattttcaaataccagttatcaagatatattaaatagctgtattgtttagaatcttaatatggtataaattagcatatgtattcacaatattcattcagacatcattcccagacagcagggatttatttaaatgttagctgtctgagtttttaaatagctaatacgaccgggtacagtggttcatgcctgtaatcccagaacttcgggaggccgagacaggcagatcacgaggtcaacagattgagaccatcctggcaaacatggtgaaaccccatctctagtaaaaatacaaaaattagctgggcgtggcggtgcgcaactgtagtcccagctactcgggaggctgaggcaggagaatctcttgaacctggcaagtgtaggttgcagtgagctgagattgagcaactgtactccagcttggcgacagagcaagaccccctctcaaaaataaataaaataaagtaaaataaatataaataattgtggccgggtgcaatggctcatgcctgtaatcccagcactttgggaggctgagatgggaggatcacttgaagccaggagtttaaaaccagaatgatcaacagagtgagacccctgtctatatatttttttaatttaaaaaataaaagaataaaattgtgtagctcagtatagtatcaagattaatctgcctactcacatttctacactttataaaaatgtaataaaagaaaattatctttctaaaaagcctattccctttccattttattttctttcaaaaattatggatttgtttttggctaacatttgggattagccattcatttgccaccactcacttagaatataatgccggtgtgtgtcacattactagtattttttaaatgcatcatataaagtatggttttctgtttctttttcgtttgtttgagatggagtttcgctcttgttgcccaggctggagtgcagtggcgcaatctcagctcaccacaacctccacctcccgggttcaagagattctcctgctcagcctcccaagtagctgggattacaggcatgcgccaccatgcttggctaattttgcatttttagtagacacgggatttcaccatgttggtcaggctggtctcgaactcccgacctcaggggatctgcctgcctaggcctcctgaagtgctgggattacaagtgtgaaccaccgtgcccagctggttttctgtttcatacatcagagtcaacttgtgaatacatttaaagattatttcattttgatatcacgaagaaaaacaggctttatatctcagactttaactaaatccagttagacctcaatttttcactgtcagattaaatccccatacctgaaaataagtttaacatttttttttgcaaatgatctattgaatcagatttaaaatgaagcatgcattgagtgtgccaaggaactaagtggtccatagcagcagtaatgttcatagggtgcgagatgcctgctatgaaacagcaactctcaaacatttttatctcaagaccatttgtttatgtgagctatatatattattatattaaatattaaatttttaaaatatttatttatgggccaggcacgggtgttacgcctgtaatcccagcactttgggaggctgaggcaggcggatcacaaggtcaagtgattgagaccatcctgtccaacatggtgaatccccgtctctactaaaaatacaaaaaaaattagctgggtgtggtggcatgcgcctgtagtcccagctacgtgggaggctgagggaggagaatggcttgaacccgggaggtggaggtttcagtgagccgagattgcgcccctgcactccagcctggtctatgatgcatttttagttaatgtgtacccctgttactggtggaaggtatctgagtcac

SEQ ID NO: 463432 - DNA, 3930 bp, Homo sapiens
gttgagttcctatgtacgtaatttgagataagtaaagataggaaactgctgatttgttttgatgcgaatgcagaaaataatcttgcctaatctgggcctagaagcagttattctctctccatattgggctttgatttgtgctgaaggtcagcttttggctcctccttcctgggatattggaaacaatgccagctctgtggcttctgccctggggactggggacagagtctctctctgtcgccaggctggagtgcagtggcatgatctcggctcactgcaacctccgcctcccaggttcaagcgattcttctgcctcagcctcctgagtagctgggactacagggtttgtgaaacaggatctgataatcaacctcttggtaataatcaacaatcaaattgtgaatattttgttgatagcctttttgaggaagctcagaaggttagttccaaatgtgtgtctcccgctgaacagaagaaacaggtagatgtaaatataaaattatggaaaaacggattcaccgtcaacgacgatttcagaagttattccgatggtgccagtcagcagtttttgaactccatcaaaaagggggaattaccttcagaattacagggaatttttgataaagaagaggtggacgttaaagttgaagacaagaaaaatgaaatatgtttgtctacgaagcctgtgttccagcccttttcaggacagggtcacagactaggaagtgccacaccaaaaattgtttctaaagcaaagaatattgaagttgaaaataaaaataatttgtctgctgttccactgaacaacttggaacccattactaatatacagatctggttggccaatggaaaaaggattgtccagaaatttaacattactcatagagtaagccatatcaaagacttcattgaaaaataccaaggatctcaaagaagtcctccgttttccctggcaacagctcttcctgtcctcaggttgctagatgagacactcacactggaagaagcagatttacagaatgctgtcatcattcagagactccaaaaaactgcatcttttagagaactttcagagcactgatttttgatagactaagtggaaaatttgcagagaaatgatggttgtaagtggacatgcaaaccaaaattggggattggagaagtcagactcactagacttttggttcgagtactattgaactctctcctgatgagaagatgtttagataagtacaagttaagaaagtagcatatgactggaaactatattcagtgcactttctccaaaagactacccagaaaaatagacttattttcaaataccagttatcaagatatattaaatagctgtattgtttagaatcttaatatggtataaattagcatatgtattcacaatattcattcagacatcattcccagacagcagggatttatttaaatgttagctgtctgagtttttaaatagctaatacgaccgggtacagtggttcatgcctgtaatcccagaacttcgggaggccgagacaggcagatcacgaggtcaacagattgagaccatcctggcaaacatggtgaaaccccatctctagtaaaaatacaaaaattagctgggcgtggcggtgcgcaactgtagtcccagctactcgggaggctgaggcaggagaatctcttgaacctggcaagtgtaggttgcagtgagctgagattgagcaactgtactccagcttggcgacagagcaagaccccctctcaaaaataaataaaataaagtaaaataaatataaataattgtggccgggtgcaatggctcatgcctgtaatcccagcactttgggaggctgagatgggaggatcacttgaagccaggagtttaaaaccagaatgatcaacagagtgagacccctgtctatatatttttttaatttaaaaaataaaagaataaaattgtgtagctcagtatagtatcaagattaatctgcctactcacatttctacactttataaaaatgtaataaaagaaaattatctttctaaaaagcctattccctttccattttattttctttcaaaaattatggatttgtttttggctaacatttgggattagccattcatttgccaccactcacttagaatataatgccggtgtgtgtcacattactagtattttttaaatgcatcatataaagtatggttttctgtttctttttcgtttgtttgagatggagtttcgctcttgttgcccaggctggagtgcagtggcgcaatctcagctcaccacaacctccacctcccgggttcaagagattctcctgctcagcctcccaagtagctgggattacaggcatgcgccaccatgcttggctaattttgcatttttagtagacacgggatttcaccatgttggtcaggctggtctcgaactcccgacctcaggggatctgcctgcctaggcctcctgaagtgctgggattacaagtgtgaaccaccgtgcccagctggttttctgtttcatacatcagagtcaacttgtgaatacatttaaagattatttcattttgatatcacgaagaaaaacaggctttatatctcagactttaactaaatccagttagacctcaatttttcactgtcagattaaatccccatacctgaaaataagtttaacatttttttttgcaaatgatctattgaatcagatttaaaatgaagcatgcattgagtgtgccaaggaactaagtggtccatagcagcagtaatgttcatagggtgcgagatgcctgctatgaaacagcaactctcaaacatttttatctcaagaccatttgtttatgtgagctatatatattattatattaaatattaaatttttaaaatatttatttatggccactgtgcccagccaataataacttataaaacatgaaacgatttagtgagaaaagtggccggttttttggggggaattactttctgtcataaagaagatagatgggttctcatgtcttctacattcagtctgttgtgcagtcacatatcatgtagactctggaaaacacctctgtatactggtgaaagaatgaaaagaagcaaataatgccttagtatgattatgaaaaacgttttgacttcacagtgccctgaatgggtcttgggaatctccagggatccctcaggcacactttgagaaccaatctatataaagtgatggttcacaatgattctgaagccttagtttcagaatcatttggggcagcttttcaaaaatgccattcctgccacctaccacaaagattctgattcactgtatctgtgatgggtctcagatctctgcatttttaatctcacgtgattcttaagtatgtggtggaagtacctttcttcaggaaattctgtcctaagcttttaccctgagaaaataaaacctgcatgctttcaccatggacggtgggagactccactgaaacacatctgctagaccactaagtttatccttgtcacccagtttgctcttggaaagagtctgttcccttttgtcactgaaccaatcatgacataaacttgtgctttacctcctatagcacagccgagacaaggctggaacatttaattaaggtttttactaaggactcaggaataacaacagggaaatatctatgtaactagatgacctgacataaaatctatcttctgattgcagtctattgtgagaatgctgcttttcctagctcccagccttccatggggcagaaggctcttttaattaggaagagagggaggacaaaggagagccttttcttttgtccattactcttagaaatgaacaggtacataatagaaaataaataattattgttggtaatgtttacacagcagtgttagagcctctctgtagtgaaacaaaaataatgttcttaccaaaaaaaa

SEQ ID NO: 463433 - DNA, 3488 bp, Homo sapiens
gttgagttcctatgtacgtaatttgagataagtaaagataggaaactgctgatttgttttgatgcgaatgcagaaaataatcttgcctaatctgggcctagaagcagttattctctctccatattgggctttgatttgtgctgaaggtcagcttttggctcctccttcctgggatattggaaacaatgccagctctgtggcttctgccctggggactggggacagagtctctctctgtcgccaggctggagtgcagtggcatgatctcggctcactgcaacctccgcctcccaggttcaagcgattcttctgcctcagcctcctgagtagctgggactacagggtttgtgaaacaggatctgataatcaacctcttggtaataatcaacaatcaaattgtgaatattttgttgatagcctttttgaggaagctcagaaggttagttccaaatgtgtgtctcccgctgaacagaagaaacaggtagatgtaaatataaaattatggaaaaacggattcaccgtcaacgacgatttcagaagttattccgatggtgccagtcagcagtttttgaactccatcaaaaagggggaattaccttcagaattacagggaatttttgataaagaagaggtggacgttaaagttgaagacaagaaaaatgaaatatgtttgtctacgaagcctgtgttccagcccttttcaggacagggtcacagactaggaagtgccacaccaaaaattgtttctaaagcaaagaatattgaagttgaaaataaaaataatttgtctgctgttccactgaacaacttggaacccattactaatatacagatctggttggccaatggaaaaaggattgtccagaaatttaacattactcatagagtaagccatatcaaagacttcattgaaaaataccaaggatctcaaagaagtcctccgttttccctggcaacagctcttcctgtcctcaggttgctagatgagacactcacactggaagaagcagatttacagaatgctgtcatcattcagagactccaaaaaactgcatcttttagagaactttcagagcactgatttttgatagactaagtggaaaatttgcagagaaatgatggttgtaagtggacatgcaaaccaaaattggggattggagaagtcagactcactagacttttggttcgagtactattgaactctctcctgatgagaagatgtttagataagtacaagttaagaaagtagcatatgactggaaactatattcagtgcactttctccaaaagactacccagaaaaatagacttattttcaaataccagttatcaagatatattaaatagctgtattgtttagaatcttaatatggtataaattagcatatgtattcacaatattcattcagacatcattcccagacagcagggatttatttaaatgttagctgtctgagtttttaaatagctaatacgaccgggtacagtggttcatgcctgtaatcccagaacttcgggaggccgagacaggcagatcacgaggtcaacagattgagaccatcctggcaaacatggtgaaaccccatctctagtaaaaatacaaaaattagctgggcgtggcggtgcgcaactgtagtcccagctactcgggaggctgaggcaggagaatctcttgaacctggcaagtgtaggttgcagtgagctgagattgagcaactgtactccagcttggcgacagagcaagaccccctctcaaaaataaataaaataaagtaaaataaatataaataattgtggccgggtgcaatggctcatgcctgtaatcccagcactttgggaggctgagatgggaggatcacttgaagccaggagtttaaaaccagaatgatcaacagagtgagacccctgtctatatatttttttaatttaaaaaataaaagaataaaattgtgtagctcagtatagtatcaagattaatctgcctactcacatttctacactttataaaaatgtaataaaagaaaattatctttctaaaaagcctattccctttccattttattttctttcaaaaattatggatttgtttttggctaacatttgggattagccattcatttgccaccactcacttagaatataatgccggtgtgtgtcacattactagtattttttaaatgcatcatataaagtatggttttctgtttctttttcgtttgtttgagatggagtttcgctcttgttgcccaggctggagtgcagtggcgcaatctcagctcaccacaacctccacctcccgggttcaagagattctcctgctcagcctcccaagtagctgggattacaggcatgcgccaccatgcttggctaattttgcatttttagtagacacgggatttcaccatgttggtcaggctggtctcgaactcccgacctcaggggatctgcctgcctaggcctcctgaagtgctgggattacaagtgtgaaccaccgtgcccagctggttttctgtttcatacatcagagtcaacttgtgaatacatttaaagattatttcattttgatatcacgaagaaaaacaggctttatatctcagactttaactaaatccagttagacctcaatttttcactgtcagattaaatccccatacctgaaaataagtttaacatttttttttgcaaatgatctattgaatcagatttaaaatgaagcatgcattgagtgtgccaaggaactaagtggtccatagcagcagtaatgttcatagggtgcgagatgcctgctatgaaacagcaactctcaaacatttttatctcaagaccatttgtttatgtgagctatatatattattatattaaatattaaatttttaaaatatttatttatggccactgtgcccagccaataataacttaagtatgtggtggaagtacctttcttcaggaaattctgtcctaagcttttaccctgagaaaataaaacctgcatgctttcaccatggacggtgggagactccactgaaacacatctgctagaccactaagtttatccttgtcacccagtttgctcttggaaagagtctgttcccttttgtcactgaaccaatcatgacataaacttgtgctttacctcctatagcacagccgagacaaggctggaacatttaattaaggtttttactaaggactcaggaataacaacagggaaatatctatgtaactagatgacctgacataaaatctatcttctgattgcagtctattgtgagaatgctgcttttcctagctcccagccttccatggggcagaaggctcttttaattaggaagagagggaggacaaaggagagccttttcttttgtccattactcttagaaatgaacaggtacataatagaaaataaataattattgttggtaatgtttacacagcagtgttagagcctctctgtagtgaaacaaaaataatgttcttaccaaaaaaaa

SEQ ID NO: 463434 - DNA, 3173 bp, Homo sapiens
gttgagttcctatgtacgtaatttgagataagtaaagataggaaactgctgatttgttttgatgcgaatgcagaaaataatcttgcctaatctgggcctagaagcagttattctctctccatattgggctttgatttgtgctgaaggtcagcttttggctcctccttcctgggatattggaaacaatgccagctctgtggcttctgccctggggactggggacagagtctctctctgtcgccaggctggagtgcagtggcatgatctcggctcactgcaacctccgcctcccaggttcaagcgattcttctgcctcagcctcctgagtagctgggactacagggtttgtgaaacaggatctgataatcaacctcttggtaataatcaacaatcaaattgtgaatattttgttgatagcctttttgaggaagctcagaaggttagttccaaatgtgtgtctcccgctgaacagaagaaacaggtagatgtaaatataaaattatggaaaaacggattcaccgtcaacgacgatttcagaagttattccgatggtgccagtcagcagtttttgaactccatcaaaaagggggaattaccttcagaattacagggaatttttgataaagaagaggtggacgttaaagttgaagacaagaaaaatgaaatatgtttgtctacgaagcctgtgttccagcccttttcaggacagggtcacagactaggaagtgccacaccaaaaattgtttctaaagcaaagaatattgaagttgaaaataaaaataatttgtctgctgttccactgaacaacttggaacccattactaatatacagatctggttggccaatggaaaaaggattgtccagaaatttaacattactcatagagtaagccatatcaaagacttcattgaaaaataccaaggatctcaaagaagtcctccgttttccctggcaacagctcttcctgtcctcaggttgctagatgagacactcacactggaagaagcagatttacagaatgctgtcatcattcagagactccaaaaaactgcatcttttagagaactttcagagcactgatttttgatagactaagtggaaaatttgcagagaaatgatggttgtaagtggacatgcaaaccaaaattggggattggagaagtcagactcactagacttttggttcgagtactattgaactctctcctgatgagaagatgtttagataagtacaagttaagaaagtagcatatgactggaaactatattcagtgcactttctccaaaagactacccagaaaaatagacttattttcaaataccagttatcaagatatattaaatagctgtattgtttagaatcttaatatggtataaattagcatatgtattcacaatattcattcagacatcattcccagacagcagggatttatttaaatgttagctgtctgagtttttaaatagctaatacgaccgggtacagtggttcatgcctgtaatcccagaacttcgggaggccgagacaggcagatcacgaggtcaacagattgagaccatcctggcaaacatggtgaaaccccatctctagtaaaaatacaaaaattagctgggcgtggcggtgcgcaactgtagtcccagctactcgggaggctgaggcaggagaatctcttgaacctggcaagtgtaggttgcagtgagctgagattgagcaactgtactccagcttggcgacagagcaagaccccctctcaaaaataaataaaataaagtaaaataaatataaataattgtggccgggtgcaatggctcatgcctgtaatcccagcactttgggaggctgagatgggaggatcacttgaagccaggagtttaaaaccagaatgatcaacagagtgagacccctgtctatatatttttttaatttaaaaaataaaagaataaaattgtgtagctcagtatagtatcaagattaatctgcctactcacatttctacactttataaaaatgtaataaaagaaaattatctttctaaaaagcctattccctttccattttattttctttcaaaaattatggatttgtttttggctaacatttgggattagccattcatttgccaccactcacttagaatataatgccggtgtgtgtcacattactagtattttttaaatgcatcatataaagtatggttttctgtttctttttcgtttgtttgagatggagtttcgctcttgttgcccaggctggagtgcagtggcgcaatctcagctcaccacaacctccacctcccgggttcaagagattctcctgctcagcctcccaagtagctgggattacaggcatgcgccaccatgcttggctaattttgcatttttagtagacacgggatttcaccatgttggtcaggctggtctcgaactcccgacctcaggggatctgcctgcctaggcctcctgaagtgctgggattacaagtgtgaaccaccgtgcccagctggttttctgtttcatacatcagagtcaacttgtgaatacatttaaagattatttcattttgatatcacgaagaaaaacaggctttatatctcagactttaactaaatccagttagacctcaatttttcactgtcagattaaatccccatacctgaaaataagtttaacatttttttttgcaaatgatctattgaatcagatttaaaatgaagcatgcattgagtgtgccaaggaactaagtggtccatagcagcagtaatgttcatagggtgcgagatgcctgctatgaaacagcaactctcaaacatttttatctcaagaccatttgtttatgtgagctatatatattattatattaaatattaaatttttaaaatatttatttatgggccaggcacgggtgttacgcctgtaatcccagcactttgggaggctgaggcaggcggatcacaaggtcaagtgattgagaccatcctgtccaacatggtgaatccccgtctctactaaaaatacaaaaaaaattagctgggtgtggtggcatgcgcctgtagtcccagctacgtgggaggctgagggaggagaatggcttgaacccgggaggtggaggtttcagtgagccgagattgcgcccctgcactccagcctggtgacggagcgagactctttctca

SEQ ID NO: 463435 - DNA, 738 bp, Homo sapiens
tacatccccagaaatggtttgtcctgcttctgctatttttaaaaagcactctgtttaggtagtagttgagagcacagacttgggagccaaactgcttaaacacatcaaaaatgtgccaggctgtgaccattgtgcagaagaaggcaacatgcccagcttccagaagaggccgatgcacaggccagcagttacagtgccaggtggtgactccttcgtttctggactcagggcctgatcctggccccagatctgacaagcggcagggccttggccaggtcactcctgcaggccacaccatttgtgacacctgtgacatgagaagtaaggccctgtgcctgccaggagcggcacggcacctgcagcagcacagccaccaagcacagccacagtcccagcacccatgtgccgggcaggggttctggaccgagacactactgacatgtggggctgggtcattcttcggtgtggcgctggctggtgcaccgcttagtggcatccctggcctctgcccactagacgctagaacccacccccagacattcccaaatgtcaccatctggcagagagaatggcagaatcacccccagaagtggacaactgccacagagcagttctgagaaaaggctcctccttcctgaagaaggtgaagatccgaattctgacaccaaacacacacaaatacgcacgcatgcacacgtgcaggaagctagcaggagggaggtgccccgcacaaatctg

SEQ ID NO: 463436 - DNA, 800 bp, Homo sapiens
cttcccatagacctgtttaaaatttctttcctctcgtcttccacacctaattttactattgtcttatttcactaggcaaagtttcaatgttcttgaaatatggatgttaaaacactcaggagattgctttcattggagaacaaatcttaggctgcaaatctagtatcacctgcatagtacttacatgtagaaatttcagattcagaactcaatcaaaatgcatatttcaagtgttatattaatgtgtttcttttatatttaggtgttttcattcacggattatttctggatggagcttcctggaatagaaagatcaagaaacttgcagaatcgcatcccaaaattctttatgatacagtgcctgtgatgtggctaaagccctgtaagagggcagatataccaaaacggccaagttatgttgctccattgtataagacaagtgagcggagaggagtattatccaccactggccattccacgaattttgtgattgccatgactcttccctctgaccaacccaaggaacactggattggacgaggtgtagcactgttatgtcaacttaattcataaccagaagacatcatttccttgttcctatttcttgttggctggctgagtagagaaagcatattattttactacttaaacctttttttttgtttgtttaaatacatttgactaaagttataattatgaatttacttatgagcaaatgcagctaaacttaatatgactcatacttaaatgtaaggaaatgttctgaaataaataaagactaaagaaaacaaaatggcata

SEQ ID NO: 463437 - DNA, 4611 bp, Homo sapiens
  misc_feature (2265)..(2265): n is a, c, g, or t
cgaattaatctccaccttcaaactgttgttagaaaagaaaagaagtgaagtaatgaaaatgaaaaagagatatgaagtgggtttggagaaactggattctgcttcatctcaagtagccacaatgcagatggagttggaggcactacatcctcaattaaaagttgctagcaaagaggttgatgaaatgatgataatgattgagaaagagtctgtagaagttgccaaaactgaaaaaatagtgaaagctgatgaaacaatagcgaatgaacaagctatggcttccaaagccatcaaagatgagtgcgatgctgacctggcaggtgccttgccaatattagagtcagcactggccgcccttgatactcttactgcacaggatattacagtggtaaaatccatgaagagtcctcctgctggtgtcaagcttgttatggaagctatatgcatcttgaaaggaatcaaagctgacaaaatccctgacccaacaggttcagggaaaaaaattgaggatttctggggcccagctaagagacttcttggtgacatgaggtttctgcagtcacttcatgaatatgacaaggacaatattcctccagcttatatgaatatcataagaaaaaattatattccaaatccagattttgtaccagaaaaaatcagaaatgcttctacagcggccgaaggtctgtgcaaatgggtcatagcaatggattcatatgataaagtggcaaaaatagtagctcccaaaaagataaaactggctgcagctgaaggggagcttaaaattgccatggatggtcttagaaagaagcaggcagcccttaaggaagttcaggacaagctggccaggcttcaagacacacttgaattaaataaacaaaagaaggctgacctggaaaaccaggttgacctttgcagcaaaaaactagaacgagctgaacagttgattggaggccttggaggtgagaaaactcgatggagccacacagctctggagctaggtcagctgtacatcaacttgactggggatatcctcatttcctccggagtggttgcttacctcggagccttcacatccacctatagacagaatcaaactaaagagtggacaactttgtgcaaaggaagagatatcccctgctcagatgattgctctcttatgggtaccctgggagaagctgtgacaattcgaacttggaatattgctggattaccttctgactcattttccattgataatgggataatcataatgaatgcaagaaggtggcctctgatgatagatcctcaaagtcaggctaataaatggatcaagaacatggaaaaagccaatagtctttatgtgattaaacttagtgaacctgactatgtcaggactctggaaaattgcatccagtttggtactcctgtgttgctagaaaatgttggcgaagaactagatcctattttggaacctcttctactaaaacaaacctttaagcagggtgggagtacatgtatccggcttggggactccacaattgaatatgcacctgacttccgcttctatattactaccaagttaagaaatcctcattatcttcctgaaacatcagtaaaggtaacattattaaacttcatgataacccctgagggaatgcaagatcagcttctgggaattgtggtggcacaagaaaggccagaccttgaagaagaaaagcaagccttgatattacaaggagctgaaaataaaaggcagttaaaagaaatagaagacaagattttagaagttctttcatcttcggaaggcaatatattagaagatgaaactgctattaagatattatcttcctccaaggccttggctaatgagatttctcagaagcaggaagtagccgaagagacagagaaaaagattgacaccacccgcatgggctatcgtcctattgccatccattcttccatcctatttttttctcttgctgatttagccaacattgagcccatgtaccagtattcactgacctggtttattaaccttttcatcctgtctattgaaaattcagagaaatcagaaattttggcaaaaaggcttcagattctcaaggatcactttacttattcactgtatgttaatgtctgccggtcactctttgaaaaggataagctgctcttttccttttgtctaaccataaatctactgctgcatgagcgggcgattaataaagctgagtggagatttctgctaactggtggcattggactggataatccttatgccaaccnttgtacatggcttcctcagaaatcctgggatgaaatatgtcgattagatgatttgcctgccttcaaaaccattcgtagagagtttatgcgcttaaaggatggatggaagaaagtatatgatagtttggaaccacaccatgaggttttccctgaagaatgggaagataaagcaaatgagtttcaaaggatgcttattattcgttgcttgaggccagacaaggttattccaatgttgcaggaatttataatcaacagattgggacgtgcattcattgaaccacccccctttgatttagccaaggcatttggagacagtaactgctgtgcaccactgattttcgtgctctctcctggagcagatcccatggctgcccttctaaaatttgctgatgaccagggatatgggggatcaaaacttagctctttatctcttggtcaaggccaagggcccattgctatgaagatgttagaaaaagctgtcaaggaaggaacatgggttgttcttcagaattgtcaccttgccacctcttggatgccaacccttgagaaagtctgtgaggagttaagcccagagtcaacacatccagatttccgaatgtggctaacgagttacccatctccaaatttccctgtgtcagtactgcagaatggagtgaaaatgaccaatgaagcaccaaaaggtttacgggctaatatcattcgatcatacctcatggacccgatctctgatccggagttctttggcagctgcaaaaagcctgaggaattcaagaaattgctttatggcctgtgtttctttcatgctttggtacaagaaagacggaaatttggacccctagggtggaatattccttatgagttcaatgagacagatctgagaatcagcgtacagcagctccacatgttcctgaaccagtatgaggaactgccgtatgaggctctgcggtacatgactggcgaatgcaattacggaggcagagtgaccgatgactgggaccggcgcacgctgcgcagcattctaaacaaattcttcaatcccgaattagttgaaaattcagactataagttcgactcaagtggcatctattttgttcctccttctggtgatcacaaaagctacatcgaatacacaaagactctgccactgaccccagcaccagaaatctttgggatgaatgccaatgcagatatcactaaggatcagtcagaaactcagctgctatttgataacattcttcttacacagtctcgttcagcaggtgctggtgcaaaatcatcagatgaagtagtgaatgaggtcgctagtgacatcttgggcaaacttccaaacaacttcgacatcgaggctgccatgaggaggtacccaacaacttatactcagagcatgaacactgtacttgtccaagagatgggacggttcaataagttactgaagaccataagagattcgtgcgtaaatattcaaaaagcaatcaaggggcttgcagtcatgtctacagatcttgaagaagtggttagcagcattttgaatgtcaaaattccagaaatgtggatgggtaaatcctacccaagccttaaaccacttggcagctatgtgaatgacttccttgcaagactaaaattcttgcagcaatggtatgaggttggtcctcctccagtcttctggctttctggcttcttcttcacacaagccttcctgaccggtgcccagcagaactacgccaggaaatacacaattcctattgatcttcttgggtttgactatgaagtgatggaagacaaagaatacaagcatcctcctgaggatggtgttttcattcacggattatttctggatggagcttcctggaatagaaagatcaagaaacttgcagaatcgcatcccaaaattctttatgatacagtgcctgtgatgtggctaaagccctgtaagagggcagatataccaaaacggccaagttatgttgctccattgtataagacaagtgagcggagaggagtattatccaccactggccattccacgaattttgtgattgccatgactcttccctctgaccaacccaaggaacactggattggacgaggtgtagcactgttatgtcaacttaattcataaccagaagacatcatttccttgttcctatttcttgttggctggctgagtagagaaagcatattattttactacttaaacctttttttttgtttgtttaaatacatttgactaaagttataattatgaatttacttatgagcaaatgcagctaaacttaatatgactcatacttaaatgtaaggaaatgttctgaaataaataaagactaaagaaaacaaaatggcata

SEQ ID NO: 463438 - DNA, 723 bp, Homo sapiens
gtgaacatgattaagtagtgtagaaacaaatcatggcttgaccagcatcgtctttctcctccttttcaggaatgcaagaaggtggcctctgatgatagatcctcaaagtcaggctaataaatggatcaagaacatggaaaaagccaatagtctttatgtgattaaacttagtgaacctgactatgtcaggactctggaaaattgcatccagtttggtactcctgagacaggagctcgccatgttgcctaggctggtcttgaactcctggactcaagcaatcctcctgcctcgtcctctcaaagtgctggaattacaggcatgagccactgtgcctggcctttgtgtcatttttctatcaatctatatactgttgttgctagaaaatgttggcgaagaactagatcctattttggaacctcttctactaaaacaaacctttaagcagggtgggagtacatgtatccggcttggggactccacaattgaatatgcacctgacttccgcttctatattactaccaagttaagaaatcctcattatcttcctgaaacatcagtaaaggtaacattattaaacttcatgataacccctgagggaatgcaagatcagcttctgggaattgtggtggcacaagaaaggccagaccttgaagaagaaaagcaagccttgatattacaaggagctgaaaataaaaggttttaaatgtcataaacagaactat

SEQ ID NO: 463439 - DNA, 1824 bp, Homo sapiens
agcgccagtttgttctggccgtgtctcccactagaatgagttaagcccagagtcaacacatccagatttccgaatgtggctaacgagttacccatctccaaatttccctgtgtcagtactgcagaatggagtgaaaatgaccaatgaagcaccaaaaggtttacgggctaatatcattcgatcatacctcatggacccgatctctgatccggagttctttggcagctgcaaaaagcctgaggaattcaagaaattgctttatggcctgtgtttctttcatgctttggtacaagaaagacggaaatttggacccctagggtggaatattccttatgagttcaatgagacagatctgagaatcagcgtacagcagctccacatgttcctgaaccagtatgaggaactgccgtatgaggctctgcggtacatgactggcgaatgcaattacggaggcagagtgaccgatgactgggaccggcgcacgctgcgcagcattctaaacaaattcttcaatcccgaattagttgaaaattcagactataagttcgactcaagtggcatctattttgttcctccttctggtgatcacaaaagctacatcgaatacacaaagactctgccactgaccccagcaccagaaatctttgggatgaatgccaatgcagatatcactaaggatcagtcagaaactcagctgctatttgataacattcttcttacacagtctcgttcagcaggtgctggtgcaaaatcatcagatgaagtagtgaatgaggtcgctagtgacatcttgggcaaacttccaaacaacttcgacatcgaggctgccatgaggaggtacccaacaacttatactcagagcatgaacactgtacttgtccaagagatgggacggttcaataagttactgaagaccataagagattcgtgcgtaaatattcaaaaagcaatcaaggggcttgcagtcatgtctacagatcttgaagaagtggttagcagcattttgaatgtcaaaattccagaaatgtggatgggtaaatcctacccaagccttaaaccacttggcagctatgtgaatgacttccttgcaagactaaaattcttgcagcaatggtatgaggttggtcctcctccagtcttctggctttctggcttcttcttcacacaagccttcctgaccggtgcccagcagaactacgccaggaaatacacaattcctattgatcttcttgggtttgactatgaagtgatggaagacaaagaatacaagcatcctcctgaggatggtgttttcattcacggattatttctggatggagcttcctggaatagaaagatcaagaaacttgcagaatcgcatcccaaaattctttatgatacagtgcctgtgatgtggctaaagccctgtaagagggcagatataccaaaacggccaagttatgttgctccattgtataagacaagtgagcggagaggagtattatccaccactggccattccacgaattttgtgattgccatgactcttccctctgaccaacccaaggaacactggattggacgaggtgtagcactgttatgtcaacttaattcataaccagaagacatcatttccttgttcctatttcttgttggctggctgagtagagaaagcatattattttactacttaaacctttttttttgtttgtttaaatacatttgactaaagttataattatgaatttacttatgagcaaatgcagctaaacttaatatgactcatacttaaatgtaaggaaatgttctgaaataaataaagactaaagaaaacaaaatggcata

SEQ ID NO: 463440 - DNA, 1864 bp, Homo sapiens
agcgccagtttgttctggccgtgtctcccactagaatgagttaagcccagagtcaacacatccagatttccgaatgtggctaacgagttacccatctccaaatttccctgtgtcagtactgcagaatggagtgaaaatgaccaatgaagcaccaaaaggtttacgggctaatatcattcgatcatacctcatggacccgatctctgatccggagttctttggcagctgcaaaaagcctgaggaattcaagaaattgctttatggcctgtgtttctttcatgctttggtacaagaaagacggaaatttggacccctagggtggaatattccttatgagttcaatgagacagatctgagaatcagcgtacagcagctccacatgttcctgaaccagtatgaggaactgccgtatgaggctctgcggtacatgactggcgaatgcaattacggaggcagagtgaccgatgactgggaccggcgcacgctgcgcagcattctaaacaaattcttcaatcccgaattagttgaaaattcagactataagttcgactcaagtggcatctattttgttcctccttctggtgatcacaaaagctacatcgaatacacaaagactctgccactgaccccagcaccagaaatctttgggatgaatgccaatgcagatatcactaaggatcagtcagaaactcagctgctatttgataacattcttcttacacagtctcgttcagcaggtgctggtgcaaaatcatcagatgaagtagtgaatgaggtcgctagtgacatcttgggcaaacttccaaacaacttcgacatcgaggctgccatgaggaggtacccaacaacttatactcagagcatgaacactgtacttgtccaagagatgggacggttcaataagttactgaagaccataagagattcgtgcgtaaatattcaaaaagcaatcaaggggcttgcagtcatgtctacagatcttgaagaagtggttagcagcattttgaatgtcaaaattccagaaatgtggatgggtaaatcctacccaagccttaaaccacttggcagctatgtgaatgacttccttgcaagactaaaattcttgcagcaatggtatgaggttggtcctcctccagtcttctggctttctggcttcttcttcacacaagccttcctgaccggtgcccagcagaactacgccaggaaatacacaattcctattgatcttcttgggtttgactatgaagtgatggaagacaaagaatacaagcatcctcctgaggatggtgttttcattcacggattatttctggatggagcttcctggaatagaaagatcaagaaacttgcagaatcgcatcccaaaattctttatgatacagtgcctgtgatgtggctaaagccctgtaagagggcagatataccaaaacggccaagttatgttgctccattgtataagacaagtgagcggagaggagtattatccaccactggccattccacgaattttgtgattgccatgactcttccctctgaccaacccaaggaacactggattggacgaggtgtagcactgttatgtcaacttaattcataaccagaagacatcatttccttgttcctatttcttgttggctggctgagtagagaaagcatattattttactacttaaacctttttttttgtttgtttaaatacatttgactaaagttataattatgaatttacttatgagcaaatgcagctaaacttaatatgactcatacttaaatgtaaggaaatgttctgaaataaataaataaagcacggaaccggagtagttcccttatgtgtctatgtagggtaacgttatgtcgtatgaat

SEQ ID NO: 463441 - DNA, 1045 bp, Homo sapiens
gcagtgcccagcgtggcctctcagccagcgccacctgtgagcacccagcaccctcatcaacccagaggctggtaccagcaccatacatatccaccttccccttgccttcgtctaactcctttctctccagttatgtctttcactatttctgaaatcttttatctgtaaactcaacttggatactgacttctgactttctgaacacgaaccttggcttgtagtaccgcccgggttcctgagcatcctacagactgtcccccaggtaacattattaaacttcatgataacccctgagggaatgcaagatcagcttctgggaattgtggtggcacaagaaaggccagaccttgaagaagaaaagcaagccttgatattacaaggagctgaaaataaaaggcagttaaaagaaatagaagacaagattttagaagttctttcatcttcggaaggcaatatattagaagatgaaactgctattaagatattatcttcctccaaggccttggctaatgagatttctcagaagcaggaagtagccgaagagacagagaaaaagattgacaccacccgcatgggctatcgtcctattgccatccattcttccatcctatttttttctcttgctgatttagccaacattgagcccatgtaccagtattcactgacctggtttattaaccttttcatcctgtctattgaaaattcagagaaatcagaaattttggcaaaaagattgggacgtgcattcattgaaccacccccctttgatttagccaaggcatttggagacagtaactgctgtgcaccactgattttcgtgctctctcctggagcagatcccatggctgcccttctaaaatttgctgatgaccaggtaccttacaatagatgaagttatcggatattattttaaaaaagcaatacttgcttataattgaaattttaaggatgagggaaaggtagaaatttgtcattcaacctttgaaagttatcacaagttgacagaatcccaagaaaatgatactaaaatggcagcactgacact

SEQ ID NO: 463442 - DNA, 3574 bp, Homo sapiens
  misc_feature (1228)..(1228): n is a, c, g, or t
gtgaacatgattaagtagtgtagaaacaaatcatggcttgaccagcatcgtctttctcctccttttcaggaatgcaagaaggtggcctctgatgatagatcctcaaagtcaggctaataaatggatcaagaacatggaaaaagccaatagtctttatgtgattaaacttagtgaacctgactatgtcaggactctggaaaattgcatccagtttggtactcctgagacaggagctcgccatgttgcctaggctggtcttgaactcctggactcaagcaatcctcctgcctcgtcctctcaaagtgctggaattacaggcatgagccactgtgcctggcctttgtgtcatttttctatcaatctatatactgttgttgctagaaaatgttggcgaagaactagatcctattttggaacctcttctactaaaacaaacctttaagcagggtgggagtacatgtatccggcttggggactccacaattgaatatgcacctgacttccgcttctatattactaccaagttaagaaatcctcattatcttcctgaaacatcagtaaaggtaacattattaaacttcatgataacccctgagggaatgcaagatcagcttctgggaattgtggtggcacaagaaaggccagaccttgaagaagaaaagcaagccttgatattacaaggagctgaaaataaaaggcagttaaaagaaatagaagacaagattttagaagttctttcatcttcggaaggcaatatattagaagatgaaactgctattaagatattatcttcctccaaggccttggctaatgagatttctcagaagcaggaagtagccgaagagacagagaaaaagattgacaccacccgcatgggctatcgtcctattgccatccattcttccatcctatttttttctcttgctgatttagccaacattgagcccatgtaccagtattcactgacctggtttattaaccttttcatcctgtctattgaaaattcagagaaatcagaaattttggcaaaaaggcttcagattctcaaggatcactttacttattcactgtatgttaatgtctgccggtcactctttgaaaaggataagctgctcttttccttttgtctaaccataaatctactgctgcatgagcgggcgattaataaagctgagtggagatttctgctaactggtggcattggactggataatccttatgccaaccnttgtacatggcttcctcagaaatcctgggatgaaatatgtcgattagatgatttgcctgccttcaaaaccattcgtagagagtttatgcgcttaaaggatggatggaagaaagtatatgatagtttggaaccacaccatgaggttttccctgaagaatgggaagataaagcaaatgagtttcaaaggatgcttattattcgttgcttgaggccagacaaggttattccaatgttgcaggaatttataatcaacagattgggacgtgcattcattgaaccacccccctttgatttagccaaggcatttggagacagtaactgctgtgcaccactgattttcgtgctctctcctggagcagatcccatggctgcccttctaaaatttgctgatgaccagggatatgggggatcaaaacttagctctttatctcttggtcaaggccaagggcccattgctatgaagatgttagaaaaagctgtcaaggaaggaacatgggttgttcttcagaattgtcaccttgccacctcttggatgccaacccttgagaaagtctgtgaggagttaagcccagagtcaacacatccagatttccgaatgtggctaacgagttacccatctccaaatttccctgtgtcagtactgcagaatggagtgaaaatgaccaatgaagcaccaaaaggtttacgggctaatatcattcgatcatacctcatggacccgatctctgatccggagttctttggcagctgcaaaaagcctgaggaattcaagaaattgctttatggcctgtgtttctttcatgctttggtacaagaaagacggaaatttggacccctagggtggaatattccttatgagttcaatgagacagatctgagaatcagcgtacagcagctccacatgttcctgaaccagtatgaggaactgccgtatgaggctctgcggtacatgactggcgaatgcaattacggaggcagagtgaccgatgactgggaccggcgcacgctgcgcagcattctaaacaaattcttcaatcccgaattagttgaaaattcagactataagttcgactcaagtggcatctattttgttcctccttctggtgatcacaaaagctacatcgaatacacaaagactctgccactgaccccagcaccagaaatctttgggatgaatgccaatgcagatatcactaaggatcagtcagaaactcagctgctatttgataacattcttcttacacagtctcgttcagcaggtgctggtgcaaaatcatcagatgaagtagtgaatgaggtcgctagtgacatcttgggcaaacttccaaacaacttcgacatcgaggctgccatgaggaggtacccaacaacttatactcagagcatgaacactgtacttgtccaagagatgggacggttcaataagttactgaagaccataagagattcgtgcgtaaatattcaaaaagcaatcaaggggcttgcagtcatgtctacagatcttgaagaagtggttagcagcattttgaatgtcaaaattccagaaatgtggatgggtaaatcctacccaagccttaaaccacttggcagctatgtgaatgacttccttgcaagactaaaattcttgcagcaatggtatgaggttggtcctcctccagtcttctggctttctggcttcttcttcacacaagccttcctgaccggtgcccagcagaactacgccaggaaatacacaattcctattgatcttcttgggtttgactatgaagtgatggaagacaaagaatacaagcatcctcctgaggatggtgttttcattcacggattatttctggatggagcttcctggaatagaaagatcaagaaacttgcagaatcgcatcccaaaattctttatgatacagtgcctgtgatgtggctaaagccctgtaagagggcagatataccaaaacggccaagttatgttgctccattgtataagacaagtgagcggagaggagtattatccaccactggccattccacgaattttgtgattgccatgactcttccctctgaccaacccaaggaacactggattggacgaggtgtagcactgttatgtcaacttaattcataaccagaagacatcatttccttgttcctatttcttgttggctggctgagtagagaaagcatattattttactacttaaacctttttttttgtttgtttaaatacatttgactaaagttataattatgaatttacttatgagcaaatgcagctaaacttaatatgactcatacttaaatgtaaggaaatgttctgaaataaataaagactaaagaaaacaaaatggcata

SEQ ID NO: 463443 - DNA, 1669 bp, Homo sapiens
gtgaggcaggaactgagaggtgctggcgtgtcccatacctctctcaccttcagaactccctgaggcctcatgttctttctgtctgtcatcagaggctgagcagtacagcagttgagagaagaggctcaggaaccaggaatgggaagctgatctgtttggggacgtgccagtgaagcggtgtgcgttggcaccaccagcggctgtcattctcaggagacaatgggattggagcgccaagggggagagttctccatgcagaatttccctgcttaatccgctcttgtgcgctggcaccaagtcaacaaaggaaaggaaccaaattacccgggcggctttggcaggctgcaccactgtcagcgggccagaagttaattccctcatcttcccccgtgccaccaactcagggggcaggtctggccaggctggctttctgtgtaaggctgtcaggtggcgtgaaggggaaagaacaggcgggcagagggtggtccaatcgccggtgcagcttcacagacagacggacggacagatgtcctgtagcagccctgcccctctccctgcccccaaagcctcaataccgggttctgtctgatgcaccaggggaaggaggaggagggtacctgatgcgcagcgtctacagtccccatataaaaatggggagtggaccttaacttcagtggagacagggcatagggacctcaaatagagcaattggcagttcaacctggcaccaagatgggctgtcatgggggtaatggtaccccatcactggggaagaggggggactggcacctgggctgcccaccatgaaacactccttctccaccacagtttgggtggggaaaagggtcagggaaagccttctgggagcagctcagcccactcagacctcccctctgttggagcccagagcccttaatgtccgtgactcactggattacaaggaggacgtcgatcataggaaagatgtgcatcacaggttggatgtggatcacaaggaggatgtggatcatggggagcatgtgaatcatggggtaaatgtgggtcacagggaggatgtagatcacggggaggatgtggatcatggggaagatgtggatcatagggaagatgtggatcatggggtggatgtggatcacagggaggatatggatcatggggagaatgtggatcatcggattgatgtggaccatgggatggacatggggaatagggtggatgtggatcacggggtggacttggatcacagggaggatgtggatcatagggaggatgtggatcatggggaagatgtaaatcattgggtggatgtggatcacgaggtggatatggatcacggggagaatgtggatcatggggaggatgtggatcttggggtggacatggatcacggggtggatgtggatcacggattggacatggggcacagggaggaggtggagcatggagaggatgtggatcatggaatagatgtggatcactggactttaattgagcaagtaaaggacccatccccgcaccaccaccaccccaagaggatcttgggtctgaggagctgaccgatcccctcattcaatcctcacagccctaccgagaagcactctcattatccctcccgtacaggtgacttggtgattggactgtggatatggattttctatgatgtttaaga

SEQ ID NO: 463444 - DNA, 1483 bp, Homo sapiens
tatatctaggtattgccagacttccaccatcggggcattataacgcttataaaacatttggtaatggcatgctttctgtctttaggatgcttagagagcagtgatagccaccaatgtgatctgatagattctatcacctgcaaaaagtgtaaaagggacgatggggcattaatgagtgatttgaaagctctagctctttttacaacactagcaggacacattggaatcacctatgtccaggccacaacccagagctttgctgtccataaacacagagttgaaatagatttccccctttatgaaaagaaaaccatgatgacccatgaaaagagcagacatttctccgtatggctggaaacatggccaccagcaatttatcctatagcttctgttactgaaaagttctgtgactgccaagttaaaaaaaattgtaagcaagtaactcatgaggagcagagttttctgctgcaaacaaagcagcagaatgaggagaatgaggagtctgaggaaaatgcagaaagtttgaaatagctactgtggaaaagggagagagaggcaattaacacagtacgataattttggacatatggaatttgaattccagagagataacatctatgtgagaaccattttgtaggctgtgctcttataaagatatatcaaaagccgcacttgtcaccttttctaaaaatgcaagtcattttcaccccctctccttctaatccttctactttctccccatatttataaacacatttcccaaaaaatattcaatcttctttttcatggatccaaaagacattggacatatggcttgaacacaacactggggtaataattaattaaggtaagaaagcaaggattttggaaagtgtgggttgatgagtcagataatggtaggatttttctcctgatctctggtaaggtattacaaagttctctcctaattgtcttgcaggcccctgacagcatatcctgaattaaacttgttctgttttcccagcttacccttctaaattctctatttcctgtcacggcatctctctccatcccttaatcatctaaactggaatcccagctctctatttcacaccccatatccaatcccctcggcccttaggggagagcgggcaatagatcctggctgcgctggtcacctgtgggctccagcagcaaacaggtgggttcatttcctgcagtatgctgtacaaatgttttatttttgtatgccctgatgtgaaaaggtttggaaaaactgtttccaacactggacaacaggcagtgcagacagggatctctaagagaggggaacagagtcagtcttgggatcaccacaggtttctgagtgcaggcactatgcatccaccatgtagcagagctgagggaggagagagattggaggtcagtgaagctgaaaagactgggacttgtgaggcaaagtgccagagaggagggagctatgcagaaaaagaacttcacacat

SEQ ID NO: 463445 - DNA, 907 bp, Homo sapiens
tctaacatgttgttaggatggctctgaaaagcatgaagaaactgatggctcaaatcatgtaaggcagaaataccagaattgctatggcagagggtggatcaaaagtctcagaaaaatgagcatgcccaacaattcagcgacagcaccatcagcccagatgggggttgtgagcaaagtccgagatggtcagaaggaaacgagaacctgggaggtggcgagtgtccactgctctagtctcaggacagcctgctctgttaaagcacctggtccttcttcctgaagacttcagtcccaccttgcattatgttttgttctgtgtatgtgcgtgtctatctctcctgctaactgctgagcttgctaaggaaaggaaccttgttttatgaaataaatgatatttatgagctcctgtgctatgatgtcaggtcatccccctctcctatgctccttccagatttgccatttgagtcacaagaccgcctatattgactataaaacaaactggaatatttgggctgtgaaagacttgcagcttcatagtaaggaagatgggaatgccatgttcaatttcttccccaagtggttatggatgtataacagagcccagagaccgaatcatagtttgggcttcacaaaggacctgtccagggagaacagaagcagtaaggggagcatgcgattgaagacaatggcacagaagggatctggggcttacaattgtgagggaatatcatgttttcaggtaaacatcatgaaaagaatatcaaacagaaagaactccttgggaatccccaatttcagagcacatagacagaatgttgtgtacgttcagcaggtgttagtggaggctaccaagtacggtgtagaaggatgtggaagttaggcacagacttgtgctcaaactctggtt

SEQ ID NO: 463446 - DNA, 1115 bp, Homo sapiens
caacgagccagagccttgcataccaggggcaggcattagaccacacccgctttgactgttagactcatctgcagtgcttgtgccactagacttctgctggctgatggcccccagctgtgagctctttcaggcatcacctttggctgcaaaaggctccctctcctgaagttactacctgcatccctggaggcagacttcatctcatgtcttcatccaaagtttgaacaaattggctaagaaggtgctagacatgtaaagggactattttttttcttaattcaaatgtaggaggagtatggatctccaggaaccagaagagctgcatacatatgcccaacaattcagcgacagcaccatcagcccagatgggggttgtgagcaaagtccgagatggtcagaaggaaacgagaacctgggaggtggcgagtgtccactgctctagtctcaggacagcctgctctgttaaagcacctggtccttcttcctgaagacttcagtcccaccttgcattatgttttgttctgtgtatgtgcgtgtctatctctcctgctaactgctgagcttgctaaggaaaggaaccttgttttatgaaataaatgatatttatgagctcctgtgctatgatgtcaggtcatccccctctcctatgctccttccagatttgccatttgagtcacaagaccgcctatattgactataaaacaaactggaatatttgggctgtgaaagacttgcagcttcatagtaaggaagatgggaatgccatgttcaatttcttccccaagtggttatggatgtataacagagcccagagaccgaatcatagtttgggcttcacaaaggacctgtccagggagaacagaagcagtaaggggagcatgcgattgaagacaatggcacagaagggatctggggcttacaattgtgagggaatatcatgttttcaggtaaacatcatgaaaagaatatcaaacagaaagaactccttgggaatccccaatttcagagcacatagacagaatgttgtgtacgttcagcaggtgttagtggaggctaccaagtacggtgtagaaggatgtggaagttaggcacagacttgtgctcaaactctggtt

SEQ ID NO: 463447 - DNA, 918 bp, Homo sapiens
caacgagccagagccttgcataccaggggcaggcattagaccacacccgctttgactgttagactcatctgcagtgcttgtgccactagtgagatgcgcctaatgggggagttcatcccccacctcaccctggtgcccaacaattcagcgacagcaccatcagcccagatgggggttgtgagcaaagtccgagatggtcagaaggaaacgagaacctgggaggtggcgagtgtccactgctctagtctcaggacagcctgctctgttaaagcacctggtccttcttcctgaagacttcagtcccaccttgcattatgttttgttctgtgtatgtgcgtgtctatctctcctgctaactgctgagcttgctaaggaaaggaaccttgttttatgaaataaatgatatttatgagctcctgtgctatgatgtcaggtcatccccctctcctatgctccttccagatttgccatttgagtcacaagaccgcctatattgactataaaacaaactggaatatttgggctgtgaaagacttgcagcttcatagtaaggaagatgggaatgccatgttcaatttcttccccaagtggttatggatgtataacagagcccagagaccgaatcatagtttgggcttcacaaaggacctgtccagggagaacagaagcagtaaggggagcatgcgattgaagacaatggcacagaagggatctggggcttacaattgtgagggaatatcatgttttcaggtaaacatcatgaaaagaatatcaaacagaaagaactccttgggaatccccaatttcagagcacatagacagaatgttgtgtacgttcagcaggtgttagtggaggctaccaagtacggtgtagaaggatgtggaagttaggcacagacttgtgctcaaactctggtt

SEQ ID NO: 463448 - DNA, 1549 bp, Homo sapiens
gatcttagttcatctctttaggattgggagggtcaggaagaaaaagatctagctacgataatagacattctttacagatgcaaattttccccccacaaaaaacagctttgtgcagggccttttcaaaatatggcaaagaaacatgttttggggtaaaatatttttattttcttccttgtctcataacgttatgccagccagagtcaggctggaaagtaagtcacaatatatagggttaaatgaaacctatctgatgagaatttatgatttgtagggcatgactctccagaccccttagataggaatttgggcaagataaaaaaaatcagagtttagtcctcaccacagtgtcaacttgctaatgtgatggaatggcagcaagatttcaaagaagattttgggggagagagcagggagtggctcagggaaagaagtggagtgttgagtcagttggcttaatgggaacctggtttgcccattttgaaaaccacaacggagaaataatcacccagatctactattttttcaccttaaaacatcctggggcccgtcatcttgcaccctggctctgcagggcaggattggaaggtctctggggggccccgctcctctgaaggatcacctgccccacctgtcacattcctccctggccaggcctcacactaaagagactcgcctggctccaccaacacccactccagactctgtaggggggtatcagcagaaattgaatctttagccccacagagaggctgtgacattcccactgccacttaagggttagggctagtcagagaatcatagaacgttaaagtgtgaaggaaccatcaggacagctcaagaagccgaaaccaagcaaatcagatggcccagggccacacagggaaggagtggaggggtccctgcgggagtgctgccccttccaggcctcctctgtcaccagaggagctggtcctgctgcttagagtcatattaaacctttggatggggtatgtaaggacactttcccctggaaaaatgctacgtcactcactttatatcctggccttaggccaactgagccttcaccccaccctccctgcctaagtcacctcaccaagcatcctctggtactgacgacgatgcttttggcctggttaccaagctttcctgaccacctgatggtagggcccctccacatgggctattcatcctcccagaagcaggtcctccagtgactgatctgcactaatgtgggcaaacagagggcatcctcctcctctctctgcttcttttctttgcaaaattagtgggacaaataggtacaagttgcatgaaaatgagatacagttcttcatttgccatccacaccaggagcaccaggtcccggagcccagctgtgcattagatgttgtctctgcagcacaaggtaggaggctgcaggatgtacctgagaaacgcaatcgcacaaagcaattgttcagcaccaaatatgggggacagaagagtgctaaggggagaagactccaaccataaataaataaaatggcagcaaattaggaaataacag

SEQ ID NO: 463449 - DNA, 1925 bp, Homo sapiens
tctgtgcagagacggtgggatcaactcctggccgcacacggatggagtcccaggcaagcctgccaaggcccagtcaggctttccacggagttgcgctcaccgtggcccctctctggctcttcaggcaagcagagctccctgtttccaagggcgtggggccctcttctctgcccaagcccctgctgactctctgtgttttcagctctgaggccagcactcagcccctctcatctgctggtgaggcttcaaccactggcagacgtgctcctcttcgggctgcttactgtgctcctgcagcccataagcgcttcggaggggtgcagttgctatggcaatgcctacagccatctgaattcctgctgcaccttctgggagaaaagagctcatgaagaggcattcggtggattcccagtctggcctctggcctctgcactgtcaggagtcagctgatgggttacatgccggacacgtgggaggagcaccaggtcccggagcccagctgtgcattagatgttgtctctgcagcacaaggtaggaggctgcaggatgtacctgagaaacgcaatcgcacaaagcaattgttcagcaccaaatatgggggacagaagagtgctaaggggagaagactccaaccataaataaataaaatggcagcaaattaggaaataacagaaaccatactgtctcatgacgtccattcacttgctcatcacagcctatccaaggctgctttcagagtttcagtgagttcttcactgttccctactcttgtaagctcttaaatatgcctgctcagctcctcttgcttctttgttttttaaaaacatactaaaggaactatttttgcagcaaaaccttcctcctcggataaaacttcacttcactggctctggcttttgaagccaggctttccctcctccaagccagcgcgcctcctctgaggtccctttcagtctggaggcctgtggtgatgtcagtgtgcctcagctgttttcaattaaacccctcgagctgagctgaataaatggcttcagcaagctgattttccaaagggtccaccttattttgaaccaacatgtcaaaacaaaatcaattcaacctgaaacacatacagtgcaaataaatacatctcttcacagatttaccttaaaaattacaagggcaggctggacacggtggctcacgcctgtaatcccagcactttgggaggctggggcccgtggatcacctaaggtcaggagttcgagaccagcctggccaacatggtgaaactccgcctctactaaaaaatacaaacattagccaggcgtggtggcgggcgcctgtaatcctagctacttgggaggctgaggcagggagaattgcttgaacctgggaagtggaggttgcagtaagccaagatcgtgccactgcattccaacctggatggcagtaagccaagatcgtgccactgcattccaacctggatgacagaataagactctgtcttaaaaaaaaaaaaaaaaattacaagggcaaagcaagatgcgagggcctctccagtcccagccccacagctcccctggggtgagaaggagggagctttgatttcagtgtcctcaaagaaggaggcaaagaaatgacagcatagccccgtgtcctggcctcggcatggctaagactgctcctgcccgcctcctgcccacctcgggcccaggactaggccagttgaggaggaagcatcacttcacctgctgccgcctgtctccttggcctggtccaccacagccgccggcctggtaggtgcccgtccctaaagaaagtcagctgcggaggctagaagggtgatacctctcagccctgcaccaggctgaaatccccgctccctgccaagtgcaggggtccccacgctgacgctggcacttgctcctgccccgtttcatttg

SEQ ID NO: 463450 - DNA, 1306 bp, Homo sapiens
  misc_feature (2)..(4): n is a, c, g, or t
  misc_feature (7)..(7): n is a, c, g, or t
  misc_feature (12)..(12): n is a, c, g, or t
  misc_feature (14)..(14): n is a, c, g, or t
cnnnttncctcntnagaatttagcatgaattgattgatgtcaagctagtgatgaagctgctagcacatatatatcaagctacaaccgaaataaagactcaaaacctggtttgggctgagcatccatgggacctcccggagccatctgggccttctgacaatggtgaagctcgcagaacctatctgatgcccaagagcagcagtgttggtgggagcatctgctctggggagcagagaggaggccatcaacactgtggtataagcagcagcctcagaagagggtggagagcagtggccaagcagcagtgtgatctgttgaggatgtgtgggctccagatggtcgctcaggtgttctggggagaaagcagggtaggttatggatgcaatccaggtaattgtaaattagaggtcaaatcagaattagtaaaaacgagtgaatttgctggtgttgctgcaactggcggtgcaggcagagctccctggagtggactctgagatagagatgagtgtgcaggatactaactagagagtgtacccaggatcaacatctgtggaagagaagggagaaaaacaggattggacaaaaggagatgctggaatgtcctgcagtctcatcaaaggccttagctgaccccatggggaactctgggcccggatgacctgcagagctgccccaagttgggaagaacagtaaaacagacttgttattggcagcccattagtgctcaggagaggcggtctccagcatgacatcagccggcggctcgacccaaatctagtatttcaccagagagcctaacgctgctggctttccaactgtgtggaagacgatacaggcgtaacaaagacaaggatgaaataagtcctgtgatggagagacaagcaaaattctacctgacttcacaggaggaagaagtgtgctgtgccagggggaacaggagaaagcttcatggaagaggtcacaggaaatgggtagctatccagctaaatagatttcatgcttgacttcagtggaatagctcaaatgatgatctgtttgggagagtaaattaaagagtttccatccgaggttggttgaatccacagatacggaacccacagatatagagggccaaccatactgagtcctgacttcacccattccttctacccccatctctcctaatccttaaacttccttgcaattcctggagcagaatactcgtgtaggagtcaggggttgtcttcccttcctagaagcaatgcttctatgttctcatttgatgttgaataaaacattaaacagaaaagctttgataacatcacat

SEQ ID NO: 463451 - DNA, 1063 bp, Homo sapiens
  misc_feature (2)..(4): n is a, c, g, or t
  misc_feature (7)..(7): n is a, c, g, or t
  misc_feature (12)..(12): n is a, c, g, or t
  misc_feature (14)..(14): n is a, c, g, or t
cnnnttncctcntnagaatttagcatgaattgattgatgtcaagctagtgatgaagctgctagcacatatatatcaagctacaaccgaaataaagactcaaaacctggtttgggctgagcatccatgggacctcccggagccatctgggccttctgacaatggtgaagctcgcagaacctatctgatgcccaagagcagcagtgttggtgggagcatctgctctggggagcagagaggaggccatcaacactgtggtataagcagcagcctcagaagagggtggagagcagtggccaagcagcagtgtgatctgttgaggatgtgtgggctccagatggtcgctcaggtgttctggggagaaagcagggtaggttatggatgcaatccaggtaattgtaaattagaggtcaaatcagaattagtaaaaacgagtgaatttgctggtgttgctgcaactggcggtgcaggcagagctccctggagtggactctgagatagagatgagtgtgcaggatactaactagagagtgtacccaggatcaacatctgtggaagagaagggagaaaaacaggattggacaaaaggagatgctggaatgtcctgcagtctcatcaaaggccttagctgaccccatggggaactctgggcccggatgacctgcagagctgccccaagttgggaagaacagtaaaacagacttgttattggcagcccattagtgctcaggagaggcggtctccagcatgacatcagccggcggctcgacccaaatctagtatttcaccagagagcctaacgctgctggctttccaactgtgtggaagacgatacaggcgtaacaaagacaaggatgaaataagtcctgtgatggagagacaagcaaaattctacctgacttcacaggaggaagaagtgtgctgtgccagggggaacaggagaaagcttcatggaagaggtgagccttacaagccacgtaggatttcaaaaggggaggataatgttccgaggcaaggaaccagcaaaacactgaggaataaaagtaaaaattgtatctggggaat

SEQ ID NO: 463452 - DNA, 1529 bp, Homo sapiens
  misc_feature (1)..(1): n is a, c, g, or t
  misc_feature (7)..(8): n is a, c, g, or t
nttcccnncctcctccagctgtgtttgtcggcccctcgggcctcatgttgttgctctggcaccccaggggctcaggtggagccacggccaggacaggcctcaccattggcaagggcactcaagctcccaggtggactcccaacctatccaggcactacagccaagggtaagagccctggactggggccgacctgcttccaatgacccaccgtccaacctcgccttaccttatccgtaggagccatttgacaagctcttgttgaacaaatgctacacatgaacacatgggctgtgtcctgaagcgctggaaactgagtggacggcatgggttggtctcaggatttgttccgcgccttgtggagatcgctgtcaagggaagtgaaggagcacgtgggcacggaccaattcgggaacaaatactactacatcctgcagaacaagaactggagaggacaaactattcaagagaaaagaattgtagaagcagcaaataaaaaagaagtagactatgaaacaggggatattccaacagaatgggaagcttggattagaagaacaagaaagactccacctactatggaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccgtgcctctgctccatacttcggaaaggaaaaaccctcagtggctcccagcagcactggtaaaacctttcagccaggatcctggatgccacgagatggcaagagccacaatgaatgaatgcattatggtcaaatcttttcacgtatatggatgcgactattttagcaaataaaagaagtgaaaagttaaaaaaaaaaaaagaatgtatgaacaaaagtccatacacctgagacatcaatttctttttctcatgttacagctaaattcaggagtagggtgggctccatttcctaagaagcactaaaatatcaccagaatgtaaagagagagagaaaaaaagtatattcaacaggcctcttcttaaggacgaaactgcatattttgcaaggaatacttcagtaaactacttggggtggatcaagatgcaaaagatggctgttcccttctaaggagactgagcccatttaattggaaggcttttgctttgctaagtggagtttgtaggttcaggcttggagtcagggtgctcaagatcacagagaagacacgggaccctctccacccttcccccacaccactctgaaactgccagaccaagacaccccatgtctagccattgctcccagccaattctaccaggtcatcaaggcccaaatcccaggccacctcctccaggaagccttccctgatgtctggatggaaatgtctaagtctccctccttgctctcccttctggctcttatgccagtctgtggatgcctcaggccttgcattactagagggtaaggctgtctccttcacctctctgccca

SEQ ID NO: 463453 - DNA, 759 bp, Homo sapiens
aggacgttactatacactactatagactttatgaatactctacacttaggctatagagcaaaaacaaaagcaaaatgaacaaaatcctggatatagactatcacaactctcagccacagggaagagtgggtcctgtagtaactaaaactatcaggcaggcaggcagaccaaagccaatttatttatcccactcaacagatggacataaaccaacaggtattggaaagagaccattgctcatacagcagccttgcatggcttttaagatcctgagttgtacctcctatcacaagccagggcgaaggaggcgctggctcccaaggttctgccggaaggtagccacgtcctcagccctgccaccaacccatcctagcagctggggcttctgggtggtcagccagcagtacctgcccactgtgaagattcattgctttttacacatcaacacagaatccgacctgaggcagcttgttcgccgcatctaccatgtgagagcacagagagaaaatgctatccaatggaccctcgccagacaccaaatctgccggcaccttgaccttggacttatcagcctacagaaacatgcaacacagaatatacagtttgatgtgagaaaaaacatgcaacacttctaaggaagtaaaatttaaatgcagaatgagcatctgaaaaaaattattagtttgacagattcagtacttttctgctagctgaaatcaaggacggcaagaagcagaggacatttgacaggaaaagaaa

SEQ ID NO: 463454 - DNA, 3525 bp, Homo sapiens
  misc_feature (1)..(2): n is a, c, g, or t
nnttcccaggataaccttctcatctcccctccctgttctctcctcctgctcctccttcttctacttcaacctatcctttatatctccacaccaagggaagcagacactcggatgtggacgcgtgtgctgcagccctgtgtgcatcagagtgagaccctgtctcgaagaagaagagaaaaagaagaagaagaagaagaagaagaagaagaagaagaagaagaagaagaagaagaagaagaagaagaagaagaagaggaagaagaagaagaagaaggaggaggaggaggaggaggaggaggaggaggaggagaagggaataagatgagaggaagaaggaagaagaacaagaggaagaagaagaaggaggaaaaggaggaagaggaggaggaggaaaataaggagaaggaggaattccacgtggctggggaggcctcacagccatggcggaaggtgaacggcacaccttacacggcagcaggcaagagagtcaatgagaaccaggaaaaagggaaaccccttatgaaaccatcagatcttgtgacacttatctactaccatgaaaacaaacttaccccaaataaactaaagcgtatgtctaaagacacgtacacaaaggttcgtagcaactttatctgttatagccaaatctagaaagagcccagatttcttcaatacatgaatgtttaagcaaactgaactgtagtacatctcataccatgaagtctgctcagtaattaaaaatgaacaaccactgatacatgtaacaacgtgaacaaatcaccagaaaattatccagagtggaaaaaaaatctaatcatacaagattgcatactgtgtggttacatttacatatcagttttgaaaagacagtgggaaggaagtgaagagcacatttgtggttgccaatagctagagagagagttggggagagagggaagtggactttcctatggcaggccaatatgaggaatctttataatgatggaaatattctgcatctgaactgtatcaaagtcattatccaggttgtgataacatactcttgctttgcaaaatgttaccatagggggaaacttcctaaagactaaatgggacctctattatttcacacaactgcatgtgaatctacaattatttcaaataaaaagttcaatttaaaatgtcattcaacttcactttacctccataatattttatggctgcttatccagataaactttatattcaactcttttaactctagcaacaacaacaacaacaaaatgtggctagaaaaccagtcatttaaattattattcctctttataaaatacattatttctctctgcctacatatgagatatttttggtcttgtcatattatcccacaagttctttgggtttgcctatattttccaatctttttatctttctgatgttcagaataaataatttccattgatctatttttaagtcaatttctctttctagtctcacctccattgtagtgtggactccatgctatgaactttttctaaaaattggttattgaagaccttagttctaaaatttatgtttgattcttctttagatattctacttctttgctgatacgtaaactttctatttgtttccagagtgttcatcttacttcttaaagcatgattatagaggctgctttgaagtctttgtgttataattccaacagctggttcttgggcttagtttctgatcatttttttccttgttaggtaagttggtttgttttgtttccctggtgctttgtatgctacagcatttttggattctattacggacgttttcaacattcccttttgagactctgggtattttatggcctaaggagaatggtgatttttgttcatttgttttttaacaagaagccaaccagattatgttcaagccttaagtttcaatctgccttccatggattgtagttctaacgtcagtttagtttttgagtttctgtatgctgttcagatcaatcccacatgcatgtccattatggggcctgggcagtggttggcctcactcatcactctgttctcaaaggctacggtttgcttctcaggtcagatctccacatacacagcttagaagtgaggctcagatttcatgcacaattttatgtgctcaccctctcactctgccttttctcatcatctcactaacaccttccagctctctgcagcttcccttcctggtcctggacagaaagtcaggactttagcatcctggccctgccacacacttgctgtgactacttctttgtctgcacccaagcaccaggaggatggaaaaggaacaaaatagtggggagtcagcacatgctcatggttgagggtctcagctcctccaaccagagagaaaagcccaaagtcctctctcggggtcacaggtgcctgatggactgccttccatccccatgctgccatggtctcctctgctgtatggcccaacggctgagcattaagataaggaagaaagacaaagagtggggtttcctcccacacagtctgatactcagatgtcccctttcccactcctcagaacagaacgtgacagctccttttggagtttcttctctttgttatcagtgtgcatttacagtcatgggccccctttgccttgaggccaggtgatactagaagaaaaaaaaatgataaactctctagcagtctggtagaacatttaattctagactttttcaccagtccacatgctactgtctacttttcagaccctctgatgctattctgagcactcaagatgtgcagttgtgtgagacgcacagggtgcagcatgttctctccatcttgcctggaaccacgtccagagaggtacaggttgaatttccatttctgttctcatgagaatggttgaacattatttctcattattagtggttatttgcatttatcttctgtgttcatagctccagctcatttatctgagggtattcaatctttttcttcattatttaaaaataatttctgcatattaaggataactaatcataatctataataaaccatacatacgcccagtttgttatgcatcattttactttacttatggtatttttgccctgcaaaggtgttttcattttatatatagtcaagataatcctccaggtttcagccaaactcatcatatttttccagtacttactgtttgggttttttttacatttatcaaattggaatttatccttatatatggtgtgggaagtggccccgatattatcttttcatatcattaccgagttactgagtactgctcatcaaatatttcttctgctgttagaaatgttgtcctttactgcatactaaactttcacatgtaattgtgtctatttctggattttctattttctgccattagtctctcttttcatgcactgacaccttactgttataattatagaggacttatgtgatttttaaatatctgacaagttaaccttccactcattgcacctttatttaaagcttttctctggctatctttgcttgtttttctgcc

SEQ ID NO: 463455 - DNA, 1785 bp, Homo sapiens
gagaaatgaatatagtccttcaggaagattaatctgacaagcaggacaaaggatggcttgtaggaaatgggaggctgaagacaggctagtcacgggccaatgggttgttgttactgaaaaggatgggaaacaggaatctactatttttgatgctgtaatgatttgttcaggacatcacgtataccccaatctgccaacggattcctttcctggcctggaccagtttcgaggcaactacctccatagccgggattataagaatccagaagccttcaaggggaagagggtcctcgtgattggtctggggaattcgggatctgacattgctgttgagctcagccgtctggctacacagccaaggcacagaggatggtacttctatgtcacaccacaagagatccacctcttctatgtggcccttcaaatcaaggaggacttgagacatcctccatgtgaagccagttccctgagaaaagagcctgtgttcaatgatgagctcccatcccgcatcctgtgtggcactctgtccatcaagcccagtgtgaaggagttcacggaaacctcagctgtgtttgaggatgggaccatgtttgaggctatcgactctgtcatctttgcaacaggctatgattattcctaccccttccttgatgagaccatcatgaaaagcagaaacaatgaggttaccttgtttaaaggcatcttccccccactaatggagaagccaaccttggctgtgattggcttggttcagtcccttggagctgccatccccacagcagacctgcaagcctggtgggctgctaaagtatttgcaaactcatgtaccctgccaaccacgaatgaaatgatggatgacactgatgagaaaatggggaaaaaactcaagtgatccccgcctggccctggaggtgtactttggcccttgcagcccataccagtttcgactgatgggaccagggaagtgggatggggccagaaatgccatcctgacccagtggaaccggacagtgaagccaaccaggacaagagttgtcagtgaagttcagcgaccccatcccttttacaatttgcttaaaatgctttcattcccattactccttctggctgttacacttacattttattaatgagaaagtctttgaggtctcaaaattcagcatagaagtgtaatcacacaatacaacacacacacacacacacatacacacacacaatcacaacatagttcctctctcctttcctgaagatatgaaaatcagtcttggcccatttgaattaaagtataagtaaaatggaaaatactcagcctctctctctctgttgggaatctgttctctaaaaggcttttcacatgctgaattggcaaatttggggatgcttaagataagacaggaagttgaataagcatgagcacagattttcaggctgaacaaagtttaacaaaatgtaaaggcattttattttgtccattatagtatattaaccaatgtatttttcatattaactgaagttattgacattaaatcaacatagagagataagtttataccaatacaacaacgaagataaaatgaacacattgcttgaaagatacatactgccaaagctctcccaagaagaagcatataacctgaatagacctaaatctattaaagtacttgaatttgtagtttaaaaactcttccacaaagaacaggccaagaaccaggtcttcactggttaattctgtcaaacatttgagaaagcaatataccaactatatgcaaaattttccagaagatt

SEQ ID NO: 463456 - DNA, 2284 bp, Homo sapiens
gataggaaaatttaaaatgctaaaggaaaaattttcttagcaatttcacaggaaaacctaagttttaagagaggttatcattctgactgggaactgaactattatgactaggtctataatttaataacaagtcacaatatctctctttcttgacatcaatttaaggtgacttttcacatagtagagagaatggcttcagttatacctgcctccaataggtccatgagatctgacaggaatacatatgttggaaaaaggtttgttcacgttaaaaatccttacttggatttgatggatgaagacattctctatcacttggatttgggaacaaaaacacacaacctaccagcaatgtttggagatgtaaagtttgtctgtgtcggtgggagccccaacagaatgaaagcatttgcactgtttatgcacaaggagctcgggtttgaggaagctgaagaagacataaaagacatctgtgctgggacagacagatactgtatgtacaaaaccgggcctgtgctcgccatcagtcacggcatgggcatcccctccatttctattatgcttcatgaactcatcaaattactccaccatgcacggtgctgcgatgtcaccattattagaatcggtacatcagggggaatagggattgcaccagggactgttgtaataacggatatagctgtagactccttctttaagccccggtttgaacaggtcattttggacaacattgtcacccgaagtactgaactggacaaagaactgtctgaagaactgttcaactgtagcaaagaaatccccaacttcccaaccctcgttggacatacaatgtgtacctatgatttttatgaaggccaaggccgactagatggagcactgtgctccttttccagagaaaaaaagttagactacttgaagagagcatttaaagctggtgtcaggaatattgaaatggaatctacagtgtttgcagctatgtgtggactctgtggtctaaaagggcagaagcagggagaagaacgagaaggcgaacgcagtagtctagtgagagttgatggacaaagtgatagcagcgcaggatgttgcagaaacctaagtgaagttattctaagagcctttctgtccttgctgcaaatctttgtaaccttgctctctctgctacctgcaggtttccctcctggatgctttcttctctacatttctgtagttactgccctccactgcattttctttcttatgctgctgctggacctgctggtagctgatttccgcctgcaaatagctctcccccaggccactgctgcagcctttcatggagtagaccccttctaggctgccaacattcacactaaaagttgcatctgcagctctgtagttcttgggagtatttctatctgaatgtcttcatggtgccagcggctctttatctccctcagatttactgttctaaaaggtggattcctggtatgctgtcccctggaagatcagccaccaagtatagagaccgaaaaccccatggatagggtgctatcatattctcttctttcattactacttcataacatcctgttcccgtaacactgaagcttggaagctggcatctggcaccttttgattttaacccatttataacgcactttgtgtgagccagaaaagcttgcttggggaagggctgagaatgcattcatggacagctgctgaaacagaggaagttagagaggacatctgatgctgctgtggtctgtgtgacacttctcgacagactcgactgtgatcagatcaacttgcctcatgatgtcctggtggagtaccagcaacggcctcagctcctaatctccaacttcatcagacggcggcttggactttgtgactagacgtcctaactgggcagcccaaccctcccctgcaagtttgtagctcaagttgtaatgtgaaagtcatattttatttgtggcatttttatatagttctcatccacatgctaaatggaaagactttatgaaatccttctctcttaaaaaggaatttattgtaaaagaatactcacactaaattaaattcaaatttcattttagaataagttaactaaatcagtctaataattaaaattttaaaactcctggattatgacatttggagtttcatatgcagcattaattaagctcacatcaaaatagaccagccatttgcacatagttaccagtcactctgtttctgaaaccaatccagaaattcatgttagaacattgtcaggcacttctaggtattggacaagtgacagaaa

SEQ ID NO: 463457 - DNA, 1584 bp, Homo sapiens
agcgggccgcgcggcacgggtgagtgcccaggacttcaccagtgctgccatgctggccccaggctgtgagttggacccagaccaagaagtggtgaggacaaggcctgaagatgtgcctgcttccccttcaacttccaccatgattgtaagtgtcctgaggcctcccagccatgcttcctgtacagcctgtggaactgtgacttttcacatagtagagagaatggcttcagttatacctgcctccaataggtccatgagatctgacaggaatacatatgttggaaaaaggtttgttcacgttaaaaatccttacttggatttgatggatgaagacattctctatcacttggatttgggaacaaaaacacacaacctaccagcaatgtttggagatgtaaagtttgtctgtgtcggtgggagccccaacagaatgaaagcatttgcactgtttatgcacaaggagctcgggtttgaggaagctgaagaagacataaaagacatctgtgctgggacagacagatactgtatgtacaaaaccgggcctgtgctcgccatcagtcacggcatgggcatcccctccatttctattatgcttcatgaactcatcaaattactccaccatgcacggtgctgcgatgtcaccattattagaatcggtacatcagggggaatagggattgcaccagggactgttgtaataacggatatagctgtagactccttctttaagccccggtttgaacaggtcattttggacaacattgtcacccgaagtactgaactggacaaagaactgtctgaagaactgttcaactgtagcaaagaaatccccaacttcccaaccctcgttggacatacaatgtgtacctatgatttttatgaaggccaaggccgactagatggagcactgtgctccttttccagagaaaaaaagttagactacttgaagagagcatttaaagctggtgtcaggaatattgaaatggaatctacagtgtttgcagctatgtgtggactctgtggtctaaaagctgctgtggtctgtgtgacacttctcgacagactcgactgtgatcagatcaacttgcctcatgatgtcctggtggagtaccagcaacggcctcagctcctaatctccaacttcatcagacggcggcttggactttgtgactagacgtcctaactgggcagcccaaccctcccctgcaagtttgtagctcaagttgtaatgtgaaagtcatattttatttgtggcatttttatatagttctcatccacatgctaaatggaaagactttatgaaatccttctctcttaaaaaggaatttattgtaaaagaatactcacactaaattaaattcaaatttcattttagaataagttaactaaatcagtctaataattaaaattttaaaactcctggattatgacatttggagtttcatatgcagcattaattaagctcacatcaaaatagaccagccatttgcacatagttaccagtcactctgtttctgaaaccaatccagaaattcatgttagaacattgtcaggcacttctaggtattggacaagtgacagaaa

SEQ ID NO: 463458 - DNA, 282 bp, Homo sapiens
acctccttgaataatatcaacatttattttgattttgtgattttctttacaaatttagtgcaaaaaactttgcatctgttgctttatttacaggttgatgatgcaaattagctaattcatggaacataaaccatgacatctacacgtgttcttaagtaaattaactaaaaagtaaaataaaaacattagagttgaaactgacccgtggttcttatcccagttactatggcaggcccttgtttatttttattaacagtttgtctgtgtcggtgggagccccaa

SEQ ID NO: 463459 - DNA, 450 bp, Homo sapiens
ggacttcaccagtgctgccatgctggccccaggctgtgagttggacccagaccaagaagtggtgaggacaaggcctgaaggttagtgagggaagaggagaaatacattcatgtctaagcacatgtgtctggtcatattccaagtctcagtacaaattaattttgaattatgtggttgatgttttccacatttcagcttccatcaactggcacaaataattaagggatgatgcaacacatattggtacaatttctcaacttttttagagctaggcccactgaaattcaggtagctactacagacgatggaagaggttattttagaaaaacatgctatgtgaacagccctacactggtgccttattttcaatcacctttttaaaccatgaattcataatactctttaaggtagttgaccactctaacgatccctttaatacataatttttaa

SEQ ID NO: 463460 - DNA, 2315 bp, Homo sapiens
agcgggccgcgcggcacgggtgagtgcccaggacttcaccagtgctgccatgctggccccaggctgtgagttggacccagaccaagaagtggtgaggacaaggcctgaagatgtgcctgcttccccttcaacttccaccatgattgtaagtgtcctgaggcctcccagccatgcttcctgtacagcctgtggaactgtgacttttcacatagtagagagaatggcttcagttatacctgcctccaataggtccatgagatctgacaggaatacatatgttggaaaaaggtttgttcacgttaaaaatccttacttggatttgatggatgaagacattctctatcacttggatttgggaacaaaaacacacaacctaccagcaatgtttggagatgtaaagtttgtctgtgtcggtgggagccccaacagaatgaaagcatttgcactgtttatgcacaaggagctcgggtttgaggaagctgaagaagacataaaagacatctgtgctgggacagacagatactgtatgtacaaaaccgggcctgtgctcgccatcagtcacggcatgggcatcccctccatttctattatgcttcatgaactcatcaaattactccaccatgcacggtgctgcgatgtcaccattattagaatcggtacatcagggggaatagggattgcaccagggactgttgtaataacggatatagctgtagactccttctttaagccccggtttgaacaggtcattttggacaacattgtcacccgaagtactgaactggacaaagaactgtctgaagaactgttcaactgtagcaaagaaatccccaacttcccaaccctcgttggacatacaatgtgtacctatgatttttatgaaggccaaggccgactagatggagcactgtgctccttttccagagaaaaaaagttagactacttgaagagagcatttaaagctggtgtcaggaatattgaaatggaatctacagtgtttgcagctatgtgtggactctgtggtctaaaagggcagaagcagggagaagaacgagaaggcgaacgcagtagtctagtgagagttgatggacaaagtgatagcagcgcaggatgttgcagaaacctaagtgaagttattctaagagcctttctgtccttgctgcaaatctttgtaaccttgctctctctgctacctgcaggtttccctcctggatgctttcttctctacatttctgtagttactgccctccactgcattttctttcttatgctgctgctggacctgctggtagctgatttccgcctgcaaatagctctcccccaggccactgctgcagcctttcatggagtagaccccttctaggctgccaacattcacactaaaagttgcatctgcagctctgtagttcttgggagtatttctatctgaatgtcttcatggtgccagcggctctttatctccctcagatttactgttctaaaaggtggattcctggtatgctgtcccctggaagatcagccaccaagtatagagaccgaaaaccccatggatagggtgctatcatattctcttctttcattactacttcataacatcctgttcccgtaacactgaagcttggaagctggcatctggcaccttttgattttaacccatttataacgcactttgtgtgagccagaaaagcttgcttggggaagggctgagaatgcattcatggacagctgctgaaacagaggaagttagagaggacatctgatgctgctgtggtctgtgtgacacttctcgacagactcgactgtgatcagatcaacttgcctcatgatgtcctggtggagtaccagcaacggcctcagctcctaatctccaacttcatcagacggcggcttggactttgtgactagacgtcctaactgggcagcccaaccctcccctgcaagtttgtagctcaagttgtaatgtgaaagtcatattttatttgtggcatttttatatagttctcatccacatgctaaatggaaagactttatgaaatccttctctcttaaaaaggaatttattgtaaaagaatactcacactaaattaaattcaaatttcattttagaataagttaactaaatcagtctaataattaaaattttaaaactcctggattatgacatttggagtttcatatgcagcattaattaagctcacatcaaaatagaccagccatttgcacatagttaccagtcactctgtttctgaaaccaatccagaaattcatgttagaacattgtcaggcacttctaggtattggacaagtgacagaaa

SEQ ID NO: 463461 - DNA, 1134 bp, Homo sapiens
ctgcctagaggaggagaaggtacacagagcagtgacatttgctccagctctagaagagcacctctgagatttcctggctgacacatcgcatctccctctggccacagccaagcaacaccagatgtctgcagtagcagtaacactttggattcctgatggaaaactccaagacgagcctctgtgaaatacctgcttcattttggcttcattttcatgcctcattatctgacccatttacttcttacctcagggcacagaccacggctgtgacactccgtaaaatcctgtgggatggggaagagtgaaaatgacacaccggtggggcaaggtggctcatgcctgtaatcctagcactttgggaggccgaggcgagtggattacctgagatcaggagttcgagaccagcctggccaacatggtgaaaccctgtctctactaaaaatacaaaaattagccaggcgtggtagtgggggtggccttctccgctcctcctcctcctctctggaggtggtttcatcacagactgtaaaggttctgtaaaaaataatctagtccgtctgcctgaagcagttctccccctgcaccagtgactcctgctatggtatactggggaattgtcatgctcttccctaagctttcctgccatcccaatcaaccagctaacaccacaggatccagtctgatttttaatgtctgtgaccccaagtgccagtgtgggctctctgcaaggctatggctggaccaggcacactacaagcagtttccacagctggcaccagggaacatgtggtgcctggaagcttggagatgccaagaaccacagggccccaaagagggagtcacagccctggcttggggagctcccaggtctgggctccccgaagggccacagctctctctcctcttcacctgcaacgtggtgagcaagacacatctcagccctgtttgtgttacagctgttttagccctgccatttgatgggtcctggttcttgtcctgtgaccagaaagaatgaggtacacagaaaagtggagagtgaacaagacaaaggggagctttgagtgatagaacagctctgaggagacccacggtcctctccacagccagggtgtcctgacaagtgttcagtttttc

SEQ ID NO: 463462 - DNA, 4645 bp, Homo sapiens
cctcttaaaccaattaataacactcaagtgtggctaaaagtcttgaaagaaagtgagggagtatgccatttggatttcagagagaagacaattctaggaggaaggaattacctatgcaaagacctggaggcactggggaacgcagtggcacccgggagcttggagattccaggaaccacagaacctcaaagagggtatctcagtcttggctcagggagctcctaggtctgggctccctgaaggactgcagctcttctctttccttcttgtcaccagcaatgtgggctggcaccgggagcagggaaaggccagacagtggaagcaggcactttcaagcctgtgagggaagggagcttcctgggcccctgagagcagagggatgctggggtctgcagctgcagctgacaggctgcagctgtgcccaggagtgtgggctcctgccccaccaactcggtaggggcagggctccctctggccttgtggattgtgcagccccagctgtgcctcccctgctgcagctggcatcctcacagtggctgctccacacgggcttgtctgtatttatgttgaaagtccaggtgaatgacatcatcagtcgtcagtacctgagccaagcagttgtagaagtgtttgtaaactacacgaagacaaattccacagtaactaaaagcaatggagcagtgctgataaaagtaccctacaaattaggacttagtttaactattattgcttacaaagatggctacgtgttgacccctctgccttggaaaaccagaagaatgccaaatgccaagtctcaaccaagtgttcagttttcaaaagccttaattaaacttcctgacaaccatcatattagcaacgttactggctatcttacagttctacaacagtttttgaaagtggacaattttctgcatacaactggaattactctcaataaaccaggttttgaaaacattgaattgactcctcttgctgcaatatgtgtgaaaatatattctggaggaaaagaactaaaggtcaatggctctattcaagtttctcttcctcttctacgtctgaatgatataagtgcaggggatcgcatacctgcttggacatttgatatgaacacaggtgcttgggtaaatcatggtcggggaatggtcaaggaacataacaatcatttaatctggacatatgatgcaccacatttggggtactggatagcagctccacttccaggaactagaggttcaggtataaatgaagattccaaggacataactgcctaccacacagtgtttcttacagccatattaggaggaacaatagtcattgtcattggattttttgctgtactactttgttattgcagggacaagtgtggtactccacagaaaagagaaagaaatatcactaaacttgaggtcctcaagagagaccagacaacttcaacaacacacataaatcatatcagtacagttaaagttgcattaaaagctgaggacaagtcgcagttattcaatgccaaaaactcctcatatagtcctcagaaaaaggaaccatcaaaggcagaaacagaagaaagagtttccatggtaaaaactcgggacgattttaaaatctacaatgaagatgtttcatttctatcagtcaatcaaaataattactcaagaaacccaacacagtctttggagcccaatgtagggtccaaacaacctaaacatattaacaacaatctatcttcatctctaggtgatgctcaagatgaaaagaggtatctcacaggtaatgaggaggcgtatgggcgttcccatattcctgaacagcttatgcatatttacagccaacccattgccatccttcaaacatctgaccttttctccacaccggaacaattacatactgctaagtcagctactttgccaagaaagggacagttagtctatggccaattgatggaaccagtaaatcgagagaactttacgcagaccttgcccaaaatgccaattcattctcatgcacagcccccagatgccagggaagaggatatcatacttgaaggtcaacagagcctgccatcccaggcttcagattggagccgatactcaagcagcttactggaatccgtctctgttcctggaacactaaatgaggctgttgtaatgactccattttcatcggaacttcaaggaatttcagaacagaccctcctggagctgtccaaaggaaagccctccccgcatcccagagcctggtttgtgtctcttgatggaaagccagttgcacaagtgaggcactcctttatagacctgaaaaagggcaagagaacccagagcaatgacaccagtctggactctggggtggacatgaatgagcttcactcaagtagaaagctcgagagggagaaaacattcatcaaaagcatgcatcagcccaagatcctttacttagaagatttagacctaagcagcagtgagagtggaaccaccgtctgttcccctgaggacccagctttaaggcacatcctagatggagggagtggagtgatcatggagcaccctggagaagagtcgccaggaaggaaaagcactgttgaagattttgaagctaatacatcccccactaaaagaaggggcagaccaccactagccaaaagagatagcaagactaacatctggaagaagcgagaggaacgcccactgattcccataaattaactccaatggggattgtgtgtctgctgtctcgtgctgtttattcttgcttcttgttgtaaattgcagtacgaacttaagaaaatgagactgagcaatctcatggttcttggacatgtctcaagcagagtaaatggtaattcagtaatcagagagaaagataccaaggaatgctttttctggcctattcatttatttttgggtgatgaatttacagtatctaagttttcaaaatgtaaaatagcttcaagatgttagttatctgaaaatgttgctcagccagccagtttggccttgactctcttaagaataacagtgaaatatatactcctcaagttgcctccaaaaatgttgcctctaccatggtgactaccccatggaacatttagaaacaaaactgacttcaggcatcatattattttaaatgttactattacgtcttcttctgcctatacttaaaaataacttgataaatgacttggactgatgttactctggagttatcacaaagaaaatgttgtttggtctttaaagagcatgtgtattgtatcatcccaaacttttgaatttgtttgctccatcaaaataaatattctttctttgacttgtctttatcttttcattttgagcttcagtttatttggggactagatttctgcctattaagatttttaaaacataacatcttcagagtttgactagaagaaaatagtctagaagtcaaccataatttgccatattaaatgctgaaagctaataatctcaatgacaaatgatggaaaaacattttcatcaagtatataatggttgactgggggtttcataattcatatgttgactagttctaatccttgtagaccttattaaaacactagactaactgcagacagtctgattcaaaacaaataagacaattacattcccaagagtctctggacttattacacttgaacagcttagttagaaactttttctaaatgggggctatccggaaagggtaatagtggctattaagcaatgtagagtaaatatctcagaatttttattttacatatttccatatttcaatccaataatgtagattcttttgtttttcatagaaaaatactttaaaaaattcagcttaaaaaattagcttatcagtatccaaaattttataataaagactatttcaaaaccctgatttctgatttagataatttctgaaaggtttgtgtccataaaatacaaaaaaggataattattaacatacttttgcagatattttctcattgttacttttaaaaatttagtatttctgatttttaaaagagttgcttgtcattattccatgtattatttaacaaaacactattgatgtgaatattgaccattgaagaggttgttaatgacaagtagatgagatctataattaaggagtttaccaattatttctaaggagtgcttatacttataaaaggaagggaaaaattatttctctgaataagtttttttccttaatgtttaaataaaatgacaagaaaagaatcttgaaagtgaatttcatgctaacaatctttaacacatacctgttttctgaaactctggtttctcaaaaagtaatgcttgccactgttctattattttcttttttcacaatgagacataagagcaagctgtaatgaatcagtgataagagaattgtacttactcttcttgaaattgggacctgtctttcctgccttttttttttttaagtgaagatgagatttgatactattaaaattagccttagtaagaaattaatctgaatcaggaaattttgaaaattccatctgccccaagatgagctcatttcacttctaaagaaaatactgcctgattgcatgtacaaaattgttatgttgatatcttatgtttgtcttcttagaccataagatccttatggacagaaaccatgctttaca

SEQ ID NO: 463463 - DNA, 2808 bp, Homo sapiens
gagtgggtggaatgagcccagcaggtctaagcaaaactgaggcagaggcactaccagccacagaggtttccagccagaaaaacgaccctgacaaggaccccataataagagctgtacagggtgaaattgttgttattggtgctacaaacagacttgactctatagatcctgcactcaggagacctggtcgttttgacagagaattcctcttcaacctgcctgatcaaaaggcaagaaaacacatcttacagatccataccagggactggaatccaaaattgtcagatgcatttttaggtgaattggctgaaaaatgtgttggctactgtggagccgatatcaaggccctgtgcactgaagccgccctgattgcactgcggaggcgttatccccagatctatgctagcagtcataaactgcagctggatgtttcctcaatagtgcttagtgcccaagatttttaccatgcaatgcagaatatcgtgcctgcttcccaacgtgctgtgatgtcttcagggcatgcactatcccccatcataagaccactgctggaaagaagcttcaacaacatcctagcagtcttgcaaaaagtgtttcctcatgctgaaattagccagagtgacaaaaaagaagatgacgtgtggaagtgtccattgtgttcacctgacttgagattgggaagtatagccttgttaaagctttgctaaacaggacttcttcttatgacttcaaccacatcctgtggtagatgtcacattatggggctcaaaaagtcatagaaaaaagtcttcagttctcctctgttttagtcacactctttgtgctatggaagtgcttcctcttgcactaccttctccacctcgtcaattatcagaatcagaaaaaagtcgaatggaggaccaggaggaaaatactttaagagagttgcggttgtttctcagggatgtaaccaagaggctggccacagataaacgctttaacatcttcagcaaaccggtggatattgaagaggtcttgtttcagtagtgtgcaaacagtgaagttgaactggctaaaagaaaaaaatattgacatctttttttggaaggaaaaaaaagcaaaggcatggatgaatattacccctagcctataaaattttaatccatgtgataactaccgatgtcatcagcaaacatctggtgacttttggatgaaattagcgaccaatttatattggcctcttaattattattaacctttgtggtctcttactcttcgatttaagaggattaaaggttgccttagtcaaatatccatactagattatttttattccaggataaattctgctgtcaaagagtatattggtattaaccaatcaataccagttaatactggcatttcccaaattatgtatacctcatcaaaagaggtagctaaaaacctgaaatttctttgtctttcatattttggaaatgcctgtggctgggatgctgtttgaagttaaaacatatcccgtgcaactaaattatttttctttctaaggattttctctgctcccagtggaaaatttctcactttatatgtgtattattttgtgtgcttgtgggagcatggtttgtgatgatgagaaaagaaattttccatttgggaatctaatactatcaactacatttttggtttttgttttatcctgggataatgtagtgtgtggatgaacacaatgtaatctttactggcctctttcttatagttcagactccatgtttgaacagctttggtgtttttagtttttattcatttctttttttaaaaaaatgaattatgggtgattcagggtttaatgttgtatcctaattgtgaaatctgtgcttttggacctgagcagatacctttgaaaccattacctcatctgttactaggaagaatgagctagcatttacattcctcccccctggcaagtctgaaaagaaatactttcccccctttttggaatgaagagactatctataattttatttgtacctttatccacaatacactgttttttccatttgatcctcttatcaaccttgtaggatcattattattattcttactttgcagttgaggaaacagacttgttggcaagtgacatagccaagacttgaaagttttttaaaattcaaagcccacattcattatcatagctactttatatctttccactgggataacaggacatgcctaattggctttttaaattaataaatatcagtttatattgctgggtcatccccccccccatagtgtttttaaataattttaaaactatcagccgattaaaaaattattttaaataaatgtgatatgtgtgtgtgccctttcttccactcccctatttggtatatttggactctaacacttcttaaaggataggggcttgcccccaactcaacttcccatgctgagagtaaaccaattttgcttttgctcaggaaaactcttttctttctaatcaaagaagatttgtcagattttcaaatgccatctgtaatagttttataaatgacggtaaggggatagaaaatgttggtcagataaatattttatttagggttgtatttctcttcttttctcctttatctttcttcttaggttcgttctgctcttaagctgagaacataggagtctctgggaaggatagagaggggaaaacaagataacctaaaacaaaagtttttatttaactaatgaatttaaaatgtctgaaaactttatcaaattccaaagcagactgcagagaaagcaaaactttagaaaataaatgttaaatttaaaattaagcat

SEQ ID NO: 463464 - DNA, 4580 bp, Homo sapiens
tgtcgtctccagaggatcccgaggtgacaaaaaaagagatatagaaactttaattttagaggatagtgaagatgaaaatgctttatcaatttttgagaccaattgtcactcaggatcaccaaagaaacagtcatcatctgctgctatacataaaccctaccttcattttacaatgtcaccatatcatcagccaacctcttacaggccacgcttattgctctctggagaacggggctcaggtcaaacttctcaccttgctccagcacttttgcacactctagaaagattctctgtgcatagactagatctcccagcactttattcagttagtgccaaaacacctgaggaatcatgtgcacagatttttcgtgaagctcgaagaacagtacctagtattgtttacatgcctcacattggggattggtgggaagctgtcagtgaaactgtgagagcaacttttctgacattgctacaagatataccatcattttcacctatatttttattgtctacctctgaaaccatgtacagtgaactgcctgaagaggttaaatgtatctttagaatacagtatgaagaggtcttgtatattcaaaggcctattgaagaagacagaagaaaattttttcaagaattgattctcaatcaggcatcaatggctccaccacgaaggaaacatgctgctctttgtgctatggaagtgcttcctcttgcactaccttctccacctcgtcaattatcagaatcagaaaaaagtcgaatggaggaccaggaggaaaatactttaagagagttgcggttgtttctcagggatgtaaccaagaggctggccacagataaacgctttaacatcttcagcaaaccggtggatagtttcagattatcttgaagtaatcaaggaaccaatggacttatcaacagtaataactaaaattgataaacataattacctgactgcaaaggatttcctgaaagatattgacctcatctgtagcaatgctttagagtataatccagataaggacccaggagataaaataattaggcacagggcttgtaccctgaaggacactgcacatgctatcattgcagctgaattagatccagaatttaataaactttgtgaggaaattaaggaagcaagaataaaaagaggcttatcagtaacatcagaacaaataaatcctcatagtactggagctcggaagacagaaactagagtcgaagaggcatttcggcacaaacaaagaaatccaatggatgtgtggcacaactctgcaaataaatgtgcatttcgggttcggagaaaatcaaggcggagatcacagtggggtaaaggaattattaagaaaaggaaagttaataatttaaaaaaagatgaagaagacaccaaatttgcagactatgagaaccatacggaggacaggaaattattagagaatggagagtttgaggtaagcactgactgccatgaggaaaatggagaagagactggagacttatctatgaccaatgatgaatcatcctgtgacatcatggacttggaccaggggcagaggcttaacaatggagcaggcacaaaagagaactttgcatctactgaggaggaaagttcaaatgaatctctactggtcaacagcagcagttccttaaacccggagcagacctccaggaaagagactttccttaaaggaaattgtctaaatggtgaggcttccactgacagttttgaaggaataccagttctggaatgtcagaatggcaagcttgaagtagtttctttctgtgatagtggagataaatgtagttctgaacaaaagattcttctggaggaccagtcaaaagaaaaaccagaaacttcgactgaaaatcatggagatgatcttgagaaactagaggcactggaatgtagcaataatgagaagttagaacctggctctgatgtggaggttaaagatgcagaactggataaagaaggtgcttctaaagtaaagaaataccgtaaattaattttagagcaggcaaaaacgacaagcctggaactggttccagaagagccatctgagcctgtgcctcctcttatagttgatcgtgagagattgaagaaattgcttgatttgttggtggataaaagcaacaatctggcagttgatcagcttgagagattatattctcttcttagtcagtgtatctaccgtcatcgtaaagattatgacaaatcacaacttgtagaggagatggaaagaacagttcatatgtttgagacattcctatgaacttttcaagatgagtggtttatcctctccaatctgctcctcacagagcagtcttctgagccattcaatttcaaattgcaccaattatgtgcagagccttggtgtaaagtgctctctcactcattctttctctctgttgaatttggtgctattgtctcaggtacctgaaaccaaccagcctacaagaaccaaacagaacttcagaaacatgttgtattttccacaaataaaaaatacaaccccacagcttggagattttggtgctacagaaactgctctcgcttctgctcctctttttgtgcactctcttttggagactcctctcttagggagcagaccagcaaacaggaggaaactggatgggggcagttctaactgtgttgaattgtttaaacagtgggcaacttgttatttttttttcctccattttacccctttaatcatatttttcccccatctgggtaatggactgaaacctgttttagagttggctatggtctgttctggtgggaagctgaagaaactggatgaaattaggtcaggctctttagaactgcctttaacgtgcctttttattcatttgaggaagataaggctaaaaggatgggctgtttgaagcaaataaattagaaatatttctttggtcacaaccttgaaaataagttttgatactctatgtcattaagagacaaccagtgtttgggtatgaaatgcctgtcttattctcaaagctcaatcaagacacccagtaagccacataatatactaaaatggtaagttttcttgtaaggtctgttttggtttaagaaacatgaataacaacaaagaataatacacagtccacacacaaaaaaacaaaaaacaaaactgcacacgttttggtattgccaacaatgatgactagaaaataaatagatagtggccattttttcttctgtcagtggcaatttaatagttattcatgtttgagttcccagagaaaaatggttttcatatgtagtaaattgttgttttgttttaaagccaggacttgccaaatggacagaaaagagaggaattcatcagaagctccataaaattcattttctgtatgcttaattgcaaacgagctctggtatggtccttgaataacagtattaatgtttaaatcccatctcctaagcttaccttcacaactcttctttttgattggaaaccattttgaatcttgttgagtgatttctgtgaattgtatgtatctgaaattaattatgggttactagttttacaaaaactttctacaaatttggagacacagtctaggcagttgcaatgaggcaaaggatgcagtgactttttttatcagatgatttttaaacaaaaagaaaattttgccagcaagttggcttggtatcttcattcattgtagccgttagctgcaggtgtgtctttccaatatatgcaacacatgtagtttgggttttaattagggcgaatggtcttggactactgcagagattctgagctacctcagctttttgtattttagttaccaacagtgtttacagagtcttgtaatcactttgccaccgtttacatcctgaagctaaggtacttgtctccttgtctttggctctttgtagtgtgcagaaagcatactttggccatagcctactgcagtaatccaaagtgcttctttgcatttacatttacatctaacgccttctaattctagcttaatttttttttaaatgccacgtgttttctttgtacctagtctgtgaagtttctgtaatatccagttagtcatacaagtcaagatgctacccatgtagacacactgtatttttaaggtgggcaagtgcgattaacgatgaaccattttaaaggggaggttatttgaaacctctaatttgattattgggaggattttcatgctttctttagtatttattaccatcataccgattcaaactattttattgtctaatacattagcattttgtattttgatggaaattgttacagaatttaaagatttgatgaaataagatgtagcagattttttgtagcaagtttctggtaaaagggttttttgcaagtctcaggttcttgctgcactatttttttttaaatatttattccagttattctaattcagaagcattcttttcaagtaacagcagcacttgtgaaaggaaaaaaaaatgcacatgtttcttagtaggttactaaatttgtacaattaattaagattttagccatcagtgagtttgaaaagggaaatgtatttattttcagcattaaaatgcttccaaaagatca

SEQ ID NO: 463465 - DNA, 6080 bp, Homo sapiens
tgtcgtctccagaggatcccgaggtgacaaaaaaagagatatagaaactttaattttagaggatagtgaagatgaaaatgctttatcaatttttgagaccaattgtcactcaggatcaccaaagaaacagtcatcatctgctgctatacataaaccctaccttcattttacaatgtcaccatatcatcagccaacctcttacaggccacgcttattgctctctggagaacggggctcaggtcaaacttctcaccttgctccagcacttttgcacactctagaaagattctctgtgcatagactagatctcccagcactttattcagttagtgccaaaacacctgaggaatcatgtgcacagatttttcgtgaagctcgaagaacagtacctagtattgtttacatgcctcacattggggattggtgggaagctgtcagtgaaactgtgagagcaacttttctgacattgctacaagatataccatcattttcacctatatttttattgtctacctctgaaaccatgtacagtgaactgcctgaagaggttaaatgtatctttagaatacagtatgaagaggtcttgtatattcaaaggcctattgaagaagacagaagaaaattttttcaagaattgattctcaatcaggcatcaatggctccaccacgaaggaaacatgctgctctttgtgctatggaagtgcttcctcttgcactaccttctccacctcgtcaattatcagaatcagaaaaaagtcgaatggaggaccaggaggaaaatactttaagagagttgcggttgtttctcagggatgtaaccaagaggctggccacagataaacgctttaacatcttcagcaaaccggtggatagtttcagattatcttgaagtaatcaaggaaccaatggacttatcaacagtaataactaaaattgataaacataattacctgactgcaaaggatttcctgaaagatattgacctcatctgtagcaatgctttagagtataatccagataaggacccaggagataaaataattaggcacagggcttgtaccctgaaggacactgcacatgctatcattgcagctgaattagatccagaatttaataaactttgtgaggaaattaaggaagcaagaataaaaagaggcttatcagtaacatcagaacaaataaatcctcatagtactggagctcggaagacagaaactagagtcgaagaggcatttcggcacaaacaaagaaatccaatggatgtgtggcacaactctgcaaataaatgtgcatttcgggttcggagaaaatcaaggcggagatcacagtggggtaaaggaattattaagaaaaggaaagttaataatttaaaaaaagatgaagaagacaccaaatttgcagactatgagaaccatacggaggacaggaaattattagagaatggagagtttgaggtaagcactgactgccatgaggaaaatggagaagagactggagacttatctatgaccaatgatgaatcatcctgtgacatcatggacttggaccaggggcagaggcttaacaatggagcaggcacaaaagagaactttgcatctactgaggaggaaagttcaaatgaatctctactggtcaacagcagcagttccttaaacccggagcagacctccaggaaagagactttccttaaaggaaattgtctaaatggtgaggcttccactgacagttttgaaggaataccagttctggaatgtcagaatggcaagcttgaagtagtttctttctgtgatagtggagataaatgtagttctgaacaaaagattcttctggaggaccagtcaaaagaaaaaccagaaacttcgactgaaaatcatggagatgatcttgagaaactagaggcactggaatgtagcaataatgagaagttagaacctggctctgatgtggaggttaaagatgcagaactggataaagaaggtgcttctaaagtaaagaaataccgtaaattaattttagagcaggcaaaaacgacaagcctggaactggttccagaagagccatctgagcctgtgcctcctcttatagttgatcgtgagagattgaagaaattgcttgatttgttggtggataaaagcaacaatctggcagttgatcagcttgagagattatattctcttcttagtcagtgtatctaccgtcatcgtaaagattatgacaaatcacaacttgtagaggagatggaaagaacagttcatatgtttgagacattcctatgaacttttcaagatgagtggtttatcctctccaatctgctcctcacagagcagtcttctgagccattcaatttcaaattgcaccaattatgtgcagagccttggtgtaaagtgctctctcactcattctttctctctgttgaatttggtgctattgtctcaggtacctgaaaccaaccagcctacaagaaccaaacagaacttcagaaacatgttgtattttccacaaataaaaaatacaaccccacagcttggagattttggtgctacagaaactgctctcgcttctgctcctctttttgtgcactctcttttggagactcctctcttagggagcagaccagcaaacaggaggaaactggatgggggcagttctaactgtgttgaattgtttaaacagtgggcaacttgttatttttttttcctccattttacccctttaatcatatttttcccccatctgggtaatggactgaaacctgttttagagttggctatggtctgttctggtgggaagctgaagaaactggatgaaattaggtcaggctctttagaactgcctttaacgtgcctttttattcatttgaggaagataaggctaaaaggatgggctgtttgaagcaaataaattagaaatatttctttggtcacaaccttgaaaataagttttgatactctatgtcattaagagacaaccagtgtttgggtatgaaatgcctgtcttattctcaaagctcaatcaagacacccagtaagccacataatatactaaaatggtaagttttcttgtaaggtctgttttggtttaagaaacatgaataacaacaaagaataatacacagtccacacacaaaaaaacaaaaaacaaaactgcacacgttttggtattgccaacaatgatgactagaaaataaatagatagtggccattttttcttctgtcagtggcaatttaatagttattcatgtttgagttcccagagaaaaatggttttcatatgtagtaaattgttgttttgttttaaagccaggacttgccaaatggacagaaaagagaggaattcatcagaagctccataaaattcattttctgtatgcttaattgcaaacgagctctggtatggtccttgaataacagtattaatgtttaaatcccatctcctaagcttaccttcacaactcttctttttgattggaaaccattttgaatcttgttgagtgatttctgtgaattgtatgtatctgaaattaattatgggttactagttttacaaaaactttctacaaatttggagacacagtctaggcagttgcaatgaggcaaaggatgcagtgactttttttatcagatgatttttaaacaaaaagaaaattttgccagcaagttggcttggtatcttcattcattgtagccgttagctgcaggtgtgtctttccaatatatgcaacacatgtagtttgggttttaattagggcgaatggtcttggactactgcagagattctgagctacctcagctttttgtattttagttaccaacagtgtttacagagtcttgtaatcactttgccaccgtttacatcctgaagctaaggtacttgtctccttgtctttggctctttgtagtgtgcagaaagcatactttggccatagcctactgcagtaatccaaagtgcttctttgcatttacatttacatctaacgccttctaattctagcttaatttttttttaaatgccacgtgttttctttgtacctagtctgtgaagtttctgtaatatccagttagtcatacaagtcaagatgctacccatgtagacacactgtatttttaaggtgggcaagtgcgattaacgatgaaccattttaaaggggaggttatttgaaacctctaatttgattattgggaggattttcatgctttctttagtatttattaccatcataccgattcaaactattttattgtctaatacattagcattttgtattttgatggaaattgttacagaatttaaagatttgatgaaataagatgtagcagattttttgtagcaagtttctggtaaaagggttttttgcaagtctcaggttcttgctgcactatttttttttaaatatttattccagttattctaattcagaagcattcttttcaagtaacagcagcacttgtgaaaggaaaaaaaaatgcacatgtttcttagtaggttactaaatttgtacaattaattaagattttagccatcagtgagtttgaaaagggaaatgtatttattttcagcattaaaatgcttccaaaagatcaagttgcttttgtttgtttgtttttttaaccgtaatgtagatggagaaattggaggcaacctcagtataggaactgccactttgaacagtttaggtcttaaagagaaagtcaatctaatgccaaggggagaacaatgagctgaaattgtaccaactcctctggccctccttccctcaattaaaaaaacacacttaccagttttgcttattttacagatatctggtggttctatagtttaaagcagcttgtgaaattaaaaaagtggactcaattttgtttacctttctgtaagtttttcatttttgctgtatagcattggcaaaaatatgtacaaattgacctctgttcttatttcctattgtgagcattataaagataagctcctatgtaaaaccttgctctcagatgagtaaaatatgtatcacagcatagctcagcaataattcatgctcagctgtggggaccctgggggctttttgaagatgatggaaccgcactagggttgaaactgatggctgtggagttaattgtgttttcgagcttgaatctcacctgtgattttttttttttaatgttgtttcatgacttgatttttctcataagccaatgtatttgtaggtttactggattttatttttagggagtgggtaatttcttcccttttttgattaagttggttcagctatggtgctattcagtaggtatcttcagtgtcaggtcccgtagctgaatgccattgttattataattattatttgtaatcacattgtaagcttgaatttgggcttgtacctgcatcttttgtattctgtacatctggttacttagactttgggagtccaatttggtttcagtcatgtatgtctactttgtagtttaagtagacttcatcaactatggtctattttgggtttgtagttttaatttagaattgtgttaaattgatgttttgcatttgacttcatttgacattagttgaagtaaattatttaatttttgaattctggaatttgaacatttactgtaatttgtaatataactgctgtgaaatacttgaataaagatgacaagaaaaacatgtctttctttagcttaattatgatcactgttggctacaaatgcagtgctacttttctagctgatttagactgttttagagagaggcatattgctggttattaagcacccaaaaagtcgtgttatatgttccttttagattttaagtacacctcacgattttttagctgaaagctttttatgttgagaaagcgtggttttagttttagttgaagattgtctaaaatatgttgtatagaagcaaatggattacttctgagatttgtttttctagctggaagactatacgataacatatgatcaggtcatatggttcattagtttaaaatgttttcctttttatcgggttgttatcagtatactttgtacagtatagcacataatatggacagagatttcataccagagttttgaagggcttac

SEQ ID NO: 463466 - DNA, 884 bp, Homo sapiens
tactactactaaattcgcggcgcgtcgatgggtaatttcttcccttttttgattaagttggttcagctatggtgctattcagtaggtatcttcagtgtcaggtcccgtagctgaatgccattgttattataattattatttgtaatcacattgtaagcttgaatttgggcttgtacctgcatcttttgtattctgtacatctggttacttagactttgggagtccaatttggtttcagtcatgtatgtctactttgtagtttaagtagacttcatcaactatggtctattttgggtttgtagttttaatttagaattgtgttaaattgatgttttgcatttgacttcatttgacattagttgaagtaaattatttaatttttgaattctggaatttgaacatttactgtaatttgtaatataactgctgtgaaatacttgaataaagatgacaagaaaaacatgtctttctttagcttaattatgatcactgttggctacaaatgcagtgctacttttctagctgatttagactgttttagagagaggcatattgctggttattaagcacccaaaaagtcgtgttatatgttccttttagattttaagtacacctcacgattttttagctgaaagctttttatgttgagaaagcgtggttttagttttagttgaagattgtctaaaatatgttgtatagaagcaaatggattacttctgagatttgtttttctagctggaagactatacgataacatatgatcaggtcatatggttcattagtttaaaatgttttcctttttatcgggttgttatcagtatactttgtacagtatagcacataatatggacagagatttcataccagagttttgaagggcttac

SEQ ID NO: 463467 - DNA, 782 bp, Homo sapiens
gatttaatttttaaagaactttgtttttattttgtgtttttatgaactgagatgatgtgaaaaactggaagtaatttttattaaaatatctgttttaggtttcagattatcttgaagtaatcaaggaaccaatggacttatcaacagtaataactaaaattgataaacataattacctgactgcaaaggatttcctgaaagatattgacctcatctgtagcaatgctttagagtataatccagataaggacccaggaggtaaggatgcatagggcaaggttccccttgataatcaatcagaagacagtttaccgtttaaatactaagtcatgcctgtgttctagatagataattttcatgacctgttgtttttcaaaacttctcaataagaagctcatagcctacataaaaataatgtgtttaaagtagagaattgtatagttgtaggtattattttcaggggtttgtttcttcatttaccttctactttttatatttacattgtaatttgagaatttaattgaaaatatattagtcaacaattgcagggctgataaagattcagaatttcgaattcatggaaatccataataggatcagtttatgtgtcaaaagatccttttatgtggaatgttatctgttctttatgtagaatgttatctgttcttttgattgttgggatttctatgtaactgtgttattttactcctaatccatcctgtattcaagtgtatagtcccaacttttgttatcgctctccagggaagactgccaggaatata

SEQ ID NO: 463468 - DNA, 468 bp, Homo sapiens
gaaactttaattttagaggatagtgaagatgaaaatgctttatcaatttttgagaccaattgtcactcaggatcaccaaagaaacagtcatcatctgctgctatacataaaccctaccttcattttacaatgtgagtgatttatatcaactttctttgtatttagagtgatttttgatactttatgattagaattatggtatatttttacttatggttataactgtgaggatattgtttttctgttgtttggacacaattctggaaaacttttactatgtattctttttcatgtggtaatagttagtttgttggttaactacctaggtgtttttttctccaagtagaagaatctttcctgctactttacttttttttttttttttgggaggcagagtctcactctgtcacccagggtagagtgcagtggcatgatcttggctcactgcaacctctgcctcctgagttt

SEQ ID NO: 463469 - DNA, 369 bp, Homo sapiens
atacgggagtagtccaagatattctaagggaatgattttaagccctcaaatcttttaatttcatgttcactgttacatcctcgctttatggtgtttattgactagccatttgaatatacaatttcagtttgaccagtgaaatcaaattacattttattcttttctgttttttcttagaaattgcttgatttgttggtggataaaagcaacaatctggcagttgatcagcttgagagattatattctcttcttagtcagtgtatctaccgtcatcgtaaagattatgacaaatcacaacttgtagaggtaagtgtttagtttatctgtagaataaacaaatacttgattttacttgttccaaagaaaaga

SEQ ID NO: 463470 - DNA, 5655 bp, Homo sapiens
tgtcgtctccagaggatcccgaggtgacaaaaaaagagatatagaaactttaattttagaggatagtgaagatgaaaatgctttatcaatttttgagaccaattgtcactcaggatcaccaaagaaacagtcatcatctgctgctatacataaaccctaccttcattttacaatgtcaccatatcatcagccaacctcttacaggccacgcttattgctctctggagaacggggctcaggtcaaacttctcaccttgctccagcacttttgcacactctagaaagattctctgtgcatagactagatctcccagcactttattcagttagtgccaaaacacctgaggaatcatgtgcacagatttttcgtgaagctcgaagaacagtacctagtattgtttacatgcctcacattggggattggtgggaagctgtcagtgaaactgtgagagcaacttttctgacattgctacaagatataccatcattttcacctatatttttattgtctacctctgaaaccatgtacagtgaactgcctgaagaggttaaatgtatctttagaatacagtatgaagaggtcttgtatattcaaaggcctattgaagaagacagaagaaaattttttcaagaattgattctcaatcaggcatcaatggctccaccacgaaggaaacatgctgctctttgtgctatggaagtgcttcctcttgcactaccttctccacctcgtcaattatcagaatcagaaaaaagtcgaatggaggaccaggaggaaaatactttaagagagttgcggttgtttctcagggatgtaaccaagaggctggccacagataaacgctttaacatcttcagcaaaccggtggatagtttcagattatcttgaagtaatcaaggaaccaatggacttatcaacagtaataactaaaattgataaacataattacctgactgcaaaggatttcctgaaagatattgacctcatctgtagcaatgctttagagtataatccagataaggacccaggagataaaataattaggcacagggcttgtaccctgaaggacactgcacatgctatcattgcagctgaattagatccagaatttaataaactttgtgaggaaattaaggaagcaagaataaaaagaggcttatcagtaacatcagaacaaataaatcctcatagtactggagctcggaagacagaaactagagtcgaagaggcatttcggcacaaacaaagaaatccaatggatgtgtggcacaactctgcaaataaatgtgcatttcgggttcggagaaaatcaaggcggagatcacagtggggtaaaggaattattaagaaaaggaaagttaataatttaaaaaaagatgaagaagacaccaaatttgcagactatgagaaccatacggaggacaggaaattattagagaatggagagtttgaggtaagcactgactgccatgaggaaaatggagaagagactggagacttatctatgaccaatgatgaatcatcctgtgacatcatggacttggaccaggggcagaggcttaacaatggagcaggcacaaaagagaactttgcatctactgaggaggaaagttcaaatgaatctctactggtcaacagcagcagttccttaaacccggagcagacctccaggaaagagactttccttaaaggaaattgtctaaatggtgaggcttccactgacagttttgaaggaataccagttctggaatgtcagaatggcaagcttgaagtagtttctttctgtgatagtggagataaatgtagttctgaacaaaagattcttctggaggaccagtcaaaagaaaaaccagaaacttcgactgaaaatcatggagatgatcttgagaaactagaggcactggaatgtagcaataatgagaagttagaacctggctctgatgtggaggttaaagatgcagaactggataaagaaggtgcttctaaagtaaagaaataccgtaaattaattttagagcaggcaaaaacgacaagcctggaactggttccagaagagccatctgagcctgtgcctcctcttatagttgatcgtgagagattgaagaaattgcttgatttgttggtggataaaagcaacaatctggcagttgatcagcttgagagattatattctcttcttagtcagtgtatctaccgtcatcgtaaagattatgacaaatcacaacttgtagaggagatggaaagaacagttcatatgtttgagacattcctatgaacttttcaagatgagtggtttatcctctccaatctgctcctcacagagcagtcttctgagccattcaatttcaaattgcaccaattatgtgcagagccttggtgtaaagtgctctctcactcattctttctctctgttgaatttggtgctattgtctcaggtacctgaaaccaaccagcctacaagaaccaaacagaacttcagaaacatgttgtattttccacaaataaaaaatacaaccccacagcttggagattttggtgctacagaaactgctctcgcttctgctcctctttttgtgcactctcttttggagactcctctcttagggagcagaccagcaaacaggaggaaactggatgggggcagttctaactgtgttgaattgtttaaacagtgggcaacttgttatttttttttcctccattttacccctttaatcatatttttcccccatctgggtaatggactgaaacctgttttagagttggctatggtctgttctggtgggaagctgaagaaactggatgaaattaggtcaggctctttagaactgcctttaacgtgcctttttattcatttgaggaagataaggctaaaaggatgggctgtttgaagcaaataaattagaaatatttctttggtcacaaccttgaaaataagttttgatactctatgtcattaagagacaaccagtgtttgggtatgaaatgcctgtcttattctcaaagctcaatcaagacacccagtaagccacataatatactaaaatggtaagttttcttgtaaggtctgttttggtttaagaaacatgaataacaacaaagaataatacacagtccacacacaaaaaaacaaaaaacaaaactgcacacgttttggtattgccaacaatgatgactagaaaataaatagatagtggccattttttcttctgtcagtggcaatttaatagttattcatgtttgagttcccagagaaaaatggttttcatatgtagtaaattgttgttttgttttaaagccaggacttgccaaatggacagaaaagagaggaattcatcagaagctccataaaattcattttctgtatgcttaattgcaaacgagctctggtatggtccttgaataacagtattaatgtttaaatcccatctcctaagcttaccttcacaactcttctttttgattggaaaccattttgaatcttgttgagtgatttctgtgaattgtatgtatctgaaattaattatgggttactagttttacaaaaactttctacaaatttggagacacagtctaggcagttgcaatgaggcaaaggatgcagtgactttttttatcagatgatttttaaacaaaaagaaaattttgccagcaagttggcttggtatcttcattcattgtagccgttagctgcaggtgtgtctttccaatatatgcaacacatgtagtttgggttttaattagggcgaatggtcttggactactgcagagattctgagctacctcagctttttgtattttagttaccaacagtgtttacagagtcttgtaatcactttgccaccgtttacatcctgaagctaaggtacttgtctccttgtctttggctctttgtagtgtgcagaaagcatactttggccatagcctactgcagtaatccaaagtgcttctttgcatttacatttacatctaacgccttctaattctagcttaatttttttttaaatgccacgtgttttctttgtacctagtctgtgaagtttctgtaatatccagttagtcatacaagtcaagatgctacccatgtagacacactgtatttttaaggtgggcaagtgcgattaacgatgaaccattttaaaggggaggttatttgaaacctctaatttgattattgggaggattttcatgctttctttagtatttattaccatcataccgattcaaactattttattgtctaatacattagcattttgtattttgatggaaattgttacagaatttaaagatttgatgaaataagatgtagcagattttttgtagcaagtttctggtaaaagggttttttgcaagtctcaggttcttgctgcactatttttttttaaatatttattccagttattctaattcagaagcattcttttcaagtaacagcagcacttgtgaaaggaaaaaaaaatgcacatgtttcttagtaggttactaaatttgtacaattaattaagattttagccatcagtgagtttgaaaagggaaatgtatttattttcagcattaaaatgcttccaaaagatcaagttgcttttgtttgtttgtttttttaaccgtaatgtagatggagaaattggaggcaacctcagtataggaactgccactttgaacagtttaggtcttaaagagaaagtcaatctaatgccaaggggagaacaatgagctgaaattgtaccaactcctctggccctccttccctcaattaaaaaaacacacttaccagttttgcttattttacagatatctggtggttctatagtttaaagcagcttgtgaaattaaaaaagtggactcaattttgtttacctttctgtaagtttttcatttttgctgtatagcattggcaaaaatatgtacaaattgacctctgttcttatttcctattgtgagcattataaagataagctcctatgtaaaaccttgctctcagatgagtaaaatatgtatcacagcatagctcagcaataattcatgctcagctgtggggaccctgggggctttttgaagatgatggaaccgcactagggttgaaactgatggctgtggagttaattgtgttttcgagcttgaatctcacctgtgattttttttttttaatgttgtttcatgacttgatttttctcataagccaatgtatttgtaggtttactggattttatttttagggagtgggtaatttcttcccttttttgattaagttggttcagctatggtgctattcagtaggtatcttcagtgtcaggtcccgtagctgaatgccattgttattataattattatttgtaatcacattgtaagcttgaatttgggcttgtacctgcatcttttgtattctgtacatctggttacttagactttgggagtccaatttggtttcagtcatgtatgtctactttgtagtttaagtagacttcatcaactatggtctattttgggtttgtagttttaatttagaattgtgttaaattgatgttttgcatttgacttcatttgacattagttgaagtaaattatttaatttttgaattctggaatttgaacatttactgtaatttgtaatataactgctgtgaaatacttgaataaagatgacaagaaaa

SEQ ID NO: 463471 - DNA, 2459 bp, Homo sapiens
tttaacctgtatctcaaattcattccctaaaaatttaaagtgaattcttccgtaatgaggaacacttttgtctttcccttaatagataacatgcattttttttccttttataggagatggaaagaacagttcatatgtttgagacattcctatgaacttttcaagatgagtggtttatcctctccaatctgctcctcacagagcagtcttctgagccattcaatttcaaattgcaccaattatgtgcagagccttggtgtaaagtgctctctcactcattctttctctctgttgaatttggtgctattgtctcaggtacctgaaaccaaccagcctacaagaaccaaacagaacttcagaaacatgttgtattttccacaaataaaaaatacaaccccacagcttggagattttggtgctacagaaactgctctcgcttctgctcctctttttgtgcactctcttttggagactcctctcttagggagcagaccagcaaacaggaggaaactggatgggggcagttctaactgtgttgaattgtttaaacagtgggcaacttgttatttttttttcctccattttacccctttaatcatatttttcccccatctgggtaatggactgaaacctgttttagagttggctatggtctgttctggtgggaagctgaagaaactggatgaaattaggtcaggctctttagaactgcctttaacgtgcctttttattcatttgaggaagataaggctaaaaggatgggctgtttgaagcaaataaattagaaatatttctttggtcacaaccttgaaaataagttttgatactctatgtcattaagagacaaccagtgtttgggtatgaaatgcctgtcttattctcaaagctcaatcaagacacccagtaagccacataatatactaaaatggtaagttttcttgtaaggtctgttttggtttaagaaacatgaataacaacaaagaataatacacagtccacacacaaaaaaacaaaaaacaaaactgcacacgttttggtattgccaacaatgatgactagaaaataaatagatagtggccattttttcttctgtcagtggcaatttaatagttattcatgtttgagttcccagagaaaaatggttttcatatgtagtaaattgttgttttgttttaaagccaggacttgccaaatggacagaaaagagaggaattcatcagaagctccataaaattcattttctgtatgcttaattgcaaacgagctctggtatggtccttgaataacagtattaatgtttaaatcccatctcctaagcttaccttcacaactcttctttttgattggaaaccattttgaatcttgttgagtgatttctgtgaattgtatgtatctgaaattaattatgggttactagttttacaaaaactttctacaaatttggagacacagtctaggcagttgcaatgaggcaaaggatgcagtgactttttttatcagatgatttttaaacaaaaagaaaattttgccagcaagttggcttggtatcttcattcattgtagccgttagctgcaggtgtgtctttccaatatatgcaacacatgtagtttgggttttaattagggcgaatggtcttggactactgcagagattctgagctacctcagctttttgtattttagttaccaacagtgtttacagagtcttgtaatcactttgccaccgtttacatcctgaagctaaggtacttgtctccttgtctttggctctttgtagtgtgcagaaagcatactttggccatagcctactgcagtaatccaaagtgcttctttgcatttacatttacatctaacgccttctaattctagcttaatttttttttaaatgccacgtgttttctttgtacctagtctgtgaagtttctgtaatatccagttagtcatacaagtcaagatgctacccatgtagacacactgtatttttaaggtgggcaagtgcgattaacgatgaaccattttaaaggggaggttatttgaaacctctaatttgattattgggaggattttcatgctttctttagtatttattaccatcataccgattcaaactattttattgtctaatacattagcattttgtattttgatggaaattgttacagaatttaaagatttgatgaaataagatgtagcagattttttgtagcaagtttctggtaaaagggttttttgcaagtctcaggttcttgctgcactatttttttttaaatatttattccagttattctaattcagaagcattcttttcaagtaacagcagcacttgtgaaaggaaaaaaaaatgcacatgtttcttagtaggttactaaatttgtacaattaattaagattttagccatcagtgagtttgaaaagggaaatgtatttattttcagcattaaaatgcttccaaaagatca

SEQ ID NO: 463472 - DNA, 3061 bp, Homo sapiens
tcactggtgacctcccgggtagccaagagcttcccccttctccgtgagccctctgagactgcaggtcccagacggttgtaaattctgcctggtggaaattgccaaggctccaaagcaggcacctgctgccctcaggagcctcttttttattgctgccctctccatccgcaccagtgcctctctctgccagttccactgttctctcgcctgctctttaggatttcctttgttttgcctccttgcctggtgctttcagcgagcagcgctgacgtcatctcaggaaccgtgctgcgtctgagagaagaacctgcagtagctgtttaagtgtgcggtgctggcagagtacctccctgaaggtgtcctggggaaagcccagcgagcagcaccggtgattgatgatactacagcgcatcccaggagctggtatcccagggcagcgctgcacctgctggcagccaaacccttcggggcaggacaccggcccacagcctcggagcgcccagtgtggtgtcagcacagcggcaggtcaccgttcaggaaggacccttgtaccgcacggagggctcccacatcactatctggtgcaatgtgagtggctaccagggaccttctgaacagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaacccaaccctattgcacatcacagatcttcaggcccgggatgccggggaatatgaatgccacacacccagcaccgagaagcaatactttgggagttaacagtgcaaagatgaacctagtggctgtttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcggcctccaaggaacctgacaaccatgtgtacaccagggctgccgtggccgcggatgccaagcagtgcttggagattgggaggaaaagctgaggtcatcaatgcccgcgaggtggcccccaggctggcctttgccagcatgttcaacagctcggagcagtcccagaaggcactttaggaggccaagtcaggaggagcgcatgagcccaggagacctgcctggacaacatagcaagactccatctctacaaaaaatggaaaaaaaaattagctaggttatggtgaagcctctgcttcctgtctgagggaagtgggggctcgtggagtgtgtgactggaaggggatggatctggtctatggaccccttggattgctgtgtaaggggcagggagcatgtggggacctgtccggaggagggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagtcctggaaaacaagcggaccgtcatcgagcagcagcctgtcttgtgtgaggtgttctgccgggatagaaaggtgcttcgggagggggagagactgaccctgccgcggctggctgacacctacgagatgctggccatcgagggtgcccaggccttctacaacggcagcctcatggcccagattgtgaaggacatccaggcggctgtggtgcagccccatcccagcgcccattcgagctgctgtcccattgcagggggcattgtgacagctgaggacctgaacaactactgtgctgagctgatcgagcacccgctgaacatcagcctgggagacgcggtgctgtacatgcccagtgcgcggctcagcgggcccgtgctggccctcatcctcaacatcctcaaagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggctcatggcatccagcagccactcaatgtcaatacctccatgttcatctctcagcccgcccttgcccctctggggtctcagcaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctacatcaccaatgagtttggggcacccccctcacctgccaatttcatccagccagggaagcagccgctcttgtccatgtgcccgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggtgggccgggggttggagaaactgagtcacggtgtggggtcccagggcatcctgggctggaggcctggatcatcacagagtggacaatggttggtgtcctctctctagtgcctgggccatctggagcccctgtgacatgagggccaagccccctgctccagtgagacccagcaggccccaacctgctcttcctgatgacctggcctgaaatggcaccacctgggctgaggcctgtgaccacacaggtgtggttcaggtggcatctggagccctgctcaggcttcccctctcctcccacccccaggcagtgactgcagccctggagacccggcaccatcacacccagatcgcgtccaccttcatc

SEQ ID NO: 463473 - DNA, 3035 bp, Homo sapiens
tcactggtgacctcccgggtagccaagagcttcccccttctccgtgagccctctgagactgcaggtcccagacggttgtaaattctgcctggtggaaattgccaaggctccaaagcaggcacctgctgccctcaggagcctcttttttattgctgccctctccatccgcaccagtgcctctctctgccagttccactgttctctcgcctgctctttaggatttcctttgttttgcctccttgcctggtgctttcagcgagcagcgctgacgtcatctcaggaaccgtgctgcgtctgagagaagaacctgcagtagctgtttaagtgtgcggtgctggcagagtacctccctgaaggtgtcctggggaaagcccagcgagcagcaccggtgattgatgatactacagcgcatcccaggagctggtatcccagggcagcgctgcacctgctggcagccaaacccttcggggcaggacaccggcccacagcctcggagcgcccagtgtggtgtcagcacagcggcaggtcaccgttcaggaaggacccttgtaccgcacggagggctcccacatcactatctggtgcaatgtgagtggctaccagggaccttctgaacagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaacccaaccctattgcacatcacagatcttcaggcccgggatgccggggaatatgaatgccacacacccagcaccgagaagcaatactttgggagttaacagtgcaaagatgaacctagtggctgtttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcggcctccaaggaacctgacaaccatgtgtacaccagggctgccgtggccgcggatgccaagcagtgcttggagattgggaggaaaagctgaggtcatcaatgcccgcgaggtggcccccaggctggcctttgccagcatgttcaacagctcggagcagtcccagaaggcactttaggaggccaagtcaggaggagcgcatgagcccaggagacctgcctggacaacatagcaagactccatctctacaaaaaatggaaaaaaaaattagctaggttatggtgaagcctctgcttcctgtctgagggaagtgggggctcgtggagtgtgtgactggaaggggatggatctggtctatggaccccttggattgctgtgtaaggggcagggagcatgtggggacctgtccggaggagggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagtcctggaaaacaagcggaccgtcatcgagcagcagcctgtcttgtgtgaggtgttctgccgggatagaaaggtgcttcgggagggggagagactgaccctgccgcggctggctgacacctacgagatgctggccatcgagggtgcccaggccttctacaacggcagcctcatggcccagattgtgaaggacatccaggcggctgtggtgcagccccatcccagcgcccattcgagctgctgtcccattgcagggggcattgtgacagctgaggacctgaacaactactgtgctgagctgatcgagcacccgctgaacatcagcctgggagacgcggtgctgtacatgcccagtgcgcggctcagcgggcccgtgctggccctcatcctcaacatcctcaaagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggctcatggcatccagcagccactcaatgtcaatacctccatgttcatctctcagcccgcccttgcccctctggggtctcagcaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctacatcaccaatgagtttggggcacccccctcacctgccaatttcatccagccagggaagcagccgctcttgtccatgtgcccgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggtgggccgggggttggagaaactgagtcacggtgtggggtcccagggcatcctgggctggaggcctggatcatcacagagtggacaatggttggtgtcctctctctagtgcctgggccatctggagcccctgtgacatgagggccaagccccctgctccagtgagacccagcaggccccaacctgctcttcctgatgacctggcctgaaatggcaccacctgggctgaggcctgtgaccacacaggtgtggttcaggtggcatctggagccctgctcaggcttcccctctcctcccacccccagggcaagagagctcaaataaaaaccagaggactga

SEQ ID NO: 463474 - DNA, 2211 bp, Homo sapiens
ccagccatgagctcagggggctgcctggcgggcctgagcctggggaatgcagggcctcgggtccacagcggctgtgcagacggcggagcagaagagggagaggttcgtcttccaggctgcaccgcgctggcggcgagcgggttcacagggagccggcggcggtggtaccacagcctggtgatgtcagacaccagtggttctttcagaggggtctctccagccccaagcaggaagctgttttccttctgtgtgtgcagccaaggcccctggaggggctgagagtcggggctgagtcttcctggggccagggccccccaacaaggcctccgatgagccccagaggacctccctctcagtgtgaagatcattcaccgatgaagacagacccagttggatcccctttgtctgaattcaggagatgtccatttctggagcaagaacaggcaaagaaatactcctgtaatatgatggccttccttgctgacgaatactgcaactattgtcgagacattttacgaaatgtgaggaactgagaacttgagagggtagggttttatctataaaatacaagcatttatgactccttattaatcatttttatttgaagagaccccgtcaacagatgtccaatggtaacccactgcactgaagtgcttacatgctatgtacctatgttgtagtcattgagttctggaaggtgagatcgatattcagtgtaatcagttggaaattctccaaggtgctaatacagataactttaggctctaaatacaaattcagctattttttagatcctaattctgctcattttgaataaagtgttggtaataaaattcaccctggaattttcaatggtgccgaagagccatttgattgatacgcgctaactgaagatggagcaggacttcgcagctgagtgatctggcatgggtattgtcacgattggatttaatcctagaattggctgtggaaaacatgaataaatctttcagctattctgatcttgcgaggtggaaaacgagttttggcgatatgctctgttacttaccccaggtggaggacttgcttacttccttctggaagtctctgcagcaagacacagtcatgctgatgtcattgcctgacgtgtgccagctctttaaatgctacgacgtccagctgtacaaggtaggaggacgcactatgcgaatggtattgaaaagtaagaggcgtgtcagcgttttgaagtcagatctacaggccatcatcaatcaaggcactttggctacttctaagaaagccctggcaagtgaccggagtggcgcagatgaactggagaacaacccagagatgaaatgtttaagaaacttaatttctttgctgggaacatcaacagatctcagggtattcctcagctgtctgtcttcacatctccaagcatttgtgttccagacaagcagaagcaaagaagagtttaccaaattggccgccagcttccagctgagatggaatcttcttctcactgctgtaagcaaagccatgaccctctgccacagagatagttttggctcctggcatctgtttcacttgttgcttttggaatatatgattcatatacttcagtcatgcctagaggaggaagaggaggaggaggacatggggactgtcaaggaaatgctaccagatgacccgactctcggccagccagaccaggcacttttccattctctgaattcctcactgtcgcaggcgtgtgccagccccagcatggagccactgggggtgatgcccacacacatgggccagggccgatatcccgtgggtgtgagcaacatggtcctcaggatcctgggcttcctggtggacactgccatgggcaataaggtgctgttggaagatgaaaccactgaaagcgcagttaaactcagccttcctatgggacaagaagccctcataaccctaaaagatggacaacaatttgtgattcagatatcagatgtaccccaaagctctgaagatatttatttcagagaaaacaatgctaatgtgtgagattatttatttgaatagagaataagaaaactgatagacttgcattcttaaaaatattaaatactaaagtttttctattgacgaaagatgatgttatgtatataatagatgtagcattgtctattttatgtttatatgtatttcaaggaggtggtttcgataaaatatgtaaactgattt

SEQ ID NO: 463475 - DNA, 1241 bp, Homo sapiens
  misc_feature (5)..(8): n is a, c, g, or t
  misc_feature (12)..(12): n is a, c, g, or t
  misc_feature (14)..(16): n is a, c, g, or t
cctgnnnncttntnnntcctccaaactattccaacctctgcctgtcacccagttccaaagttgcttccacatgttcaggtatcttttcagcagtgccccactctactggtaccaatttactgtattagtccattttcatgctgctaataaagacatacctgagactgggaaatttacaaaagaaagaggtttattggactcacagtttgacgtggctggggaggcctcacaatcatggcagaaggtgaaaggcacatctcacatggcggcagacaagagaagagagagcatgtgtaggcaaactcccatttttgaaaccatcagaactccgacaccacgaacccaccgggaggaacgaacaactctggatgcgtcatctttaagagctataacactcactgcaaaagtctgcggcttcactcctgaagtcaatgcctgcacttggttgaccctaaaccagattcctcaacaggtcaacagcaacccacctgcagtgaccatttcaccatcacccactatgtcatcaggtacccttcctgagggcattccccatcctgcaaaggacatccctgattccacatgaggttaaggagacgctgctgcctacccgtttcactctaagcaaattcacataatgatgtttttcaccctaaatgccaaaacccagagttttttacaatgaaaaatctcttctgagtaaacttgaagtctactctggaagttaagtctactagaatttttttaaatctggtgtaattatttcacaggtcagaatgtggaatccaaagacgaaatagaaagcagatatgtctcatcctgctgaggctaactgaacattctgtatacctctgggagagatcttctatgtacatgaacatagacagagtctcactctgttgcccaggttggagtgcgatgacacgatcttggctcactgaatcctccacctcctggattcaagcaattctcctgccttagcctcctgagtagctgggactacaggcgtgttccgccacacccagctaattgttgtatttttagtagagacgaggcttcaccatattgaccaggctggtctcaaactcctgacctcaggtgatccacctgtctcagcctcccaaagtgctgggattataggtgtaagccaccacgcccagcctgtaacagttaactttatatgccaacttgactacaccatagggttcccaaattaaacattatttttgaatgtgtcactgagg

SEQ ID NO: 463476 - DNA, 1811 bp, Homo sapiens
  misc_feature (2)..(2): n is a, c, g, or t
  misc_feature (4)..(4): n is a, c, g, or t
cnancaccagaggtatctgatctattatcacacagaatgtgggccaggccccttcctgacttgacccttggaatgactgagatacaaacacaggaagggtacgtggccttaggccaagctgtggcagagaaaacttcagagcatctctacattcctttatctgctgtctcctaccttgaggggccgcctgacctgcagactttaaggcactcatgtagtggcagctcctggaactcccactgcttcaccgcctttctgcggggctcccctgccctactgcctggatcctacagctccccagtagtcccaccaattgccattaaacctcccaatctttactgggaggatctctacttactgtttcaaggcaaaaagatgattaaactatctcacatggttgtaatttgggcctaaaataaatgactctagtggtagcatttcatgtaggcaggtccaaggaagacagatttgtagacagagttgggaaaagggtcaaagagccaatgagtctccctatcctgagggatgccttgacggagccacagcatgaactcatgttttcctgaatccatctcagttcatgtgacaggatggaaatgcttcctttcttagccagtgttgcttgtaacgagttccctgcagctcagggaagggagcaacatgtactgctttgttgcttcctgtatagagaaggcaggaatgaggaagttcagagaacactgtcctgagcagctgccacaggagacccagcccaagctctgcatgcagaaaggcacatggcaagaaattcccatcctgcacacgtggatgtgatggacaccctcactccttaaattttgaggcaactagactgaaaagggctcttgcttgatttaaacaattgaactcttccttttggctcaggcatcttgttgcttcttgcactggctttgccactgaccttggcatttgctattttttgtctttttgataatagccactctaaccggagtgagatgatatctcattgtggttttgatttttatttccctgatgattagtgacgttgaacatttttttcatgtctttctttgttggctatttgtaagtcttcttttgagaaatgtctactcagatcatttgcccattttttaatgaaaaaaaattttttttttccgttgagatatttgagtttcttgtgtattctggatattacttctcctccattgtgaatagtttggaaatattttctcccattctttagattgtcctttcagtctgtcgttttctttgctgtacagaagccttttcaacttgatgtgatcccatttgttactttttactttggttatctgttctttttgaggttttacttaagaaatctttgcccagatcaatgttctaagttgtttcctctatgttttcttctagtagttttatagtttcaggttttagatttaggtctcagatccactttttgattaagggtgagatgtaggggtctagtttcattcttctgcatatggatatctggttttaccagcacattttattgaaaagactgtcctttccccagactacccagatgtttttccctgaaaaacagcacagaattatatactagtgaactttttgaaaagtacatgttggagaagggtgtgtgtgcgcatgtgtaaaatgtatttggatctggcatttcagcttgttaggagattcttttgaaatgtgattgtatcatcaatcaaattagttctccctctcagctttctatcattttcaaatgtggcaacaatgacttataatgctgtttaaatatagatagaccattcatc

SEQ ID NO: 463477 - DNA, 969 bp, Homo sapiens
gtgggtatttttctccttcataatgaccgcctactctagaatgtctttaaacattttaagcattcttatttgtattctgtacctcaagattccattgcctggaagccctatgactgattccaggaccaccatccccctcactgtctctgaggcacctgcgtggaccgggtctggattgagtctcatttctctggattcccacggcagccggcggctgcctctcccacacccgtcactctgtgtcatggaaagctgtgtgtttgtcttcattcccaccgagtctgagccactcgaggtcagggccatgaccgtgagctacacgtccttggcgcccagtgtgagccccacacatcagcatgggcctgtgtcccccaggccacacgtcggcatgggcctgtgtcccccaacccacgtgtcagcatgggcctgtgtcccccaacccacgcttcagcatggggcatgtcccccaggccatgcgtcggcatgggccatgtcccccaacccacgcgtcagcatgggccccgtgtcccccaacccatgcttcagcatggggcatgtcccccaggccacgcgtcagcatgggccatgtccccacataggtgagtccctgatgcaggttgggtccccggggaagctcactcagagacagaagagtgtttattggtggcggggcagtgctcttgggtttagggtctgtgaagggagagaaggaaagccagtggggtagagggagtcgtcgggcagtgatgccctaaccgctggtccctggggaagctctggagctggcacaccccttcagggttgtcccgagtggagcctggggccaggcctttatccacagtgtgggccgccaccaggtgcaggtgcccaggaggggcgtgttatgggttgaattgtgtccctccaaaaagatacattcaagtcccaagccccgctacgtgtgaatgtgacaaatccactgtagaaacc

SEQ ID NO: 463478 - DNA, 821 bp, Homo sapiens
gtgacaccaatgaggagcaggtccctgttttgtctctgcctgggctggcctgtctggaacagtcttctagggtcacagtgcacgtctgcctctgggcagctgcctgacccaggcctccacgagagcagggaagaggcacagagacgttccatgatggctgggtgaagaagcaggcagtcgggaaaccctctgcctgcagagaccacctgcagatgggggcctcagctgcctgcagttgcccagggcatggaagcacaaagctcatttctgttaccacatcactaactgcaggattggacctcagcatgcatactggttctggcacaaaaggagctgatttcttgttcttgcaactgtcccaggcaggggttcctgctcagcagatggtgcctctcctagaagtaattcagggaccagccaccttccatcctaggcctccatcacagcccttgggcctcgctgtggtgtgcacccccagcagtcagaaaagagggagactgggagcacatctctgtggctgcaggcgtcactttctgctgttctcttgtctacactttctgtgttttgttggacaatccagtcgtcaggccgtgcccacctgtcatgttggatgggaaatgtagtccagcagtatgtccagagagaagggagaaatgattttggtaaacaaccaaccatctccactgcaggtgatgcaggcaaacccaaaaacgggggctcagcctgagttggttcttggcttcattcagggaagaattcaagagcaagccaacggtgaaagaaagcaagtttatatagcgtagtgaacagcaagatggctg

SEQ ID NO: 463479 - DNA, 2782 bp, Homo sapiens
gaggagggagtgggaagtggggactttaaatgaagacaggtgacaaggcacttagctgattaaagaaggaaagactaggaatggccagggctaccagtaaattactgatagccagtgacctccccaagggaccctagaacccaggatcccactttccacacctgcaggtcacccgttggctgccagatccatgtcaggttcctttgagttcagctgcagcctgctgacttgggcacttcccccaacagcctgcttggctgaccacatcccccagatggttccaaactgtcagccttttgagcccacagacacgctgatgatctggaaggccttcatcagcccttctgaaagagatcttgcggatgccagctccttttcaactcagtacatggaacatgcagacaccagccctgctgctgagaacaatgtctgtcagaaacatgctttccctgagaggacaaccattattagtgggatgtttctccccaacctgccttttgaaagaaacccagaattatttttaaacagaatttggaggcttccaaatacaacaaatattcaaactgcctgtgggttcctacattacaagtccttgctttgtggtggggagaacagaggctatggagccaatggttctggggacatagggggcctcggaggcctgctccgtgggcctgaactgccttctcttgctttctcttctccgcttcctgggcatcaacccaaggaccctcaatgccttgacccggtggttttcaactctggccgcacactagaatcatcagaagaacttactgagatatggatgcttacaagcaactcattgtcctcagaaaatagcagctgcttctggggagtattcggcattgggtgtgactacttaggggagcgagctttcagcagaaggcctgagccttcgtccgacaggaaaggaggaagtgactcataccacctgtgcacatcaggagacagtcatgtgaactacagctgttgccagtgccagctgggcattgtgcaaagcaggacttgaatgtgtccatcacatgcactctgtggtcgagccatcagatgccctgagtaattaatgttcacatggctttgtgaaatacaactatgtaggctagctcgtcaagtgtttttacaagagctgacgccagtggaacccactcagcttgcttttcctgttccagctttttcacgcacagtcaggacccccctggaacttcatctactgccagctcccccattcccctcccacgagtgtgggtggccctcttagcctctgaccgcatactggaacctgcggaggcagtgttaccagacctgaggtcttcctctgcatttcatttgctgttccctggcctgcaatgccccttccttcccacctcccccgagggcctagcagcccctcctacacagccctctagcccctctgtgctcaaagtgcatctgaggacatcacctgagagctgtaggagatgcaggatctcaggccccaccccaaacctactgaagccaaatctgctgtttaacgtgatccctggagattcataagcatgttgtctgtgcagcacggagtgaggggcggctcctcttcgctgcaccccttcctgattacccctaggcccagccaaataaactcttcttcctgctcccttgtgccccatttggacttcactcgtaacaagggagtataactggatggtaaaagggacttttcctgttatctagacatttcagcagaggcctcaaaggcagaacaaaatagtgcaaggagccgcacatccgcacagtgctgagaccctgcccaggacaagcttggctttttagcttctgttgtgatagaacaaaagagtttttgacattttgtaacttcttccagtcttttatctttcagtttttgtctgagacttctactaggatgttttcttctcaacacgcttgatttttgtatagttaataattttgaaataaaggcattctcaagagcagttcaaatgcacttgaaaattgctgaaatgtattgagttgcatattgcataatcaaattacttttttgccacatagactgatctattgctgtgtgactttgggtgagtcactgtacctctcagggcatctgcttctcaatctgtacaatgaggtgactctcgagaatccccaagttccctcccagacctcagatcccatgaagaacaaagagcctcaggtgcagaactgcgaaggagaggtctgctcagaaatcatgtttctttcttttgcttccctttgtaatttttcaagaaaaattctttagtaatggtgttcttgggctatagcagatgaaaaaaagagaaagtcaggttctttggggttaaatggagcatttaatgacagttaagcaaaaagatgtgtgctgggcctttttctcacgttggatgtttggctaattgatcagcagatcctggcacccaagtgacaacctgcattgaaaaggcggaacttggctctcctgccctgccagctgtaagagcttgaaagcaaagctatggggggaatgtctttcatttccccctggaagctgggaggacgttcagcttagcattgccaactgtgtaatgtggacttgcctctaaaagaagcctttttccttggatgtctttcaggccgcagtattccctttggcacccccacccacctggaacaaagcctgatgtaaagtctgggtgcgactcagaccggcctgggaaagaatttatttaataaatggtggaaagtggcttccttgacgtgtcttcgatgg

SEQ ID NO: 463480 - DNA, 197 bp, Homo sapiens
acatttcagcagaggcctcaaaggcagaacaaaatagtgcaaggagccgcacatccgcacagtgctgagaccctgcccaggacaagcttggtgagtggaaaacttcctttgtcagcccttcgcgcacttccagcctcagatcgaggcatcagggagggtttccttgaagagggtgggctgagggctgtgtgttccca

SEQ ID NO: 463481 - DNA, 343 bp, Homo sapiens
tggccaggagcggcggcggcagcaacaggaggcgatctcgcgagaggcgaggccaaaaccctgcctcgctagcgcagggagaagtcgcaccagtcggagcgcagagggacacgcagacatttcagcagaggcctcaaaggcagaacaaaatagtgcaaggagccgcacatccgcacagtgctgagaccctgcccaggacaagcttggccgcagtattccctttggcacccccacccacctggaacaaagcctgatgtaaagtctgggtgcgactcagaccggcctgggaaagaatttatttaataaatggtggaaagtggcttccttgacgtgtcttcgatgg

SEQ ID NO: 463482 - DNA, 688 bp, Homo sapiens
gaagcattgtggtaacgcatggggtgctgctgaatgggactcattgcactctgcaacctggctctggcgattcagaccgtgaatgcttggattttgatggtcctgatgaaatggttttccttatgcaagcaaagtaaggtggccttttcaatccttccagctaccagtcagtccacaagcacttatgggacaccagaccttgcctggagcagccttggggaatcaaataggagccagtccctgccctccagaaactgtgtgtctgggggagaagatcacacacaggaaaatcaagtggtgacaagaggtgccatgagacagtatatagttcatttccccaccgcaagagtaaagggcttagggtcagaggctttggtgcctgagttctgactctgccaattattagcattgggacctcagactcagctggcagagaggagaagcagcgggacatcaggactatggctggacgtcagagagaagcagcttaacttcagaggtgcagcttgatggtgtaacttaggagaagaatctgactggagacggccagacttcagaagaagatgacctacccccccatccccttttcagcttcccttcccgctgagagccacttttattggcaataaaatcctccacatttaccacctttcaatgtgttcatgtgacttcattattcctggacacc

SEQ ID NO: 463483 - DNA, 1100 bp, Homo sapiens
gcgactctaccgagctttgtcatccccttcgatcaatgttgtctcctgccccccagggggtcaatgggatcctttgagccaggacgtttttccagtttctgaatccaattgtaaatccctcatttttttaaaaacctctaccagacttttaaaaagttgtcctcaaaaaactttctaatctagagagagaaagagcacggcaacttctaagtgatgctggcgagaaagtcaggagacttggcacttacaactttctaaagatctgaatgcaaatgtcacctggagcattggagtatgccgaggcccctgggtgatgaaagtgagggagaaatgagagggcaggggtgcgccaaataaggggggatttcactcctgtccatccctgggcttgtgtaactcaaggtattggagagtcaaagtgtgctcttggttttactgctaccatgaagagacgaaaagcgagcccgcagacttgtggccctttccctgacctgatttgttatctctcaagtgaggccaagaagatggcttctgcccaggattccaggagagtgggactgcacacagcacataacttactttgcaaggagggattgcttgtggttttcgttagctctggagcttcggaagtcactgtcaagctagctacttcccaggaaaatatgcacttaaaaggtctcctgggccatccaaattgtgggacaaaaattacctgtgtgcccttctttagccaactaggggccagaagtgatgttatagacaagctagggcctttcagtcctggtgtgacttcagtcctggtggctgacttgggtgctttgaccaaaacaggccctgtccaagcttccattttctggtgtttgtgtggtgttaagtaatatcgtgcatgtaaaaatgtttgaaactgaatgtgcatacacttctctttcctgctgccttgtgaagaaggtgcctgcttctgcttagccttccaccatgattgtaagtttcctgaggcctctccagccatgcagaactgatgtgaatttgcttctcttttgccttccaccatgattgtcaggcctccctagccacgtggaactgtgagtccattaaacctc

SEQ ID NO: 463484 - DNA, 1837 bp, Homo sapiens
cccttttagccatggctggagtggctgggatacagggcaacaagtccctaggctgcacagacttgagggccctgggtctggcccatgaaaccagtttttcatccttggcttccagggctggcatgggagggcctgctgctatgatgatgcatgtttatatgctaaattttgtgaaagattctggaattgctggaattagaggaaagagggatttacatgagaacgaagagccaagaagtcaggaacccacttggaaacaccactcagccttggaaaagccacccaattacagtggctgtggaggatcccgacatggtttgactgtgcttgggaactggttaggttctttggacttcacaaaaccattaattttaagttcacattttaaatatgaaatacagttagacaaccatgtgttttctcatgtcttttggtcaaacattttatgggtaaaatttatttcaaccaaactgctctaatatatatgcatttgttatagtaacccgggacccatataaaagctacattttcaatacaagataaaagtcattttgcaaaaactgcatttttttatgcctgctggtgcagctgtagcaacaactttactttttttttccatttttttgagagaagatgagaaggcacagatgttaaggagaatgccatgtgaagacatagacagagattggagttatgctgccaaggaatatctggagccatcagaagctggaagaggcaaggaaagattctccactggagtcttctgagggatgccaacaggctgcttagttgattcaagagaagactatgagtagggagaaaagttaaaacccagtcccacagattaatccaataaagaatagaagagaaaatttaatttcaaattttgttaatcagaattacttggggacttgttaacacagaagtcactgagccccaattccagagtttctgaagtctggggaaggctcaagaatctgtgtttctattaagttcaccactgatgctgatgctgctggtctgagtgaaatacatggagaaccactgacaatgacctcagagaacatgtgtacacttctgaatatgcttgagaccttaagatgtcaatatggtagtggttttaacttggacagggtatccaaaatgtgatataagtgctaagtcttacccatccagaaagtagagttgagattgttgataagtttctatctcaggtaagtgtcacgtaaggaactagggttggactgaatgtgtaacaatgaggtgagcgcatcgactcgaagtccaggtgggagatattggggagggaagacatgcttgaaataaatccaggggtctgaaatgttctactccttctgagtggagataagtgtggcgcacaatcttttaaatatacaaaggacagaaacactgctagaacataaaactgaatactcagtacaacaagggaaacatctatagtggactcatcctgcaaattgcaaactttcctatgagtgacccttacaaggaagcttaactttcaggggtttatcttgatttcttttgtaataaataaaaactccctctgcgatataatttatgaatgaaataaattatcaaatatagtaagatacaaaggtacttttagaaattttataggagtaactgtaattttattttattatttagccatgcttgtgcgtgagtatttttaagtaccaggagttaggaaggctttctagatatttgaaatgatttgggtgttgtgatctaagctgtatctgctttagaggacaccttaatcccagtaatgctgtggtccttgcagttttgtagaggtactgccttgatgatc

SEQ ID NO: 463485 - DNA, 905 bp, Homo sapiens
cccttttagccatggctggagtggctgggatacagggcaacaagtccctaggctgcacagacttgagggccctgggtctggcccatgaaaccagtttttcatccttggcttccagggctggcatgggagggcctgctgctatgatgatgcatgtttatatgctaaattttgtgaaagattctggaattgctggaattagaggaaagagggatttacatgagaacgaagagccaagaagtcaggaacccacttggaaacaccactcagccttggaaaagccacccaattacagtggctgtggaggatcccgacatggtttgactgtgcttgggaactggttaggttctttggacttcacaaaaccattaattttaagttcacattttaaatatgaaatacagttagacaaccatgtgttttctcatgtcttttggtcaaacattttatgggtaaaatttatttcaaccaaactgctctaatatatatgcatttgttatagtaacccgggacccatataaaagctacattttcaatacaagataaaagtcattttgcaaaaactgcatttttttatgcctgctggtgcagctgtagcaacaactttactttttttttccatttttttgagagaagatgagaaggcacagatgttaaggagaatgccatgtgaagacatagacagagattggagttatgctgccaaggaatatctggagccatcagaagctggaagaggcaaggaaagattctccactggagtcttctgagggatgccaacaggctgcttagttgattcaagagaagactatgagtagggagaaaagttaaaacccagtcccacagattaatccaataaagacggatgcgcccgcccccccccctgccgtcccctgcgctcatcccac

SEQ ID NO: 463486 - DNA, 4522 bp, Homo sapiens
ttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggagatcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaaggaagaaatgcaggagttgaaactaaatagcagtaagtcagcatcccatcatcgttggcccacagagaattatggaccagactcggtgcctgatggatatcaggggtcacagacatttcatggggctccactaacagaatttaagtcaaccaaagaaggattttccatccctgtgtctgctgatggatttaaatttggcatttcggaaccaggaaatcaagaaaaggaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctataagactgaggacagcgatgacatccattttgaaccagtagttcaaatgcctgaaaaagtagaacttgtaataggagaagaaggtgaaaaagttctgtattcacagggggtaaaactatttagatttgatgctgaggtaaggcagtggaaagaaaggggcttggggaacttaaaaattctcaaaaacgaggtcaatggcaaaccaagaatgctgatgcgaagagaacaagtactaaaagtgtgtgctaatcattggataacgactacaatgaacctgaagcccctgtctggatcagatagagcatggatgtggtcagccagtgatttctctgatggtgatgccaaactagagcggttagcagcaaaatttaaaacaccagagctggctgaagaattcaagcagaaatttgaggaatgccagcagcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactgtgatttaagggaagatgctttggatgatagtgtcagtagtagctcagtacatgcttctccattggcaagtagccctgtgagaaaaaatcttttccattttggtgagtcaacaacaggatctaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaaaaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaaaccatttgcatttggcaacagttctgccactgggtctttgtttggatttagttttaatgcatctttgaaaagtaacaacagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcacttaaacggcctgcttcgggaagcagaggcaaccagtgcagtccttatggagcaaattaagcttctcaaaagtgaaataagaagattggaaaggaatcaagagcaagaggagtctgcagctaacgtggaacacttgaagaacgtcttgctgcagttcattttcttgaagccaggtagtgaaagagagagacttcttcctgttataaatacgatgttgcagctcagccctgaagaaaagggaaaacttgctgcggttgctcaaggtgaggaataaaatgcttcccgttcttctggatgggcatcctatcttcgtagttggtttggacttcgataggttgatggaaggaatatttttattaaccaaataaaatctatttacaaaaatggttcatgtgtattaccatcattcttttgtcaaaaagtgtgtatatgtttgcatttacatatatttgtacatctatatgacagatgtattttaaaagtttcaacttgaagtaaaagtacaacagcttgaagtattgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgtttgaggctagtgagctgtgattgtaccactgcactccagctcggggaacagagcgagaccttgtctctaaaaataataatagtaataaaaataacattttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactatctcaaaactcattatgttgtcagagccctagagctggctaatgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataagctttccatcagaagggattttagacaccttagaggtccgtgctacatcttcacagttcctctgaataaccttaggtggtagtgttacttgcctttgacacctctgcatatgttttaatgactagatccaaactgtgttgttcttaaatcaaaaattggataatttttaatatttatgtattaatcacatagtatgctctctgaagttctcttaagccttcagtttata

SEQ ID NO: 463487 - DNA, 462 bp, Homo sapiens
tgaaataaaatgttaattggaaacatgaaaattagcagctgataattatagtagtcattgcataatacagtaatggtctttgttattgtgctttcaggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaagtaaagaaaattacctggatttgtacatgcagtagatccctttcatgtagcagttcaatatagaggcccctacattgtatcctgaactgttttagggagttcataaagagaatgagtagaaaccctagtctcccaactaaactttcagtaggccctttcttcaagctactgaaagtttagtt

SEQ ID NO: 463488 - DNA, 1281 bp, Homo sapiens
  misc_feature (43)..(44): n is a, c, g, or t
  misc_feature (46)..(46): n is a, c, g, or t
  misc_feature (52)..(52): n is a, c, g, or t
  misc_feature (55)..(55): n is a, c, g, or t
cgggatttacccccttggggaccctggttcttcaggacacacnntnggctcnttngagaagaattgaatactactgacttatactcttacaggaaagttactgacaatatttcttcctgtatggagaactttaacttggggaaatctttggaagacttccgattctcccatatggcaaaatatgtgtggattgctgagtatttttaccaaggttttaagcgatggattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaagtaaagaaaattacctggatttgtacatgcagtagatccctttcatgtagcagttcaatatagaggcccctacattgtatcctgaactgttttagggagttcataaagagaatgagtagaaaccctagtctcccaactaaactttcagtaggccctttcttcaagctactgaaagtttagtt

SEQ ID NO: 463489 - DNA, 1289 bp, Homo sapiens
  misc_feature (3)..(3): n is a, c, g, or t
  misc_feature (8)..(8): n is a, c, g, or t
aancttanacagtttcttctggaacatgttcccctccaaagcattcagctttagtgaagaaggcattggggatcagaaacctataccccaaaatatggcgcttcaacttgctgaactgaagaagccgctcaaggtctctgtgaccctccccagctccaccctctctcttccaaagcacaggataaaatcgttctctaaagaagaaaaactgaagcttgtcaacgcagctgggcagacttttgtcacaaactattctgtgggcccgccggactttgtcccaggccattgtatgtttttcaaatccattgataatcctaaagataatttactaacccctcaaaatcatccatacttccccatctccctttctcctaggaagagggtatataaggacctctacctcattgggtatgttacaatggctagatgactcagacttttttagttaatgctgccacaaagagtttgcaggggattggagatgtttactgtaaatttctcccaccatgtatttattcacaaatgaactaaaaaaaaaatcattcatgaacagtcctgagtgcctccagtacctgatatatgcctgaagaagttgattcctggatcactgtctagaaggtagggggtggggttggagaggcatacaggagaacagagacaatcagtgtggacaccaaaccttgagcatgatttctgtacaagtcagtaacattcagtgcacggtagaacagacacaggtactgaactcaacaactaagtcatcttcaaggcctatcaaagcaaagaagagacaggtcttgggatcccacctccaacaatcagtgattaatctcaaggcttcaaaatgtgtagtgcttgaagaccatctctaactttaaaatcataggtgcaaatctgccaatatttgtaaagaacattaaattatttagatttctagagtcccatatttccttttaattcttcattattggtgtatcaaaagtgctagaaacagtttctgtcccataaaacacacaaaatatatatgtgcaaaatgaaagaatgagagagtagtctgaaaagcagaccaaaatgtatgcataaaaaagtttatcagagcattatgtactaagctaaaaattactggaaataaaagtctttaaaacagagctctagtcacataagtcttatgatcaatatctattcatacaataaaatatgcaagatttgcatttattgaaatttaatgacatcagaaaatggaaccaatacaatacaaccctacaaaataggatataaaattactttat

SEQ ID NO: 463490 - DNA, 1852 bp, Homo sapiens
ttcagtggatgcagcagctgatgccgccaggtccaacagagtgacagtgttccctgttggaattggagatcgctacgatgcagcccagctacggatcttggccggcccagcaggcgactccaacatggtgaagctccagcaaatcgaagacctccctaccatggtcaccttgggcaattccttcctccacaaactgtgctctcgatttgttaggattcgcatggatgaggatgggaatgagaagaggcccggggacgtctggaccttgccagaccagtgccacaccgtgacttgccagccagatggccagaccttgctgaagagtcatcgggtcaactgtgaccgggggccgaggccttcatgccctaacagccagtcccctgttaaagtggaagacacctgtggctgccgctggacctgcccctattttgttaacctatcgaaaatcaagaatgcaacagctgcatgtgaaagatcaatagaggataaaaagtgttactgtgaacgacttaaaaggatacctgcagtatttcatgaagatgaaaatttatttctagtgaaggattttaagataagtatatttaactacagatttatcttacaacaacaagaagaagaaagaataaaggctgaagagttgtatgaaaaagatacagaagagttaaaaataatggaagagcaatataggacacaaactgaagtgaaaaaacaatctaaactgactctcaaatcattggaagtggaattgaagactgtaagaagtaactcaaatcagacttctcatactcatgaaaaagaaagagacctgtggcaggaaaatcacttgatgcgggatgaaattgccagactcaggctggaaatagacacaataaaacatcagaaccgggaaactgaaaataaatatttcaaagatattgaaattataaaggaaaacaatgaagaccttgaaaagactctaaagctgaatgaggaaacattaacaaaaacaataacctggtatagtaaagagcttaatgttctgatggatgagaatacaatgctcaattttgagctagagaaggaaaaacaaagcaccccaagactggaaacagaaatggaatcataccgttgtagactggctgctgccctatgtgatcatgatcaatgtcagtcattgaaaagagacctacagcttgctttccagagcacagtgaatgaatggtgtcatttacaagaaaatactaattctcacattcagattctttctcagcaactttctaaagctgagagtacatccagtggcctggaaactgagctccgttatgaaagagaggctctcaaagaaaagacgttgggtatagaacacatgcaaggagtcctaagccgaacacagtgtccattgaaggacattgaacacatgtaccaaaatgaccaacctattttggaaaaatatgtgagaaagcagcagtctatagaggatggactatttcaactacaaagccaaaatctgttgtatcaacagcaatgtaatgatgctcacaagaaagctgacaatcaggaaaaaacaataattaatatccaagtcaaatgtgaagatactgtagaaaaacttcaagctgagtgtagaaagctagaagagaacaataaggggttgatgaaggaatgcactcttttaaaagaaagacaatgccaatatgaaaaagagaaagaaaaaggagaaatgaaaaacctggtcgttatcctttgaccatgttttaattgattgcctttttgttgttgatttgtaagagttctttatatattctgaacaagaatgtatttttttacacttttttcataaactttgttctaaatcttgtattcttgtttctgc

SEQ ID NO: 463491 - DNA, 4679 bp, Homo sapiens
ggaattaactatggatctgaatgtcaggatgtggagatcacggaggaccactttggagattggccaccacacttcacatgttcaggaagcccagagtgctttgcaaatctgcctgacacatcctgagctgcagaatgaaatttgctgtcagcttattaaacagacaagacgaagacagccacagaatcaaccaggaccattgcagggctggcagctcttggcactctgcgttgggctcttccttccccatcatcctttcctgtggctcctcaggcttcacctaaagaggaatgcagattccaggacagaatttggaaaatatgccatttactgccagcgttgtgtagaaagaacgcaacaaaatggtgacagagaagcaagaccctcaaggatggaaattctttcaactcttctccgaaacccttatcaccattctttgccctttagtatacctgtgcacttcatgaatgggatataccaggtagttggttttgacgcatctaccacagtggaagaatttttgaatactttgaaccaggacacaggaatgaggaaaccagcgcagtctggatttgcgttgttcactgacgatccttctggcagagatttagagcattgtcttcaaggaaacatcaaggtgaaaccaagtccttttcaggagccaagcccaacgaacagcaaagaagctactctttacaagaagagtaaactttgcaagaagtttaattcaggagttttccaaaactttaaccaatctaatctccacgataagaaaaaaaaaatgcaggactttaaccacaagggaccttagagaaataatgcacttattttgcaaatgagaaagctgaggcctagagagggaaatgagttacccaaaatcaaatagctagacctgggtctagactctttccataaattatatgtcaaatttctttggtataactttagttattaaaatctttttgaactcggaaggtgaaaaacttgcttcttcagtgaccaaatcatggaaaaatccctggaatcttcttgtttccagtttcaggcagtcctacattacagttcctttttgagtaaaaaatgcgtggccacagtccaaagttaatgtgtgtccaaaaggataagtggaccaaatagcaatttataattacatactaaactcagagccgcacagaggctgaaaacaaaaagcttgagtatatttggtttgatcatattaattgaaaaatttcagtctgcagcacacttgtcttcaaaaaatgttgatttgaaaagtactgtaaatctcagttttccacttcctttctagatttgtgacattatttccaaatgggaacaggcttccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggtagagattggagattttgaaagacctttctcaactccagcagggcatgttaccaatcagtgcaaagtgaatcaaactctaaagcaagtcatagagaaattttatcctaaaaggtatagagatggctgttctgaagagcagttaaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcaccacctctctgctccagcactgctctcagcccagacccggggaccccaagccagaatgatgggaagccagcctcttctgtcaagcagcagaccgaccaaaggccccaccttactctgaaagctggggagcctgaacattcactccttgtcctccatgctgtggctgtatcagctccctacaagttcgtttacacctggcagcacggcagccacacaccggtattccaaaccttaacaatgaagggggttagtctcttttatttgattcttaaatattcaaataaatattaacagtaaaacataaacacaaaatttgccaacacactaattttcttatagagtaaatgagtaagaattcatcattttttccatctcccttctcccttgtcatcagacacattgtgcaatgtggcttttcttttcttttctttttttcccctttttaatattctggcaatctttagaaagggagattccaaactcccatttggtaaaccagttgattatttggaaatgttcactgccaaaatagtaagtgctataactaaatgcgcttttaattaatgatatagtgtttggaaaggagtagaacatgcagcataagaaactgctgcagagtggtgcgaggagtacattttcagagcaggtgcagtacatcttccggctctatgaatcattatgtgagaaagcaggataacattaggtaacctgagcctcctgtgtggtattagaaagtataccgtcaccttttcacatcactggagtgtaaaatttaaaacaagatggtgattcctgacattccttggctgtcagtgctgcccagattcagaagaatattgcccacatttcactgtatttggtgctgggtcattttgaccttgctttgttaataatatctttaaaaacaaagacaatccttaaagctttgctcctcacacattaccttctaattatagtttgaaaatagattccctacacatacatacatatgtatgcacagatagggtcttgctatgttgcccaggctggtcttgaactcctggcctcaagcaatcctctctcctcagcctcccaaagtgctgggattacaagtgtgagccaccacacctggctccagaaattttattttatttttttgaggcagggtctcactctggttgcccaggctggagtgcagtggtgccatcatagctcactgtagcctcgaccttccgggatcaagcaatcccacttcagcctcttgaatagctgggactagaagcatgcaccaccatgcccatctaatatttgtatttttagtagagacaggatctccctatgttgtccagcctagtctcaaactcctgggttcaagcaatcctcccacctcggcctcccaaagtgctgggattgcaggcatgagccaccgtgcccagcctcaaaaatattttttaaaagaaaagagaaaataattcttctgtcaaaggaggttaaattttagttgatagagtacttaaatgcattactttattaggttatgtaagtggtcagtgcattccagtatgtgtcacaacagtgtagttcatattcatgataaaaatgaaactgtgataagacatgaaaattatattattaaaatgttcaattgtaatggtaatcatgagtatacttaattttatttatgtatagaatatttgtatttattttttggacatatatttatcactttgtcattttttttaaccaatttgagaaatgttagctgctgaattaatttgttgcccgagccttcatattttcttctttgctgccttctccctgtggcaatgtactgttctcacattaagccttttaaaaatgttccatactgtattagcatccttagaagggacagaactaagaaatacattgctcaaataatattttactttattgataatgacaaaaagaatattttttaaaccccatcaaaatagatttcaattgactgtttcccctacatcttttgagccacagtcgcccatcgaataagcaaatttgtttttgagaataaactggtaaccagtttgtgatgactctcagaagccttttggctgggttacagaagagtttctaagttcctagagagccatttaataattagttggtgagccagaggcttgacagagctgttacttatgtgtgagggctttattctcaggcagtagtttattcatcatttggtaagcccctccccacactcctctaatttaaacaagtagtgaaggcttatcttaaactgtgtagtaccttagacttggcatttatttttgatagagcagagataaaatattttgatggaaggaaatcaattttctgtaactgatgatgtgaaaattttattttctgggaaattatatagccattcaaaaattcaaagtatgttattatgattggttacaagagaataatgttacatgtttaattgtaatatttgtctcctatcattttcttccctttcagtcataataaatgatttacaaaacccattttgagcattatcttttgaataatcttcaagaaatacctaatgttttcattgt

SEQ ID NO: 463492 - DNA, 451 bp, Homo sapiens
ggcaaggctacggttcgcgccagcggccggcgctatggggctgagccgcgtgcgggcggttttctttgacttggacaacactctcatcgacacggccggggcgagcaggagaggcatgttggagatggggtctcgatatgttgctcatgctggtcctgaactcctaaactcaagtgatcctgccaccttggccttccaaagtgctgggattacaggcatgagccaccatgcccggcccaaaaagcacaagttttattttcatatcttcatgaccagaatgaaagatgttggactctaaactaccaaacaaaggattgttactagctatatatgaagaagttggctttaaaaaatgagtgagttctagagcagttgggagagcctcactttgttgtctctaaaaataaggccaattcccaccagaaacggtgtagttagtagctgctttaaa

SEQ ID NO: 463493 - DNA, 1323 bp, Homo sapiens
cggacgcgtgggtcgacccacgcgtccgaaatatatcattgttttgcaaatttctatatctaattcagggtttaccaggagcttaataattaatggctacatagcaaggcatcgtcttggaaccggagaattttctctagactattaggctagacagtctcatgattatactaaccaaacctggagtaaagtggttgaaaaaaaagaaagtataaaggggcttattaaagtggttaataaatatgatttaggttggtttttgatatgtttttcttccaactgttatataagaaactactaatgtaaaatagtaggctatatgttgggatgtgtatagctatgtcttcaagactaatactcagagaatcaaattgtagattgtacctatctgtgagcctatttctttagccagttttctgtctactgccaagaaacagaattctctgcctcatgcaaatgccctttcgtgtttacttttcgctctagatttttaaaaatgtgattgtgcccttgactgtaccaaagtgctgttgctataacagtgaacatttgtgaacagaggatgtttgtagtttcaaatgcagtacccatatgaccttgatcatattttagctatttaaaaattaagttggaggattttggcagaagtagtcacatgcatgattgctctgatagattggttggcgtgtgctgcagggggcttgtccttttaactctcccacaggatggatgtaggcagtgtcacattcattatgctgagagtgaaggttcatcactcctgtatcatggtagcaaatctcaacaggatagcttctaggatgttaagtgagcagttctccagcagaaatgatgtagaaggaaaaaattgaataattaaatttccttgtcttcacagtttgtattctacagagtacagtaatgtattacattccatttgcacccttccttagggaagaactttgtggttatctaccttctgagtggaatgttacagaaaatattttaaaatattggaataaacctatgattttattaatattttttgttttagaataatattccttaaaattatgggtgatgttttgtcatctttattttttttcaaagtttccctgtagtggccttctcacacaaagccagaggccctccctaacactgcttacagaggtgggcctagaacagacatgaatggacactgcacctggaataccagcacctggtggggaggtttggttccatgtgcacctccacatacaaggcacgaacatctcagatctgggagtgcccaggacccatgatttttatttgagtcgctgctaaatc

SEQ ID NO: 463494 - DNA, 3418 bp, Homo sapiens
ggcaaggctacggttcgcgccagcggccggcgctatggggctgagccgcgtgcgggcggttttctttgacttggacaacactctcatcgacacggccggggcgagcaggagaggcatgttggaggtgataaaactcttacaatcaaaataccattataaagaagaggctgaaatcatctgtgataaagttcaagttaaactcagcaaggaatgttttcatccttacaatacatgcattactgatttaaggacttcacattgggaagaagcaatccaggaaacaaaaggtggtgcagccaatagaaaattggctgaagaatgttatttcctttggaaatctacacgtttacagcatatgacactagcagaagacgtcaaagccatgcttactgaacttcgaaaggaggtccgcctacttctattaacgaatggggacagacagacccagagggagaagattgaggcttgtgcctgtcagtcctattttgacgctgttgttgtaggtggagagcagagagaggagaaaccagcaccgtccatattttattactgctgcaatcttctcggagtacaacctggggactgtgtgatggtcggtgacacattagaaaccgacatccaaggaggcctcaatgcaggattgaaagcaacagtctggatcaataaaaatggaatagtgccactgaagtcctccccagttccgcattacatggtttcttctgtgctagagttacctgctctcttacaaagtatagactgcaaagtcagtatgtccacttaaagcacataaaagggcatgattatgaatgttagaatcaatttgctgagtatgaaataagaaaagttagggcactccacttatgataatccagctctaagaataattttacttatgatttaatggccaatattttgaaggtcttcccaaccctattgcttctaagttgtaacaaccaaccattgagtggtacttatatctgaaaattcagattgcatgaattcaggtcagtagtatagcccagaaaatttaaggaaatatattatttgttagtctgtatctggagctttttaaaattatgttattaatcttttagtatcttggctgcataatgccaagcaggattgctttacacatggatgcacaaatgtaaggtttatcttctggcttaaaaatagatatttttaaaaaatagattttctaaaacacagatttatgaaagcaagtgaatctggttaatatgaaataagtactaagtcacatgcaaatcaaggtattatatagtgaaattattttgcatattttgaaaacataaaccatagtttttgcctactttggatgtatactttcttttatgaacctgatttttctgtatgacatttttttttttttcagagggcagggagcaatttttctatggcatgtgacagattcctccagttagaaaaagctgttaaaatcaacacatggtgctcctttaccgtgacattttctcacctgtgcacagtgagccggtagcttccttttagtcttcacctctcaaggaaatgtttttactgtcttttcccagacacacagtggggttgagggagctaggctgttttgctagagataattgcaaggcacgtggcactaaaagtcatttttcttctgtggatccataagaggaacatttcctcagtgtagcctaacaatgcagcccccaatctgttcctttttttttttgaaatgggatctctgtcgcccaggttggagtgccatggcaccatctcggctcactgcaacctctgcctcctgagctcaagtgatcctcccacctcagcctcccaagggtgtgtgtgactacaagtacacactaccacgcccagctaatgtgtgtttttgtagagatgggattttgccatgttgcccaggctggtctcgaattcctggattcaagtgatcctcccacctcagcctcctaaagtcctaggattataggcatgagccactgtgcctggccccctcatctgatagaaaattagattttgctatgagccatttcctgagggccaatttaatactcgtgtgactcttcttagagttaccatctgccttaaatttcctctgtttttcacattcttggaaatatatcattgttttgcaaatttctatatctaattcagggtttaccaggagcttaataattaatggctacatagcaaggcatcgtcttggaaccggagaattttctctagactattaggctagacagtctcatgattatactaaccaaacctggagtaaagtggttgaaaaaaaagaaagtataaaggggcttattaaagtggttaataaatatgatttaggttggtttttgatatgtttttcttccaactgttatataagaaactactaatgtaaaatagtaggctatatgttgggatgtgtatagctatgtcttcaagactaatactcagagaatcaaattgtagattgtacctatctgtgagcctatttctttagccagttttctgtctactgccaagaaacagaattctctgcctcatgcaaatgccctttcgtgtttacttttcgctctagatttttaaaaatgtgattgtgcccttgactgtaccaaagtgctgttgctataacagtgaacatttgtgaacagaggatgtttgtagtttcaaatgcagtacccatatgaccttgatcatattttagctatttaaaaattaagttggaggattttggcagaagtagtcacatgcatgattgctctgatagattggttggcgtgtgctgcagggggcttgtccttttaactctcccacaggatggatgtaggcagtgtcacattcattatgctgagagtgaaggttcatcactcctgtatcatggtagcaaatctcaacaggatagcttctaggatgttaagtgagcagttctccagcagaaatgatgtagaaggaaaaaattgaataattaaatttccttgtcttcacagtttgtattctacagagtacagtaatgtattacattccatttgcacccttccttagggaagaactttgtggttatctaccttctgagtggaatgttacagaaaatattttaaaatattggaataaacctatgattttattaatattttttgttttagaataatattccttaaaattatgggtgatgttttgtcatctttattttttttcaaagtttccctgtagtggccttctcacacaaagccagaggccctccctaacactgcttacagaggtgggcctagaacagacatgaatggacactgcacctggaataccagcacctggtggggaggtttggttccatgtgcacctccacatacaaggcacgaacatctcagatctgggagtgcccaggacccatgatttttatttgagtcgctgctaaatc

SEQ ID NO: 463495 - DNA, 5254 bp, Homo sapiens
taaacttgaataaaaaagcaaatcttgtgagaaatgtacaccaacaacgagatcgattttaacagtgagcaaaaagtttttaaagaaattagtggaaaaaatataggaaagttgaaacacattctgctggtctgcaccctgaccaaggaagacaatcgctgcgtgggcaagattcccgaggatgagcagctgcatgttctccccctgtacaagatggccaacacggatgagtttggtagcgaggagaaccagaatgcaaaggtgggcagcggagccatccaggtgctcaccgccttcccccgcgaggtccgacgcctgcccgagcctgccaagtcctgccgccagcggcagctggaagccagaaaggcagcagccgagaagaagaagattcagaaggagaagctgagcactccggagaagatcaagcaggaggccctggagctggcgggcattacgtcggacccaggcctgtctctgaagggtggattgtcccagcaaggcctgaagccctccctcaaggtggagccgcagaaccacttcagctccttcaagtacagcggcaacgcggtggtggagagctactcggtgctgggcaactgccggccctccgacccttacagcatgaacagcgtgtactcctaccactcctactatgcacagcccagcctgacctccgtcaatggcttccactccaagtacgctctcccgtcttttagctactatggctttccatccagcaaccccgtcttcccctctcacttccgggtgccttgagtaagagctgagaaccggcctgctgggtgtttactgtatctgtttggaagcactggcggagggtcgttgtaagatgtcctgagcatttatgtggtctggttttaactgtaaatagtgaaagatttttttaagcacttttgcctagatttaaacagcaacttgaaaaaaaaagtatgttttaacatgtaattgtgggagaaattgtaaatagtagccgaatatttaatgtgctttgtctatcctccacttttaccatattctgtaaagttgcatttattttacaggacaaaaaaatgaaatattattgcttttgaaataaatacccaagagcttatcaggacttagaattattcagaactcagatttataggaaaacctctgaccttcagtttgacaagctaaaggaagcagagtctttaatgagcatgctaattttctagttttgaggaaaaattgggtcctttaaatgctattttgcttatcgcatcagtacttttatgcaggtctcatttgactccgtgcttaggtagatgcgggggtgccttgaaaacttcattttaaatgatcttaagcaagaaatacaatattttacgaaacatttggagaatgtgaccgtctgtatgacccgtggaagccccaggttggctgttggtttggaaggtcccgagtgtaacccaggtgattctgatacttggcatgtgtgaatcttcctgatgtatgttaaataaactcttcccctcatcaccctttggtaggaaagccattagatgaaaggagaaaccaatacaagctaaaagcatgcgacgtctgtcccccagcccaaacagccttggttcatcagtttctgcagtaggagataggctgctgagaggtgagtcaagaggcagtctccattggatgtccccactccccgcagaatggcgtttccagagttaggcggtgtggttgccgtgctcaagcccatgctgatttgtacactacatgtctaacctacctcaaatctcagtcattaaaattagcatgctttagacatatatttaaaaagtaactatgcacagctctttatcccccccttgctgctgaagctttcttaaagagaaaaatcaaatttttattttttactggcactatcattttttaagtcctaaagatgattaacagacatttttatcatgagaagaaaaataaagccattgcaactaaagaacctaacagcatgaccaagttcgaagagtcatattatagcaacggaaatcgatggcgtcttagtcatctccccagtgtgccctgtccacggacaccatccacgtgcagtgcaaacatttggttccttttctgctctgttttgttttccctgcctgttgcgtgcaagggaagtgcttgtaaagttctgtgctacgagatttttaaaataaaaatcgcttcgcagcaggttctcacaaaataactggtgctagctcaagaaatcatcatctgaccatcagaaatcttgactaaaggtgttgcatggatttgggggtctttcggtttttggttttgggtctggcttttagcagggccaatgtttcccacaccccggcttcatgggtactgctttgccttctcaccaaggtgacgatggtgtgcgtggaaagagatgataccccaccgccccctcttggtccttccaccagcctcttttgggaacagtagtttgcagagcaagggatttttaaagcgctaaaggaaagaagtagcagagcttaactgctttgtaccacacagcagtagatgtgcaaggacggttgacaatgagtcgatgataacctaatttcattgagagaaacccagccagacttgcttctagaggtttaatcaccatgagatctcaaaccaaggcaaagctggtggaaaactatatgatatccctgacgtgcctcaaccagtatctctttccttttgttactgaagtgtgttttatggactaggaagcatttttatgaattgaaatagtctaaataaaatggtgctatggtgttttaatgtgactgtccctgatcctgtcttgctgaggtgctatcaacgttctgaaaccacaaccaaccaaaaacaaggtgggctccagtctcttggctttttttttttccctcccctcttttggtgctgtcttagacccgtttaccgtgctataatctgctctgagcagtgttgtgttgtgttgtattgttcttcccttggtggccaaacaaagcaagtcgagaaggcagctatctccctttctgtgatcgggagtgggcctgcctggcttggcaggtgctttttggttccacacctgtcttctcaggcttgatgtgaaagaaagggcgaagggttttttgagtttttgtttttgaggaaggggagttgggtacttctgcctctcctagcatgataggcattctcatagccagggacagattttctcctgcagcccagggtgctaagcagacatctctgggagtcccaagggcacaccaagggagaccagatggatctccttcctcccctggcactggctgggaccatggtgggcaggggcttcattctctgacccagcgttgcttctgcctctcattggtaaccccttatgttcggactaaaggaaggagctttctttgctcactcgatgccactgaggctgctttttagttggtgctaacctaaatttcttcttgggtccacagaagttgatgttttaaaaactcaccaggaagctccattttgtgtcatccactgtcacaataatttttttaaatacctcaaaaacaggacatcatgacaacttcagtaaagtagattccatgagggtctgatacctgcaggttgtccgtctgatgacatacttgaccttgaaaaatctggggtcattttgtttttcattcttcagcagttaagatagcggaacgccgaaaggaaggagcgtagttggctgtatttcatgtttaagttttgcttttgaataaaatgtgaatttcctatgcccatctcattgagctttctcagtcattgttgctgtcatttgaaatgactccctcaaaacctagttttattagccagctgcctctgctgtagtacatggccaacttcaacataccctggaccaaaacatttttgaggtgcatacccccaacataagttacacagtcccacatccaggtgcacagagtgcgagtgcactccgcgagtgcggggggaggggcggccccctctggtgctcccagcccttcctcctgcagagctgcaggcaagagcagagcaataggcttctcccctgagcagagaccgcagcacagaaatgcaaggtctaaagttgctttttgcctaagaatcagcgagcgatttggcctacttcctcattggcttctattctgatatcagggatgctttttgtagtggtattgtttgctccctcttcgcgttttgactacccgtcattcaggggtaactcatcactcttcacacggggatttaaattaagaaactaattggctcatgtgaacattccaaattttcttggtttcaataccctttttttttcttttgaggggaaaagaggggagaaaaacaggagtgatgtcatttctttttcatgtattccaattaaagaaacaagggcaggtcgtataatggcatattaatacattagacttaatctagaacccctgtagctttttgatgtgttttatttcttatctctttgaattcctgtttggttacttggcttccaatggaggtgaacttaacaaccatacttgaatattccgtcttgactttgtaaactgtggctacttgaaatgaagtttatctggggttgatggatgaatggtagatttttgcaatgtctcaaggcaataggatgtgtattaaactgtagatattcttagtacagtaaatttatgctgataattttattttgtataatttttacctttttgttaatattttttccttccactttattggtttgcctcctgagctacccctccttaccctcccttctccctcagtgtttcagtaaatttaatttagggtgcctagaaattgcaagtatgtatcctttttgatttgtattttattataatttacacaaacaactgggtttgtgaactgtattactcctggtatctttaaaatattgtgggtgttttaataaattttatatttattttttgcactcaaattcagtgtgggttctctttttccccttcttgaaccaggactggaatgtgatgtgtcaggtaccctgtaacctcacccacccaccgtatgttgtagatgtacaaatgaagccctcactaatagcagcagcggaacctggccttgtccattctgccacctggataaaggaatgttcagaggctatcagctgttaaaacgggatctaaagggagaaaatagagatggcctttttctcatctatgtttctctttttgttttctttcccttttatgtttttttgtcc

SEQ ID NO: 463496 - DNA, 453 bp, Homo sapiens
gctcggtaccccagaagatcacctccattttgtgtcatccactgtcacaataatttttttaaatacctcaaaaacaggacatcatgacaacttcagtaaagtagattccatgagggtctgatacctgcaggttgtccgtctgatgacatacttgaccttgaaaaatctggggtcattttgtttttcattcttcagcagttaagatagcggaacgccgaaaggaaggagcgtagttggctgtatttcatgtttaagttttgcttttgaataaaatgtgaatttcctatgcccatctcattgagctttctcagtcattgttgctgtcatttgaaatgactccctcaaaacctagttttattagccagctgcctctgctgtagtacatggccaacttcaacataccctggaccaaaacatttttgaggtgatcttctgggatcctgtagagtcact

SEQ ID NO: 463497 - DNA, 8180 bp, Homo sapiens
taaacttgaataaaaaagcaaatcttgtgagaaatgtacaccaacaacgagatcgattttaacagtgagcaaaaagtttttaaagaaattagtggaaaaaatataggaaagttgaaacacattctgctggtctgcaccctgaccaaggaagacaatcgctgcgtgggcaagattcccgaggatgagcagctgcatgttctccccctgtacaagatggccaacacggatgagtttggtagcgaggagaaccagaatgcaaaggtgggcagcggagccatccaggtgctcaccgccttcccccgcgaggtccgacgcctgcccgagcctgccaagtcctgccgccagcggcagctggaagccagaaaggcagcagccgagaagaagaagattcagaaggagaagctgagcactccggagaagatcaagcaggaggccctggagctggcgggcattacgtcggacccaggcctgtctctgaagggtggattgtcccagcaaggcctgaagccctccctcaaggtggagccgcagaaccacttcagctccttcaagtacagcggcaacgcggtggtggagagctactcggtgctgggcaactgccggccctccgacccttacagcatgaacagcgtgtactcctaccactcctactatgcacagcccagcctgacctccgtcaatggcttccactccaagtacgctctcccgtcttttagctactatggctttccatccagcaaccccgtcttcccctctcagtgtcctgggtcctggtgcctgggggcacagtggcagcagtggcagttttgagaagaagccagacctccacgctctgcacaacagcctgagcccggcctacggtggtgctgagtttgccgagctgcccagccaggctgttcccacagacgcccaccaccccactcctcaccaccagcagcctgcgtacccaggccccaaggagtatctgcttcccaaggcccccctactccactcagtgtccagggacccctccccctttgcccagagctccaactgctacaacagatccatcaagcaagagccagtagacccgctgacccaggctgagctgtgcccagagacgctggcaagatgggcaagacacctctgtccgaggtgtctcagaatggaggacccagtcacctttggggacagtactcaggaggcccaagcatgtcccccaagaggactaacggtgtgggtggcagctggggtgtgttctcgtctggggagagtcctgccatcgtccctgacaagctcagttcctttggggccagctgcctggccccttcccacttcacagatggccagtgggggctgttccccggtgaggggcagcaggcagcttcccactctggaggacggctgcgaggcaaaccgtggagcccctgcaagtttgggaacagcacctcggccttggctgggcccagcctgactgagaagccgtgggcgctgggggcaggggatttcaactcggccctgaaaggtagtcctgggttccaagacaagctgtggaaccccatgaaaggagaggagggcaggattccagccgcaggggccagccagtggtcttctaccagcacaagaacctcaaccagcccaaccacgggctggccctctgggaagccaagatgaagcagctggcggagagggcacgggcacggcaggaggaggctgcccggctgggcctgggccagcaggaggccaagctctacgggaagaagcgcaagtgggggggcactgtggttgctgagccccagcagaaagagaagaagggggtcgtccccacccggcaggcactggctgtgcccacagactcggcggtcaccgtgtcctcctatgcctacacgaaggtcactggcccctacagccgctggatctaggtgccagggagccagcgtacctcagcgtcgggcctggcccgagctgtctctgtggtgcttttgccctcatacctgggggcgggttgggggtgcagaagtctttttatctctatatacatatatagatgcgcatatcatatatatgtatttatggtccaaacctcagaactgacccgcccctcccttacccccacttccccagcactttgaagaagaaactacggctgtcgggtgatttttccgtgatcttaatatttatatctccaagttgtccccccccttgtctggggggtttttatttttattttctctttgtttttaaaactctatccttgtatatcacaataatggaaagaaagtttatagtatcctttcacaaaggagtagttttaaattccatttaaaatgtgtatttattggattttttaaaagcgacaatagtaatggtaaaggatgggcaggaaaggccagtagtgctcccccgcccagtctcgctgggtctggcgagccaagcccctcgggcgctggcgaggtcctcagccatctgcccctcgagagccaagcgcggacggtagccacccagttcatccctcccgacatacaccccttccctttggggaagggagcctcaggacagcttctgtcctctctgataggatgggagagtctgcagaaaaccatctggggtcccttttccagtccccggcttggagtcgaagggcagatgcaccccaggccagccccacgagatgctggcatagctttccccagaaaccaggttggaagtagatggcttcaagcttgctagtctccacactgaatcctctgtccgttatttatggagtcacacgatgtcatggttcactaggcagcacctcacgctggagctggagtgcgaggttcttaggggccgtgcacccatgttgccaagccaatgcatgctgagctgaaggaatttgtcttagtggcagttttttaaaaaatgcccccaaagtctatgctgatactgaaaaagggctactgtatctttaaaaacaggaagttgaacccaagctgtgaaaagccagtggtgctctgtgcatggtgctgtgcggagcctgggtgctgtagtgttgtgctgggactttcttgactcttgggcaggtcacatcctacaggagctcagcagaccagtgtaacaacagttaatgcatctatcctgatccctgaatttccacattggacaatggtgcatgcctcacacctgagcctgcttcctccatgctgtcattgggttcgggggcctacacttaacaattttaaagtgcaagagtcaaacattttcaacaggttgctataattttcctccctaattggtgccatttctccatttgatcattttctttttttcctttctcccctcttcatccactttaatatagctgttctgaaattctggtgcattcattcggttctttgaaatgagaatgtggtgcttaatttttgtgacgttgtcgagagaggttgggcctgatgggagcaacactcatcatcaccaagtcaaactttgttggagtgttggtttttcttgtgatattagcagaaatgatctcatgctagccatgtggatgtgtgtgtggtgaatggggggcttcatcaggacacacagaggggaatgtggccacacggtggatgaccaccaagccctgagatgaacaggtatttactgagcagttgtattcagatatgggtcttcatgaatcatgtttaacaatcagatgaccgctataggcaagttcctgagcttccgggtgccttgagtaagagctgagaaccggcctgctgggtgtttactgtatctgtttggaagcactggcggagggtcgttgtaagatgtcctgagcatttatgtggtctggttttaactgtaaatagtgaaagatttttttaagcacttttgcctagatttaaacagcaacttgaaaaaaaaagtatgttttaacatgtaattgtgggagaaattgtaaatagtagccgaatatttaatgtgctttgtctatcctccacttttaccatattctgtaaagttgcatttattttacaggacaaaaaaatgaaatattattgcttttgaaataaatacccaagagcttatcaggacttagaattattcagaactcagatttataggaaaacctctgaccttcagtttgacaagctaaaggaagcagagtctttaatgagcatgctaattttctagttttgaggaaaaattgggtcctttaaatgctattttgcttatcgcatcagtacttttatgcaggtctcatttgactccgtgcttaggtagatgcgggggtgccttgaaaacttcattttaaatgatcttaagcaagaaatacaatattttacgaaacatttggagaatgtgaccgtctgtatgacccgtggaagccccaggttggctgttggtttggaaggtcccgagtgtaacccaggtgattctgatacttggcatgtgtgaatcttcctgatgtatgttaaataaactcttcccctcatcaccctttggtaggaaagccattagatgaaaggagaaaccaatacaagctaaaagcatgcgacgtctgtcccccagcccaaacagccttggttcatcagtttctgcagtaggagataggctgctgagaggtgagtcaagaggcagtctccattggatgtccccactccccgcagaatggcgtttccagagttaggcggtgtggttgccgtgctcaagcccatgctgatttgtacactacatgtctaacctacctcaaatctcagtcattaaaattagcatgctttagacatatatttaaaaagtaactatgcacagctctttatcccccccttgctgctgaagctttcttaaagagaaaaatcaaatttttattttttactggcactatcattttttaagtcctaaagatgattaacagacatttttatcatgagaagaaaaataaagccattgcaactaaagaacctaacagcatgaccaagttcgaagagtcatattatagcaacggaaatcgatggcgtcttagtcatctccccagtgtgccctgtccacggacaccatccacgtgcagtgcaaacatttggttccttttctgctctgttttgttttccctgcctgttgcgtgcaagggaagtgcttgtaaagttctgtgctacgagatttttaaaataaaaatcgcttcgcagcaggttctcacaaaataactggtgctagctcaagaaatcatcatctgaccatcagaaatcttgactaaaggtgttgcatggatttgggggtctttcggtttttggttttgggtctggcttttagcagggccaatgtttcccacaccccggcttcatgggtactgctttgccttctcaccaaggtgacgatggtgtgcgtggaaagagatgataccccaccgccccctcttggtccttccaccagcctcttttgggaacagtagtttgcagagcaagggatttttaaagcgctaaaggaaagaagtagcagagcttaactgctttgtaccacacagcagtagatgtgcaaggacggttgacaatgagtcgatgataacctaatttcattgagagaaacccagccagacttgcttctagaggtttaatcaccatgagatctcaaaccaaggcaaagctggtggaaaactatatgatatccctgacgtgcctcaaccagtatctctttccttttgttactgaagtgtgttttatggactaggaagcatttttatgaattgaaatagtctaaataaaatggtgctatggtgttttaatgtgactgtccctgatcctgtcttgctgaggtgctatcaacgttctgaaaccacaaccaaccaaaaacaaggtgggctccagtctcttggctttttttttttccctcccctcttttggtgctgtcttagacccgtttaccgtgctataatctgctctgagcagtgttgtgttgtgttgtattgttcttcccttggtggccaaacaaagcaagtcgagaaggcagctatctccctttctgtgatcgggagtgggcctgcctggcttggcaggtgctttttggttccacacctgtcttctcaggcttgatgtgaaagaaagggcgaagggttttttgagtttttgtttttgaggaaggggagttgggtacttctgcctctcctagcatgataggcattctcatagccagggacagattttctcctgcagcccagggtgctaagcagacatctctgggagtcccaagggcacaccaagggagaccagatggatctccttcctcccctggcactggctgggaccatggtgggcaggggcttcattctctgacccagcgttgcttctgcctctcattggtaaccccttatgttcggactaaaggaaggagctttctttgctcactcgatgccactgaggctgctttttagttggtgctaacctaaatttcttcttgggtccacagaagttgatgttttaaaaactcaccaggaagctccattttgtgtcatccactgtcacaataatttttttaaatacctcaaaaacaggacatcatgacaacttcagtaaagtagattccatgagggtctgatacctgcaggttgtccgtctgatgacatacttgaccttgaaaaatctggggtcattttgtttttcattcttcagcagttaagatagcggaacgccgaaaggaaggagcgtagttggctgtatttcatgtttaagttttgcttttgaataaaatgtgaatttcctatgcccatctcattgagctttctcagtcattgttgctgtcatttgaaatgactccctcaaaacctagttttattagccagctgcctctgctgtagtacatggccaacttcaacataccctggaccaaaacatttttgaggtgcatacccccaacataagttacacagtcccacatccaggtgcacagagtgcgagtgcactccgcgagtgcggggggaggggcggccccctctggtgctcccagcccttcctcctgcagagctgcaggcaagagcagagcaataggcttctcccctgagcagagaccgcagcacagaaatgcaaggtctaaagttgctttttgcctaagaatcagcgagcgatttggcctacttcctcattggcttctattctgatatcagggatgctttttgtagtggtattgtttgctccctcttcgcgttttgactacccgtcattcaggggtaactcatcactcttcacacggggatttaaattaagaaactaattggctcatgtgaacattccaaattttcttggtttcaataccctttttttttcttttgaggggaaaagaggggagaaaaacaggagtgatgtcatttctttttcatgtattccaattaaagaaacaagggcaggtcgtataatggcatattaatacattagacttaatctagaacccctgtagctttttgatgtgttttatttcttatctctttgaattcctgtttggttacttggcttccaatggaggtgaacttaacaaccatacttgaatattccgtcttgactttgtaaactgtggctacttgaaatgaagtttatctggggttgatggatgaatggtagatttttgcaatgtctcaaggcaataggatgtgtattaaactgtagatattcttagtacagtaaatttatgctgataattttattttgtataatttttacctttttgttaatattttttccttccactttattggtttgcctcctgagctacccctccttaccctcccttctccctcagtgtttcagtaaatttaatttagggtgcctagaaattgcaagtatgtatcctttttgatttgtattttattataatttacacaaacaactgggtttgtgaactgtattactcctggtatctttaaaatattgtgggtgttttaataaattttatatttattttttgcactcaaattcagtgtgggttctctttttccccttcttgaaccaggactggaatgtgatgtgtcaggtaccctgtaacctcacccacccaccgtatgttgtagatgtacaaatgaagccctcactaatagcagcagcggaacctggccttgtccattctgccacctggataaaggaatgttcagaggctatcagctgttaaaacgggatctaaagggagaaaatagagatggcctttttctcatctatgtttctctttttgttttctttcccttttatgtttttttgtcc

SEQ ID NO: 463498 - DNA, 7542 bp, Homo sapiens
taaacttgaataaaaaagcaaatcttgtgagaaatgtacaccaacaacgagatcgattttaacagtgagcaaaaagtttttaaagaaattagtggaaaaaatataggaaagttgaaacacattctgctggtctgcaccctgaccaaggaagacaatcgctgcgtgggcaagattcccgaggatgagcagctgcatgttctccccctgtacaagatggccaacacggatgagtttggtagcgaggagaaccagaatgcaaaggtgggcagcggagccatccaggtgctcaccgccttcccccgcgaggtccgacgcctgcccgagcctgccaagtcctgccgccagcggcagctggaagccagaaaggcagcagccgagaagaagaagattcagaaggagaagctgagcactccggagaagatcaagcaggaggccctggagctggcgggcattacgtcggacccaggcctgtctctgaagggtggattgtcccagcaaggcctgaagccctccctcaaggtggagccgcagaaccacttcagctccttcaagtacagcggcaacgcggtggtggagagctactcggtgctgggcaactgccggccctccgacccttacagcatgaacagcgtgtactcctaccactcctactatgcacagcccagcctgacctccgtcaatggcttccactccaagtacgctctcccgtcttttagctactatggctttccatccagcaaccccgtcttcccctctcagtgtcctgggtcctggtgcctgggggcacagtggcagcagtggcagttttgagaagaagccagacctccacgctctgcacaacagcctgagcccggcctacggtggtgctgagtttgccgagctgcccagccaggctgttcccacagacgcccaccaccccactcctcaccaccagcagcctgcgtacccaggccccaaggagtatctgcttcccaaggcccccctactccactcagtgtccagggacccctccccctttgcccagagctccaactgctacaacagatccatcaagcaagagccagtagacccgctgacccaggctgagctgtgcccagagacgctggcaagatgggcaagacacctctgtccgaggtgtctcagaatggaggacccagtcacctttggggacagtactcaggaggcccaagcatgtcccccaagaggactaacggtgtgggtggcagctggggtgtgttctcgtctggggagagtcctgccatcgtccctgacaagctcagttcctttggggccagctgcctggccccttcccacttcacagatggccagtgggggctgttccccggtgaggggcagcaggcagcttcccactctggaggacggctgcgaggcaaaccgtggagcccctgcaagtttgggaacagcacctcggccttggctgggcccagcctgactgagaagccgtgggcgctgggggcaggggatttcaactcggccctgaaaggtagtcctgggttccaagacaagctgtggaaccccatgaaaggagaggagggcaggattccagccgcaggggccagccagtggtcttctaccagcacaagaacctcaaccagcccaaccacgggctggccctctgggaagccaagatgaagcagctggcggagagggcacgggcacggcaggaggaggctgcccggctgggcctgggccagcaggaggccaagctctacgggaagaagcgcaagtgggggggcactgtggttgctgagccccagcagaaagagaagaagggggtcgtccccacccggcaggcactggctgtgcccacagactcggcggtcaccgtgtcctcctatgcctacacgaaggtcactggcccctacagccgctggatctaggtgccagggagccagcgtacctcagcgtcgggcctggcccgagctgtctctgtggtgcttttgccctcatacctgggggcgggttgggggtgcagaagtctttttatctctatatacatatatagatgcgcatatcatatatatgtatttatggtccaaacctcagaactgacccgcccctcccttacccccacttccccagcactttgaagaagaaactacggctgtcgggtgatttttccgtgatcttaatatttatatctccaagttgtccccccccttgtctggggggtttttatttttattttctctttgtttttaaaactctatccttgtatatcacaataatggaaagaaagtttatagtatcctttcacaaaggagtagttttaaattccatttaaaatgtgtatttattggattttttaaaagcgacaatagtaatggtaaaggatgggcaggaaaggccagtagtgctcccccgcccagtctcgctgggtctggcgagccaagcccctcgggcgctggcgaggtcctcagccatctgcccctcgagagccaagcgcggacggtagccacccagttcatccctcccgacatacaccccttccctttggggaagggagcctcaggacagcttctgtcctctctgataggatgggagagtctgcagaaaaccatctggggtcccttttccagtccccggcttggagtcgaagggcagatgcaccccaggccagccccacgagatgctggcatagctttccccagaaaccaggttggaagtagatggcttcaagcttgctagtctccacactgaatcctctgtccgttatttatggagtcacacgatgtcatggttcactaggcagcacctcacgctggagctggagtgcgaggttcttaggggccgtgcacccatgttgccaagccaatgcatgctgagctgaaggaatttgtcttagtggcagttttttaaaaaatgcccccaaagtctatgctgatactgaaaaagggctactgtatctttaaaaacaggaagttgaacccaagctgtgaaaagccagtggtgctctgtgcatggtgctgtgcggagcctgggtgctgtagtgttgtgctgggactttcttgactcttgggcaggtcacatcctacaggagctcagcagaccagtgtaacaacagttaatgcatctatcctgatccctgaatttccacattggacaatggtgcatgcctcacacctgagcctgcttcctccatgctgtcattgggttcgggggcctacacttaacaattttaaagtgcaagagtcaaacattttcaacaggttgctataattttcctccctaattggtgccatttctccatttgatcattttctttttttcctttctcccctcttcatccactttaatatagctgttctgaaattctggtgcattcattcggttctttgaaatgagaatgtggtgcttaatttttgtgacgttgtcgagagaggttgggcctgatgggagcaacactcatcatcaccaagtcaaactttgttggagtgttggtttttcttgtgatattagcagaaatgatctcatgctagccatgtggatgtgtgtgtggtgaatggggggcttcatcaggacacacagaggggaatgtggccacacggtggatgaccaccaagccctgagatgaacaggtatttactgagcagttgtattcagatatgggtcttcatgaatcatgtttaacaatcagatgaccgctataggcaagttcctgagcttccgggtgccttgagtaagagctgagaaccggcctgctgggtgtttactgtatctgtttggaagcactggcggagggtcgttgtaagatgtcctgagcatttatgtggtctggttttaactgtaaatagtgaaagatttttttaagcacttttgcctagatttaaacagcaacttgaaaaaaaaagtatgttttaacatgtaattgtgggagaaattgtaaatagtagccgaatatttaatgtgctttgtctatcctccacttttaccatattctgtaaagttgcatttattttacaggacaaaaaaatgaaatattattgcttttgaaataaatacccaagagcttatcaggacttagaattattcagaactcagatttataggaaaacctctgaccttcagtttgacaagctaaaggaagcagagtctttaatgagcatgctaattttctagttttgaggaaaaattgggtcctttaaatgctattttgcttatcgcatcagtacttttatgcaggtctcatttgactccgtgcttaggtagatgcgggggtgccttgaaaacttcattttaaatgatcttaagcaagaaatacaatattttacgaaacatttggagaatgtgaccgtctgtatgacccgtggaagccccaggttggctgttggtttggaaggtcccgagtgtaacccaggtgattctgatacttggcatgtgtgaatcttcctgatgtatgttaaataaactcttcccctcatcaccctttggtaggaaagccattagatgaaaggagaaaccaatacaagctaaaagcatgcgacgtctgtcccccagcccaaacagccttggttcatcagtttctgcagtaggagataggctgctgagaggtgagtcaagaggcagtctccattggatgtccccactccccgcagaatggcgtttccagagttaggcggtgtggttgccgtgctcaagcccatgctgatttgtacactacatgtctaacctacctcaaatctcagtcattaaaattagcatgctttagacatatatttaaaaagtaactatgcacagctctttatcccccccttgctgctgaagctttcttaaagagaaaaatcaaatttttattttttactggcactatcattttttaagtcctaaagatgattaacagacatttttatcatgagaagaaaaataaagccattgcaactaaagaacctaacagcatgaccaagttcgaagagtcatattatagcaacggaaatcgatggcgtcttagtcatctccccagtgtgccctgtccacggacaccatccacgtgcagtgcaaacatttggttccttttctgctctgttttgttttccctgcctgttgcgtgcaagggaagtgcttgtaaagttctgtgctacgagatttttaaaataaaaatcgcttcgcagcaggttctcacaaaataactggtgctagctcaagaaatcatcatctgaccatcagaaatcttgactaaaggtgttgcatggatttgggggtctttcggtttttggttttgggtctggcttttagcagggccaatgtttcccacaccccggcttcatgggtactgctttgccttctcaccaaggtgacgatggtgtgcgtggaaagagatgataccccaccgccccctcttggtccttccaccagcctcttttgggaacagtagtttgcagagcaagggatttttaaagcgctaaaggaaagaagtagcagagcttaactgctttgtaccacacagcagtagatgtgcaaggacggttgacaatgagtcgatgataacctaatttcattgagagaaacccagccagacttgcttctagaggtttaatcaccatgagatctcaaaccaaggcaaagctggtggaaaactatatgatatccctgacgtgcctcaaccagtatctctttccttttgttactgaagtgtgttttatggactaggaagcatttttatgaattgaaatagtctaaataaaatggtgctatggtgttttaatgtgactgtccctgatcctgtcttgctgaggtgctatcaacgttctgaaaccacaaccaaccaaaaacaaggtgggctccagtctcttggctttttttttttccctcccctcttttggtgctgtcttagacccgtttaccgtgctataatctgctctgagcagtgttgtgttgtgttgtattgttcttcccttggtggccaaacaaagcaagtcgagaaggcagctatctccctttctgtgatcgggagtgggcctgcctggcttggcaggtgctttttggttccacacctgtcttctcaggcttgatgtgaaagaaagggcgaagggttttttgagtttttgtttttgaggaaggggagttgggtacttctgcctctcctagcatgataggcattctcatagccagggacagattttctcctgcagcccagggtgctaagcagacatctctgggagtcccaagggcacaccaagggagaccagatggatctccttcctcccctggcactggctgggaccatggtgggcaggggcttcattctctgacccagcgttgcttctgcctctcattggtaaccccttatgttcggactaaaggaaggagctttctttgctcactcgatgccactgaggctgctttttagttggtgctaacctaaatttcttcttgggtccacagaagttgatgttttaaaaactcaccaggaagctccattttgtgtcatccactgtcacaataatttttttaaatacctcaaaaacaggacatcatgacaacttcagtaaagtagattccatgagggtctgatacctgcaggttgtccgtctgatgacatacttgaccttgaaaaatctggggtcattttgtttttcattcttcagcagttaagatagcggaacgccgaaaggaaggagcgtagttggctgtatttcatgtttaagttttgcttttgaataaaatgtgaatttcctatgcccatctcattgagctttctcagtcattgttgctgtcatttgaaatgactccctcaaaacctagttttattagccagctgcctctgctgtagtacatggccaacttcaacataccctggaccaaaacatttttgaggtgcatacccccaacataagttacacagtcccacatccaggtgcacagagtgcgagtgcactccgcgagtgcggggggaggggcggccccctctggtgctcccagcccttcctcctgcagagctgcaggcaagagcagagcaataggcttctcccctgagcagagaccgcagcacagaaatgcaaggtctaaagttgctttttgcctaagaatcagcgagcgatttggcctacttcctcattggcttctattctgatatcagggatgctttttgtagtggtattgtttgctccctcttcgcgttttgactacccgtcattcaggggtaactcatcactcttcacacggggatttaaattaagaaactaattggctcatgtgaacattccaaattttcttggtttcaataccctttttttttcttttgaggggaaaagaggggagaaaaacaggagtgatgtcatttctttttcatgtattccaattaaagaaacaaggcagtcgatatgcctttatacttaaattattgaacccgtactttgatgtgttattctatcctggaaccggcggcactgccacagggggactacacaattgtatcgctgtgtaaccgccaagcaactggggaacagaggtacgcacgagttatacacatcaaggcaattactaattcatgcgcccccctaaggatgccacctaccatttact

SEQ ID NO: 463499 - DNA, 7441 bp, Homo sapiens
taaacttgaataaaaaagcaaatcttgtgagaaatgtacaccaacaacgagatcgattttaacagtgagcaaaaagtttttaaagaaattagtggaaaaaatataggaaagttgaaacacattctgctggtctgcaccctgaccaaggaagacaatcgctgcgtgggcaagattcccgaggatgagcagctgcatgttctccccctgtacaagatggccaacacggatgagtttggtagcgaggagaaccagaatgcaaaggtgggcagcggagccatccaggtgctcaccgccttcccccgcgaggtccgacgcctgcccgagcctgccaagtcctgccgccagcggcagctggaagccagaaaggcagcagccgagaagaagaagattcagaaggagaagctgagcactccggagaagatcaagcaggaggccctggagctggcgggcattacgtcggacccaggcctgtctctgaagggtggattgtcccagcaaggcctgaagccctccctcaaggtggagccgcagaaccacttcagctccttcaagtacagcggcaacgcggtggtggagagctactcggtgctgggcaactgccggccctccgacccttacagcatgaacagcgtgtactcctaccactcctactatgcacagcccagcctgacctccgtcaatggcttccactccaagtacgctctcccgtcttttagctactatggctttccatccagcaaccccgtcttcccctctcagtgtcctgggtcctggtgcctgggggcacagtggcagcagtggcagttttgagaagaagccagacctccacgctctgcacaacagcctgagcccggcctacggtggtgctgagtttgccgagctgcccagccaggctgttcccacagacgcccaccaccccactcctcaccaccagcagcctgcgtacccaggccccaaggagtatctgcttcccaaggcccccctactccactcagtgtccagggacccctccccctttgcccagagctccaactgctacaacagatccatcaagcaagagccagtagacccgctgacccaggctgagctgtgcccagagacgctggcaagatgggcaagacacctctgtccgaggtgtctcagaatggaggacccagtcacctttggggacagtactcaggaggcccaagcatgtcccccaagaggactaacggtgtgggtggcagctggggtgtgttctcgtctggggagagtcctgccatcgtccctgacaagctcagttcctttggggccagctgcctggccccttcccacttcacagatggccagtgggggctgttccccggtgaggggcagcaggcagcttcccactctggaggacggctgcgaggcaaaccgtggagcccctgcaagtttgggaacagcacctcggccttggctgggcccagcctgactgagaagccgtgggcgctgggggcaggggatttcaactcggccctgaaaggtagtcctgggttccaagacaagctgtggaaccccatgaaaggagaggagggcaggattccagccgcaggggccagccagtggtcttctaccagcacaagaacctcaaccagcccaaccacgggctggccctctgggaagccaagatgaagcagctggcggagagggcacgggcacggcaggaggaggctgcccggctgggcctgggccagcaggaggccaagctctacgggaagaagcgcaagtgggggggcactgtggttgctgagccccagcagaaagagaagaagggggtcgtccccacccggcaggcactggctgtgcccacagactcggcggtcaccgtgtcctcctatgcctacacgaaggtcactggcccctacagccgctggatctaggtgccagggagccagcgtacctcagcgtcgggcctggcccgagctgtctctgtggtgcttttgccctcatacctgggggcgggttgggggtgcagaagtctttttatctctatatacatatatagatgcgcatatcatatatatgtatttatggtccaaacctcagaactgacccgcccctcccttacccccacttccccagcactttgaagaagaaactacggctgtcgggtgatttttccgtgatcttaatatttatatctccaagttgtccccccccttgtctggggggtttttatttttattttctctttgtttttaaaactctatccttgtatatcacaataatggaaagaaagtttatagtatcctttcacaaaggagtagttttaaattccatttaaaatgtgtatttattggattttttaaaagcgacaatagtaatggtaaaggatgggcaggaaaggccagtagtgctcccccgcccagtctcgctgggtctggcgagccaagcccctcgggcgctggcgaggtcctcagccatctgcccctcgagagccaagcgcggacggtagccacccagttcatccctcccgacatacaccccttccctttggggaagggagcctcaggacagcttctgtcctctctgataggatgggagagtctgcagaaaaccatctggggtcccttttccagtccccggcttggagtcgaagggcagatgcaccccaggccagccccacgagatgctggcatagctttccccagaaaccaggttggaagtagatggcttcaagcttgctagtctccacactgaatcctctgtccgttatttatggagtcacacgatgtcatggttcactaggcagcacctcacgctggagctggagtgcgaggttcttaggggccgtgcacccatgttgccaagccaatgcatgctgagctgaaggaatttgtcttagtggcagttttttaaaaaatgcccccaaagtctatgctgatactgaaaaagggctactgtatctttaaaaacaggaagttgaacccaagctgtgaaaagccagtggtgctctgtgcatggtgctgtgcggagcctgggtgctgtagtgttgtgctgggactttcttgactcttgggcaggtcacatcctacaggagctcagcagaccagtgtaacaacagttaatgcatctatcctgatccctgaatttccacattggacaatggtgcatgcctcacacctgagcctgcttcctccatgctgtcattgggttcgggggcctacacttaacaattttaaagtgcaagagtcaaacattttcaacaggttgctataattttcctccctaattggtgccatttctccatttgatcattttctttttttcctttctcccctcttcatccactttaatatagctgttctgaaattctggtgcattcattcggttctttgaaatgagaatgtggtgcttaatttttgtgacgttgtcgagagaggttgggcctgatgggagcaacactcatcatcaccaagtcaaactttgttggagtgttggtttttcttgtgatattagcagaaatgatctcatgctagccatgtggatgtgtgtgtggtgaatggggggcttcatcaggacacacagaggggaatgtggccacacggtggatgaccaccaagccctgagatgaacaggtatttactgagcagttgtattcagatatgggtcttcatgaatcatgtttaacaatcagatgaccgctataggcaagttcctgagcttccgggtgccttgagtaagagctgagaaccggcctgctgggtgtttactgtatctgtttggaagcactggcggagggtcgttgtaagatgtcctgagcatttatgtggtctggttttaactgtaaatagtgaaagatttttttaagcacttttgcctagatttaaacagcaacttgaaaaaaaaagtatgttttaacatgtaattgtgggagaaattgtaaatagtagccgaatatttaatgtgctttgtctatcctccacttttaccatattctgtaaagttgcatttattttacaggacaaaaaaatgaaatattattgcttttgaaataaatacccaagagcttatcaggacttagaattattcagaactcagatttataggaaaacctctgaccttcagtttgacaagctaaaggaagcagagtctttaatgagcatgctaattttctagttttgaggaaaaattgggtcctttaaatgctattttgcttatcgcatcagtacttttatgcaggtctcatttgactccgtgcttaggtagatgcgggggtgccttgaaaacttcattttaaatgatcttaagcaagaaatacaatattttacgaaacatttggagaatgtgaccgtctgtatgacccgtggaagccccaggttggctgttggtttggaaggtcccgagtgtaacccaggtgattctgatacttggcatgtgtgaatcttcctgatgtatgttaaataaactcttcccctcatcaccctttggtaggaaagccattagatgaaaggagaaaccaatacaagctaaaagcatgcgacgtctgtcccccagcccaaacagccttggttcatcagtttctgcagtaggagataggctgctgagaggtgagtcaagaggcagtctccattggatgtccccactccccgcagaatggcgtttccagagttaggcggtgtggttgccgtgctcaagcccatgctgatttgtacactacatgtctaacctacctcaaatctcagtcattaaaattagcatgctttagacatatatttaaaaagtaactatgcacagctctttatcccccccttgctgctgaagctttcttaaagagaaaaatcaaatttttattttttactggcactatcattttttaagtcctaaagatgattaacagacatttttatcatgagaagaaaaataaagccattgcaactaaagaacctaacagcatgaccaagttcgaagagtcatattatagcaacggaaatcgatggcgtcttagtcatctccccagtgtgccctgtccacggacaccatccacgtgcagtgcaaacatttggttccttttctgctctgttttgttttccctgcctgttgcgtgcaagggaagtgcttgtaaagttctgtgctacgagatttttaaaataaaaatcgcttcgcagcaggttctcacaaaataactggtgctagctcaagaaatcatcatctgaccatcagaaatcttgactaaaggtgttgcatggatttgggggtctttcggtttttggttttgggtctggcttttagcagggccaatgtttcccacaccccggcttcatgggtactgctttgccttctcaccaaggtgacgatggtgtgcgtggaaagagatgataccccaccgccccctcttggtccttccaccagcctcttttgggaacagtagtttgcagagcaagggatttttaaagcgctaaaggaaagaagtagcagagcttaactgctttgtaccacacagcagtagatgtgcaaggacggttgacaatgagtcgatgataacctaatttcattgagagaaacccagccagacttgcttctagaggtttaatcaccatgagatctcaaaccaaggcaaagctggtggaaaactatatgatatccctgacgtgcctcaaccagtatctctttccttttgttactgaagtgtgttttatggactaggaagcatttttatgaattgaaatagtctaaataaaatggtgctatggtgttttaatgtgactgtccctgatcctgtcttgctgaggtgctatcaacgttctgaaaccacaaccaaccaaaaacaaggtgggctccagtctcttggctttttttttttccctcccctcttttggtgctgtcttagacccgtttaccgtgctataatctgctctgagcagtgttgtgttgtgttgtattgttcttcccttggtggccaaacaaagcaagtcgagaaggcagctatctccctttctgtgatcgggagtgggcctgcctggcttggcaggtgctttttggttccacacctgtcttctcaggcttgatgtgaaagaaagggcgaagggttttttgagtttttgtttttgaggaaggggagttgggtacttctgcctctcctagcatgataggcattctcatagccagggacagattttctcctgcagcccagggtgctaagcagacatctctgggagtcccaagggcacaccaagggagaccagatggatctccttcctcccctggcactggctgggaccatggtgggcaggggcttcattctctgacccagcgttgcttctgcctctcattggtaaccccttatgttcggactaaaggaaggagctttctttgctcactcgatgccactgaggctgctttttagttggtgctaacctaaatttcttcttgggtccacagaagttgatgttttaaaaactcaccaggaagctccattttgtgtcatccactgtcacaataatttttttaaatacctcaaaaacaggacatcatgacaacttcagtaaagtagattccatgagggtctgatacctgcaggttgtccgtctgatgacatacttgaccttgaaaaatctggggtcattttgtttttcattcttcagcagttaagatagcggaacgccgaaaggaaggagcgtagttggctgtatttcatgttttatttcttatctctttgaattcctgtttggttacttggcttccaatggaggtgaacttaacaaccatacttgaatattccgtcttgactttgtaaactgtggctacttgaaatgaagtttatctggggttgatggatgaatggtagatttttgcaatgtctcaaggcaataggatgtgtattaaactgtagatattcttagtacagtaaatttatgctgataattttattttgtataatttttacctttttgttaatattttttccttccactttattggtttgcctcctgagctacccctccttaccctcccttctccctcagtgtttcagtaaatttaatttagggtgcctagaaattgcaagtatgtatcctttttgatttgtattttattataatttacacaaacaactgggtttgtgaactgtattactcctggtatctttaaaatattgtgggtgttttaataaattttatatttattttttgcactcaaattcagtgtgggttctctttttccccttcttgaaccaggactggaatgtgatgtgtcaggtaccctgtaacctcacccacccaccgtatgttgtagatgtacaaatgaagccctcactaatagcagcagcggaacctggccttgtccattctgccacctggataaaggaatgttcagaggctatcagctgttaaaacgggatctaaagggagaaaatagagatggcctttttctcatctatgtttctctttttgttttctttcccttttatgtttttttgtcc

SEQ ID NO: 463500 - DNA, 351 bp, Homo sapiens
ctgactgagaagccgtgggcgctgggggcaggggatttcaactcggccctgaaaggtagtcctgggttccaagacaagctgtggaaccccatgaaaggagaggagggcaggattccagccgcaggggccagccagctggacagggcctggcagtcctttggtctgcccctgggatccagcgagaagctgtttggggctctgaagtcagaggagaagctgtgggaccccttcagcctggaggaggggccggctgaggagccccccagcaagggagcggtgaaggaggagaagggcggtggtggtgcggaggaggaagaggaggagctgtggtcggacagtgaacacaacttc

SEQ ID NO: 463501 - DNA, 2910 bp, Homo sapiens
taaacttgaataaaaaagcaaatcttgtgagaaatgtacaccaacaacgagatcgattttaacagtgagcaaaaagtttttaaagaaattagtggaaaaaatataggaaagttgaaacacattctgctggtctgcaccctgaccaaggaagacaatcgctgcgtgggcaagattcccgaggatgagcagctgcatgttctccccctgtacaagatggccaacacggatgagtttggtagcgaggagaaccagaatgcaaaggtgggcagcggagccatccaggtgctcaccgccttcccccgcgaggtccgacgcctgcccgagcctgccaagtcctgccgccagcggcagctggaagccagaaaggcagcagccgagaagaagaagattcagaaggagaagctgagcactccggagaagatcaagcaggaggccctggagctggcgggcattacgtcggacccaggcctgtctctgaagggtggattgtcccagcaaggcctgaagccctccctcaaggtggagccgcagaaccacttcagctccttcaagtacagcggcaacgcggtggtggagagctactcggtgctgggcaactgccggccctccgacccttacagcatgaacagcgtgtactcctaccactcctactatgcacagcccagcctgacctccgtcaatggcttccactccaagtacgctctcccgtcttttagctactatggctttccatccagcaaccccgtcttcccctctcagtgtcctgggtcctggtgcctgggggcacagtggcagcagtggcagttttgagaagaagccagacctccacgctctgcacaacagcctgagcccggcctacggtggtgctgagtttgccgagctgcccagccaggctgttcccacagacgcccaccaccccactcctcaccaccagcagcctgcgtacccaggccccaaggagtatctgcttcccaaggcccccctactccactcagtgtccagggacccctccccctttgcccagagctccaactgctacaacagatccatcaagcaagagccagtagacccgctgacccaggctgagctgtgcccagagacgctggcaagatgggcaagacacctctgtccgaggtgtctcagaatggaggacccagtcacctttggggacagtactcaggaggcccaagcatgtcccccaagaggactaacggtgtgggtggcagctggggtgtgttctcgtctggggagagtcctgccatcgtccctgacaagctcagttcctttggggccagctgcctggccccttcccacttcacagatggccagtgggggctgttccccggtgaggggcagcaggcagcttcccactctggaggacggctgcgaggcaaaccgtggagcccctgcaagtttgggaacagcacctcggccttggctgggcccagcctgactgagaagccgtgggcgctgggggcaggggatttcaactcggccctgaaaggtagtcctgggttccaagacaagctgtggaaccccatgaaaggagaggagggcaggattccagccgcaggggccagccagtggtcttctaccagcacaagaacctcaaccagcccaaccacgggctggccctctgggaagccaagatgaagcagctggcggagagggcacgggcacggcaggaggaggctgcccggctgggcctgggccagcaggaggccaagctctacgggaagaagcgcaagtgggggggcactgtggttgctgagccccagcagaaagagaagaagggggtcgtccccacccggcaggcactggctgtgcccacagactcggcggtcaccgtgtcctcctatgcctacacgaaggtcactggcccctacagccgctggatctaggtgccagggagccagcgtacctcagcgtcgggcctggcccgagctgtctctgtggtgcttttgccctcatacctgggggcgggttgggggtgcagaagtctttttatctctatatacatatatagatgcgcatatcatatatatgtatttatggtccaaacctcagaactgacccgcccctcccttacccccacttccccagcactttgaagaagaaactacggctgtcgggtgatttttccgtgatcttaatatttatatctccaagttgtccccccccttgtctggggggtttttatttttattttctctttgtttttaaaactctatccttgtatatcacaataatggaaagaaagtttatagtatcctttcacaaaggagtagttttaaattccatttaaaatgtgtatttattggattttttaaaagcgacaatagtaatggtaaaggatgggcaggaaaggccagtagtgctcccccgcccagtctcgctgggtctggcgagccaagcccctcgggcgctggcgaggtcctcagccatctgcccctcgagagccaagcgcggacggtagccacccagttcatccctcccgacatacaccccttccctttggggaagggagcctcaggacagcttctgtcctctctgataggatgggagagtctgcagaaaaccatctggggtcccttttccagtccccggcttggagtcgaagggcagatgcaccccaggccagccccacgagatgctggcatagctttccccagaaaccaggttggaagtagatggcttcaagcttgctagtctccacactgaatcctctgtccgttatttatggagtcacacgatgtcatggttcactaggcagcacctcacgctggagctggagtgcatctgcccttcgactcccggggactggaaaagggaccccagatggttttctgcagactctcccatcctatcagagaggacagaagctgtcctgagatccctccccacggtccg

SEQ ID NO: 463502 - DNA, 2666 bp, Homo sapiens
tggctgcctgcaggtggcagcccgagggcctggtcccaaaggccggtgacgccttctcacctgcatccgctcctccagcccaggctggcggtgactgctctgatcactacgtgctgtgaagggcacggtgccagcctctgatctgggtccttgctgccatatgaagacacccacctaccctgctggagaggggctctggagggccagggagagagaggatagctgggctccagtcggtgccccatccagagcccacagacaggacaaagccatcccgggccctccagcccccgttggccatcgcagcacacgccacctgcacaaagatccggcaggcaccgggagccggctggcaggtacctctgagcacactggattaattcccagggcggccgtcacagcagtgacgttggcactgaccacccacggaaaggacagaatttaaagaggctgagtttttcatctctctctgctgttttctctctggtttcccttttaccattttgacaagtcccaccatactcagttccagcctgggacacacacttgtgattgctaacgggtggaaagttgcacgtgccatgttgtgttgctgacaccaaaggcaaaagcccaggtcctggccccaggttaggcccacacatgcctgggctgtcccatctcggggactccctggtcagagctgaaagtcttcgggctctgtctccctcgctggggagtgtgtccagccctgtcctctagcactgggcccctgtctccccagacacggcccccagggcggaggggaccacagacattctgaggtgaactctcctccgtgttggaaatatgaaaaataaaaagggaagggctgggggaagagacggggcattgtttacttcctcaaaattccatgttaacgagttcccgctgaattctctggttaagcagagaacggctgtgcagagcgtgagctgtgagccccaagctggtcctcctgtgggccccgcagcgctggagctgacctctcaccaagggtccctttgtaacttcctgtgactgattctttaatggcatctaatgatgatgcaaggaagctgccagctgggagtttcggcaccactgattgcccccataaggagccagtgggatggacaccagctcctgccccttgcctgaaacatccctgcagaccctcggcctgcaccggtgccccactgaaggcccccacctacggttctgcccacacaccagggtctctccagctcaccaccacccagggtccttccagctctcctcccccagggtccttcaagctctctccctccagggtccctccagctttccctgctctaggttccctccagttctcctcccccagggtccctcccgcttccccacttaacctccccggggtccctgcagctcgggcttccgcccccggggtccctccagctgggttttctcttgcaccctggggcctggtgctccacccctctctgtccacttcctgcctccaggctgtgtccgagctctgtgcacctgacacccacgagcagaattacagccctaaagacgtccgtgccccagttgctggcacctgtgaacaccagcaaatcaaaacccaattcagcagagggatgattttcgccttccggaagatgaaatcacgaaagctcagagacggcgcgcactccctggtgtttcagcatctgtcacggggatcaacaaagcatgacagccgccaatgtgcctccgtgtggacttttgtgatgctgtattttctcttgagaggggcccctgattctggacagaatgcactgggagaccctgtgatgaccactcagccccctctgctgctgctggttgagcagacaacagggtcctcccgaggagagaacacagtaggcacactggatgtggggagagggtccaaaagccccaagcagggggcaggtctgggcagaggagaaggcgctgtgtctgtggtggcactggatgcctcggaagtcatctttagagccctggagtcctcgccaagggcacgggctccctttgtggtcctggaataatggggcctgcctggcactctcagattgcgtggggatccgctggacttaggacaacatttataatcaattttgcttacaaaattctattggaagtttgagttgcatcaaattcataaattagtttggcaaaaacgtacatcttcttaatatttctttttagatatggaatatactgtatttctccatttgttcaaatattttctatggtgctctcttgggcttatggatttaattatttgagcctgacagacttcttgtaagattaatttccaggtactcagttttaaaattgtgaatagaattcttttcccattgtttctctaactgttaatgctgatatgtaggaaaacgactgctttttatgttcctattaaaatttttttaaaaattagtataattttacattatttttcttaggacatgctggctttgggaaatgaattattgggaaacatgccacctttttgtgttctctggaaacacttatctagcatggaaatcatctgttccatgacagtctgaaaacccagcctgtgaaaatgtctgtggctggaaacttgtgagaaataattcttcaacaacattttcaatttcatacatggcttttcatttatc

SEQ ID NO: 463503 - DNA, 941 bp, Homo sapiens
gcctagcgtgccctgactctcttaactaccaccgctacacggtcatcaaaaacaaggaaaacctaaaaaactggcagagccaagacagcccaaggcaacatgatgactaaaagtaatgtgggatcctggaagagaaaaggaatgtccgtgaacaactcgaaaatctgaataaggaagccagagaaagaaaagtaacggaagcctagagcaagcagaaaatgaataaataacaaaaaatacagcagaaatcaatgcattttaaaaattagaaaacaacagagaaaatcaatgaaaccaaaaatagatttttaaaaaaaatcaatcaagttgaaaacctctagctagtccaaccaagaaaataagggagaagatgcaaattactaatatcagaaacgggagagctctatctctgcagggtcctgtgagcgttaaaatggaatatgatgaagaactgattccacacctgcaaatgtgtggcggagctgcaaccctggaagcctgtgccggcctctacgggccccactgcaccctccgtgccatgaacctagttgctgacccccaggtcacagccaggcaggaaggaacagaagccatggaggacctgagggtgtggccagcaaagcccgcgctgggatccatgttggaaatggagatgggatgtatgggacaacaaagggctcctggtgcattgctgaggtatcctgggctcccacaggggccacacatggatttggtgtggaagtgtccccccaggctccgtgtcccaggctcggggcagagccagcgccagtggttgggaggttcagggagcgttttccaacatcagcagctaaactgtggagcccaccacacccggcatgtcccaggggaggctgagggactctgttagcgttcacaggcggcacatcccccagggcaggaggcagcccctctggccccac

SEQ ID NO: 463504 - DNA, 2558 bp, Homo sapiens
gcgtgagactccacggtcatccagtttcagccgtgggaggggaaactggccaaaggagcacgatgtgggtgtttttaatgggccaggcccgggtacactggcatcatttccactcacaggcatccaacagcaccttgtcacatggcacacctagacgcacggaagatgcacctagagctactttgcagcaggctggctgggccccattcccggctgccttaggtgatttgcatggttcactgcagagcccagcaccgctgcagggttgcacccctccctctacgtccaatgactcaaagcataagccacgcctaggaaaatgttcctggtgtcaaacgcaaatgacttttcctttcctagactttaccaattattcaaaaccatcattgtttttattgttccatactggggccctatctttattatgtggttgtttttctagaatttctaattgccttttccttgttgagaaagaagaaatattaatgctattcaccattgtcccaattatacatttgagcttcttatgcatttcatggattgcttagaatcagttctgtttttttttgcagttgtcattttcattaagttagattcactctggtccagtttggacccactgctccacatttaggccatctctgcttctctgcttgccctggctgggtcgagaggacatttgtcactattattattctgcttctttctaatggcttttttttccttcaacctctacttttatcttgtccttgcatttcccacccatcccgtctccccacttaatctactgagaatccccttccccaggaacacctgttctgagaccatccggtcgtacactcctgcatagaggggccaccctgggacctctggtccctcattgcagcctcagaccctggacagtcacttcctctgctcctattcagtgccctatttcaagtgctcaaataactcattaagaaatgatgcttggttaaaactgttccaatattggctaagctaaatgatagcactagtggtgagcatcacagtcacccctggagaccatggcaggcggggcttgggggggctgccagtgggcactgtggtgttccatctctttatgtggacaccagcctgcagagttcgattcactttgcccacttctctgcgtgtatgttgcactagagcaaaaaaaagtttattaaaaacagaaaggatcttgggacccttagaactcaccgcatgtctgaaaatcatacttgtttgatagatgtctagatgtggaacttaggtggaaactttgtcagcactcgaaaaaacatcaccctgctgccttctggaaaaacgtcaccctgccgccttctggaatgctactatgctatgttgctgttggagatctaatgccggtctgatttttatttctttgtagctgaattattttttctttaggtaatactttagtctctctttaaaccaggtgttctgaatttttacaatgacatgtgaagatatcttttaaaattcatcttacttagcagttcacaactttctcaatatgaacatttgagtctccctgacaatttggggaccttttctggtgctatttacttgaaaattgcctctactccattttctctgttttcttttcctaaaacttctattggctgaatgtggtctgtcctagaaggatccttcatgcctcattaccccttcacttctttcgttttactttttagaaaatttccccttttcttttgattaaaaaaaattcagaagttaccacattccaggtttccaagagcttttatgaggcacaattgctgttttcttaaagtacatgttcatgttttatggctgcattatatccttaaatctctctgagaattctaattattgggaggattttgtttctaaattgcttcttcataggctatttttattctctttgattattttagattatcttaaatatttccagtcacatttaagaatgaggcttacttgagttttgtagattgtcattggacaaattttgctttgggggagtgagccagaggcccaaaatgtcgtaatttgaagatctttattctaagtcaccaacactgcaaaagccctggatctactctagatgtacagccctttcagaatctttgaagaagagtgatttgggccagtcagtgggcactggcgccgtcagattgcaggggacctgaggagggagaggaaataaacaccatgctcagtcatcttgaatcagaatccagccaagtctgtcgaacagaggactggtgccaggtgctttggccttgggctaaggggctgttcaggaagaggtgggcgaggaggatccgtggctcgcctggtcacaagcatgttgagatgaatccagcctggtgccacctacagccgtgaaggcccgcggtctgaccctataatgtgctgccttcctgagacggctgcacttctgcaaagccctcgtgccctcatgtcctagccatgaaatcatgcagactttcgatcacaggccttagcagtgagaaacagaaaagtcttttggtttctgtcaattgcagggc

SEQ ID NO: 463505 - DNA, 1045 bp, Homo sapiens
tgtataatcagaggcgtccctgcaatgattaaacaccaagggaaggctgccttcccagtccatgaccggcgccggagttttgggtccacggataaaacgtgtctcctttgtctctaccagaaaatgaaaggaattgaaattaagagaagggagaaattgaagtgtggcaccaagattgaaaggagaaagaggttgagggatagacctgaggtcgtaggtggatctttctcatggagcaaagaacaggaggacaggggattgatctcccaagggaggtcccccgatccgagtcacggcaccaaatctcatgcgcgtccgtatgaagagaccaccaaacaggctttgtggagaagatgtcgaagacacaggagaagacaagccagggagaggggcttagagcagattctcccttgcagcctcagaaggaatcagtcctggtcacaccttgatctcagacttctggcctccagaatggtagcagcagcaaaaatggcaaaatgaggacttttgagaattcctttctctatggaaacaaaaccctgggggaaaatggtctgaatcaaccttttcagaactctggaaattagcccgagacttgaagcaattcaggttgcatttgtataagaaaagtgacagaatctcagtaagaacagcaagctttgaaggatttgaacttgcccagttgccttccttctttctccatctctgcaggggacttaaaaccaacatcccacactcataatgaaaacctggcaggaggcagaacaggattggagctgcttcaaagccttaggtccagagaactcatcacctatgcagatcctcaataagactcaaagctgattccgcctcagaaaccatggagacccaaagccaaattcaaagtgctgaaagttaactcatccaatcagtcaactcttgtacagacctcctttttttttgttcttggagtttgttttattctaataaaggtgttttatattgttgttgtattattcttaaataccatattttagttgctattataaatggtacttctattgcc

SEQ ID NO: 463506 - DNA, 1361 bp, Homo sapiens
gcagttcacatatgccagagagaagccatatagtgcttcctttaagtgaagagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacagggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtaagcaaagattttaacaaattaaatattctgaattttgtttaatttttttttctaacttaacttttccttaaataaaacaggtatttctccttggagtagtatataccagccacttacaattaaaggagaaatgtaattctcaccacagctcctatcagccgttatgcctgccccttcctgtatgtaaacagctttgtacagaaagacaaaaatcttggtgggatgcggtttgtactctgattcacagaaaagcagtttctgataattatttagcctgaaaattaaaaaaaaattagcacaaggctttgtaggtaagaccattatagatctttctaaatatttaaggtgtgttttgtgtcaccattaggtgtagatggtcagccttttgaacaaactgacactacagaagaggca

SEQ ID NO: 463507 - DNA, 2753 bp, Homo sapiens
gggttgatgggtgcagcaaaccaccatggcacagtagccatatattagtattgacatttttattaaattactatgtttccatcattaggaaccataattttcagtataaaaatgacatagcataaaatcaaggaagtttaagtaaaaatcttgtaatcttaaaagtgaattggaaattgcagtatgaactcacattgtgttttactctttaaaaaatacatattttctagttctgtccactgaaaagacccagaagcaatgaaaacccagtaacaatgagcacacttccacggctgaactctctagataacatttaccaatgaaattggctgattctaagtctagggcaaaaaatgtacaaaaggagactggatacaagtctcttattgtaccagaaagtgaaggagaaatcaaagactaatgaggtcacgttaaagtgatacaggacgacacagggcctgcctgcagcagctggtcaataatgaagggattaatccatgactgcaagactcgtgggaaggagggagtggggactgcagggagggtcctagtaaaagcagggtgggcctcgatgagcacagcatggacagtgcgatttaaatcccatcgcttgtgggcaggaggagtgaggatgccagaacctagttatcccccaccatcccacgctctcccaggaggcggcggcaggaagtgcagtctacagtaagggaaagccgccggagctggagacaggctggaaagagcaggtaacagcccacaaggagcgggggccctggctgtcagactcaacttgcaggaccatcaagtgcaggtgtggttcaagaaccggggccgcttgctctgcggtagcaacggcacataaccgcagcgatgaccagggcagccaagccagcagccgggaccccgggatgctcttggcacatgatccgactcccctgcctttgcgggtcctgtactcccgcgaggtccaggattgtgcagcccctccccaaccggccgttgggaatcttcgcagcagcagaacccgctgcctccaggtccgaccagacctgcataggtagagagtccccgcacagggcggccagcagagctacccagctgccccagggcctcgggacccctgggcctgggacccaggccagaccctgactcattcggtgatctcacaggactcctcccaccccaagaccctttcagggaccctgcctcgaactccacgacatgggaggcaggggcgggccttttgcaggggaaggactcccccagcaggacgtttactgaatctggagggagtcgccctgcagatatcccgcggaagccggaggagacccaggtgcgccccaccggctagctgcgcctgcgggtgcccaaattggtgtccgggccatcctcaccgcagtgactcctccgcagcgccaacgcactccattttccttccaccctgccggtggggggcgtttgcttgttctcactctgcagccgcagccagtggcgccgctaccaaggtccccgcctcgccatccgggtcctgcctgagcatccttattggtgctcagggctaggcgtgcattgctgctaggggcgcggaaaggtttatcgtgggtggatgctgcccggggcttgagtggtttttagaggtcttgagtggctcactctccaatcagcgctttctagagacagcgtggtcagcgtacttgcttactttcaggattgcgagacgtctttaacccttgctgatcggctgacgctgcagcttcctgtggcttcctgctcatttcccgcaagatagcactgataggcaattccattttggaaaatttatcctgaggaaataaataaagatgtaaacagagaataacttacagatgtgacgtttgtgatcgttaaaactggaaacagcgcaagagtggacgataggggatgagagagccacacagcgcatagaagatgatcagtctgaagagagggttttcagacatgcaattaactgctattcactgtacttcattttaactgcaaactagcagtctctttccccaggaaaaaagaggtcaactcggaggagccagggattcagcccactctggacaacactcagagccatggcacctacctgtatgaaaaaaaattgttaagcagctgccactcctagttactggcctctgctcggtgactgatgcacttctaacatccttgtcccaggataaagaccttgtaatggagaaaaaagatggcagggatcctttccatggaatttcggctgttgtctagtggaccttccaggaattgtctgattctatgggaacaggagcgaattccagggccatggcagttgcttaatgctgcacagcactctagatttgaaagctacaggccagggactggcctagaggaagatacctcagaggctgcaggcctaaccaggcctgaactaggaggggccagtgcagagggagaaacctatgcagaactctctaagaggccaaatctgaggactcgggcaggacatggcagcaatcagggaggcttcaagccacaaaacccccacagatgtgatgcctttatttgtttcatacaaaaacaagccaggaaagaaatggggttggactgcatactctctgcaaagccatatcccaccttctcgctctgccatcctcagtgagtggctcttcatcctcctgagtgtggcctcagggtcataagatggctgctgcacctcccgccctcattccaggcagaaggaggcaaaggcc

SEQ ID NO: 463508 - DNA, 2176 bp, Homo sapiens
gggttgatgggtgcagcaaaccaccatggcacagtagccatatattagtattgacatttttattaaattactatgtttccatcattaggaaccataattttcagtataaaaatgacatagcataaaatcaaggaagtttaagtaaaaatcttgtaatcttaaaagtgaattggaaattgcagtatgaactcacattgtgttttactctttaaaaaatacatattttctagttctgtccactgaaaagacccagaagcaatgaaaacccagtaacaatgagcacacttccacggctgaactctctagataacatttaccaatgaaattggctgattctaagtctagggcaaaaaatgtacaaaaggagactggatacaagtctcttattgtaccagaaagtgaaggagaaatcaaagactaatgaggtcacgttaaagtgatacaggacgacacagggcctgcctgcagcagctggtcaataatgaagggattaatccatgactgcaagactcgtgggaaggagggagtggggactgcagggagggtcctagtaaaagcagggtgggcctcgatgagcacagcatggacagtgcgatttaaatcccatcgcttgtgggcaggaggagtgaggatgccagaacctagttatcccccaccatcccacgctctcccaggaggcggcggcaggaagtgcagtctacagtaagggaaagccgccggagctggagacaggctggaaagagcaggtaacagcccacaaggagcgggggccctggctgtcagactcaacttgcaggaccatcaagtgcaggtgtggttcaagaaccggggccgcttgctctgcggtagcaacggcacataaccgcagcgatgaccagggcagccaagccagcagccgggaccccgggatgctcttggcacatgatccgactcccctgcctttgcgggtcctgtactcccgcgaggtccaggattgtgcagcccctccccaaccggccgttgggaatcttcgcagcagcagaacccgctgcctccaggtccgaccagacctgcataggtagagagtccccgcacagggcggccagcagagctacccagctgccccagggcctcgggacccctgggcctgggacccaggccagaccctgactcattcggtgatctcacaggactcctcccaccccaagaccctttcagggaccctgcctcgaactccacgacatgggaggcaggggcgggccttttgcaggggaaggactcccccagcaggacgtttactgaatctggagggagtcgccctgcagatatcccgcggaagccggaggagacccaggtgcgccccaccggctagctgcgcctgcgggtgcccaaattggtgtccgggccatcctcaccgcagtgactcctccgcagcgccaacgcactccattttccttccaccctgccggtggggggcgtttgcttgttctcactctgcagccgcagccagtggcgccgctaccaaggtccccgcctcgccatccgggtcctgcctgagcatccttattggtgctcagggctaggcgtgcattgctgctaggggcgcggaaaggtttatcgtgggtggatgctgcccggggcttgagtggtttttagaggtcttgagtggctcactctccaatcagcgctttctagagacagcgtggtcagcgtacttgcttactttcaggattgcgagacgtctttaacccttgctgatcggctgacgctgcagcttcctgtggcttcctgctcatttcccgcaagatagcactgatagggtattggaaatccttatgtaaagtatctgttcactgtttttgcccattttcttgatttatttgaactgattcttctattcttttgaagttaatgtgttgcaattttcacatctatgttgttttttcattagtggcatttctcaactccttgatttcttgaatttcatgttgtctatttcagtatgtattaaattatctgtgacggtggaccagttttggtttgtctgtttgttttatttcaatcaatggcacactgaaatgctcaaacattaaactgttgaaaaaatttaatggcattcgcaacctaagcccactctctcccgcttttttttttttttttttttcagagtcactctgtcgtccaggctggagagcag

SEQ ID NO: 463509 - DNA, 2226 bp, Homo sapiens
gggttgatgggtgcagcaaaccaccatggcacagtagccatatattagtattgacatttttattaaattactatgtttccatcattaggaaccataattttcagtataaaaatgacatagcataaaatcaaggaagtttaagtaaaaatcttgtaatcttaaaagtgaattggaaattgcagtatgaactcacattgtgttttactctttaaaaaatacatattttctagttctgtccactgaaaagacccagaagcaatgaaaacccagtaacaatgagcacacttccacggctgaactctctagataacatttaccaatgaaattggctgattctaagtctagggcaaaaaatgtacaaaaggagactggatacaagtctcttattgtaccagaaagtgaaggagaaatcaaagactaatgaggtcacgttaaagtgatacaggacgacacagggcctgcctgcagcagctggtcaataatgaagggattaatccatgactgcaagactcgtgggaaggagggagtggggactgcagggagggtcctagtaaaagcagggtgggcctcgatgagcacagcatggacagtgcgatttaaatcccatcgcttgtgggcaggaggagtgaggatgccagaacctagttatcccccaccatcccacgctctcccaggaggcggcggcaggaagtgcagtctacagtaagggaaagccgccggagctggagacaggctggaaagagcaggtaacagcccacaaggagcgggggccctggctgtcagactcaacttgcaggaccatcaagtgcaggtgtggttcaagaaccggggccgcttgctctgcggtagcaacggcacataaccgcagcgatgaccagggcagccaagccagcagccgggaccccgggatgctcttggcacatgatccgactcccctgcctttgcgggtcctgtactcccgcgaggtccaggattgtgcagcccctccccaaccggccgttgggaatcttcgcagcagcagaacccgctgcctccaggtccgaccagacctgcataggtagagagtccccgcacagggcggccagcagagctacccagctgccccagggcctcgggacccctgggcctgggacccaggccagaccctgactcattcggtgatctcacaggactcctcccaccccaagaccctttcagggaccctgcctcgaactccacgacatgggaggcaggggcgggccttttgcaggggaaggactcccccagcaggacgtttactgaatctggagggagtcgccctgcagatatcccgcggaagccggaggagacccaggtgcgccccaccggctagctgcgcctgcgggtgcccaaattggtgtccgggccatcctcaccgcagtgactcctccgcagcgccaacgcactccattttccttccaccctgccggtggggggcgtttgcttgttctcactctgcagccgcagccagtggcgccgctaccaaggtccccgcctcgccatccgggtcctgcctgagcatccttattggtgctcagggctaggcgtgcattgctgctaggggcgcggaaaggtttatcgtgggtggatgctgcccggggcttgagtggtttttagaggtcttgagtggctcactctccaatcagcgctttctagagacagcgtggtcagcgtacttgcttactttcaggattgcgagacgtctttaacccttgctgatcggctgacgctgcagcttcctgtggcttcctgctcatttcccgcaagatagcactgataggcaattccattttggaaaatttatcctgaggaaataaataaagatgtaaacagagaataacttacagatgtgacgtttgtgatcgttaaaactggaaacagcgcaagagtggacgataggggatgagagagccacacagcgcatagaagatgatcagtctgaagagagggttttcagacatgcaattaactgctattcactgtacttcattttaactgcaaactagcagaaagcctggatctttgagttgtgttgatgggcatattcgtgtttgccacttgaaggagtaagaggcccgcgtggatctggaggcaagtggctgtgccctcctgcaatctgctcacctgcagaaatgctcgcgtagggcagctctcaattttctgccacctcctcagctttttctgtgaaacagaagttggttactttgg

SEQ ID NO: 463510 - DNA, 1304 bp, Homo sapiens
cacaaccacttccttgcacccctgggtagcatgagccatgatgtgagctgttcgtttctcaggtcctacaaggaaaacaggagggaagagggtccttctgtgcttgaagcaggagtgctgagtgggtacccttgttgggagcctcatccacattcacagtggaactgcatgagcaacttaatattttatcaccaaaatgtactctatgttttacttgtcatttcctcatttatcctcagaaaaatcctgtgcaagactttttatcccaatgttcaaacaggaaacaggtgctcccaggctgtcacatgcacgggaagtcaccctcctgcgatgtggctccagccttccctggctatagcagccactgcagctctccaccctgctgctctgggccccattcgatgttggcttcatccgaaaatgcacatcctgggtgactttagctagagaagagcgagtagccaacaccaggtcgtgggcagcaattgctgtttttaaatggctgagttgctcactggtatagacagagatgagctgagctgagctgagtaatggacactgtcttgtggtcgagccacatcagcagttataatctctcatgtacctcctgcaaacaagtcaagtttagaataccttctagataagcacatgctatcaaagtctgtgccattcccaccttctatgccctgtaatttgggttcctctaagagttgataagactctttgctggcaaatttctttttcaatttttagaaacaaatatatgtacctaggtagacacagaaatatggatttattttgcttaaccatcattgttttttggcagtgttttctggggggcaattcctacattccaggcccgcttcaagaattgatgtgcaacccagcgtagggaagaactgcttctggactgcacctgaggcagcaccaccggcaacggagccccgccacctgctgtacccgtccaccttctctggttgacctccctggggccagacagcccactcagagtccgtgctccctcctatggagatgaaggagctgtgtccacaggcgtgcacacagggagaacgccgtgggaacctgcaggcagagactgggggtgcatctaccagccaaggaacacccaggactgccagcagtaccaggaagttgcagagcaacacgggcatcctccttaccgctctcagaagattccagccctgcagatacctgaaccttcagtttccaacctccagacctggaagacagtaaagctctgttgttgtagcccctggtgtgtggtcctttgtgacagcagccct

SEQ ID NO: 463511 - DNA, 1667 bp, Homo sapiens
caaggtgttagcaataatggacacttctctaccttctgccacactctgaacaatgccacacttccatcaaatggattcatcccaaagcctgtgctgcgtgcctaagggaacgtcacaagacagtaggtctggaaagaagcacccaggcagccaagggtgggagctgcaccccaggatcacaaacgccttggtgaatgcctgctctacctgcagtgtggcccctttggcctctacagctggaagtcttcatctgtacaaagtgaataataaaaatattataaaacaaaggcagtcacaaatagccacattggtgttgaggtacaatcagtttatgatcctgggagagcaagaagcaaggagccagcaagtctggacacattccagaggccacgaggggttttatgtcctgagtcctggattccatccaagccatgaggggttttatgccctaggcttaggttgtagtgcggcggggcagccttccacccttaagcacagaacctggtgttccataggccacaagaagttttaaactctggacccaggacatgttccaaggctcttttcatattatgtcagactagcaagtcttgcctcagcttttctcccaacaattggactgatgggttgctccactgggcacaagcatcatgggttcttaaaacaaggccctgaacaagcaccaaatatgttcctgtcaccacactccactagcccttcaactataaacatgcataggagtcacctgggggccttgctaaataaaatgcagcttctgattcaatagtctcaaacaggaccagagattctgcgtctcttgttgagttcccgagtgaggcagacaatgccagtccacagactcacattttgagatacagcacctgggccattgtgttccaatgtgcttgataacctggagcacctattaaatatccaagttgccaggactttcttctggaaatcttaattcagtatgttttgtttggagccttggacgtttgggaaaactagaatttctttctctccctttagacaaaagtcaactactgctgaggcatgggcttaataaatgttgactaaaatatccaactcaacaaccaatcctgtataattttcaaactctgtcaataacttgctgggtccaacctgcagaccctggctgcgtgatggatgaagaaatgcactcagacacagatcccctacaaaagaccatgtttcttctcagcttgctcagtccagctgagccagctttccactggactcctgaatgtgagaaggacacaggctcccaggaccatccagaagcatctctcatcaccttaaagctctgaaacactggctgggtgcagaggctcacacaagtaatcccaacacattaagaggctgaggtgggaggattgcttgaggccaggaattcaagaccagcctaggcagcatagcaagaccccatctctacaaaaagtacaccccaaaattacctgggtgtggtggcacatgcctatagtctcaattaggaggctgaggtgggactattctttgatcccaggagtttgaggctgcagtggggtatgatcgcaccaccgcactccagcctgggagacagattgagaccatctctaaaacaacaacaggccaggtgctgtggcttatgcctgtaatcccagcaa

SEQ ID NO: 463512 - DNA, 665 bp, Homo sapiens
agaacgatgtcacctgcctatcacagccagacaaaagtcaactactgctgaggcatgggcttaataaatgttgactaaaatatccaactcaacaaccaatcctgtataattttcaaactctgtcaataacttgctgggtccaacctgcagaccctggctgcgtgatggatgaagaaatgcactcagacacagatcccctacaaaagaccatgtttcttctcagcttgctcagtccagctgagccagctttccactggactcctgaatgtgagaaggacacaggctcccaggaccatccagaagcatctctcatcaccttaaagctctgaaacactggctgggtgcagaggctcacacaagtaatcccaacacattaagaggctgaggtgggaggattgcttgaggccaggaattcaagaccagcctaggcagcatagcaagaccccatctctacaaaaagtacaccccaaaattacctgggtgtggtggcacatgcctatagtctcaattaggaggctgaggtgggactattctttgatcccaggagtttgaggctgcagtggggtatgatcgcaccaccgcactccagcctgggagacagattgagaccatctctaaaacaacaacaggccaggtgctgtggcttatgcctgtaatcccagcaa

SEQ ID NO: 463513 - DNA, 2116 bp, Homo sapiens
caaggtgttagcaataatggacacttctctaccttctgccacactctgaacaatgccacacttccatcaaatggattcatcccaaagcctgtgctgcgtgcctaagggaacgtcacaagacagtaggtctggaaagaagcacccaggcagccaagggtgggagctgcaccccaggatcacaaacgccttggtgaatgcctgctctacctgcagtgtggcccctttggcctctacagctggaagtcttcatctgtacaaagtgaataataaaaatattataaaacaaaggcagtcacaaatagccacattggtgttgaggtacaatcagtttatgatcctgggagagcaagaagcaaggagccagcaagtctggacacattccagaggccacgaggggttttatgtcctgagtcctggattccatccaagccatgaggggttttatgccctaggcttaggttgtagtgcggcggggcagccttccacccttaagcacagaacctggtgttccataggccacaagaagttttaaactctggacccaggacatgttccaaggctcttttcatattatgtcagactagcaagtcttgcctcagcttttctcccaacaattggactgatgggttgctccactgggcacaagcatcatgggttcttaaaacaaggccctgaacaagcaccaaatatgttcctgtcaccacactccactagcccttcaactataaacatgcataggagtcacctgggggccttgctaaataaaatgcagcttctgattcaatagtctcaaacaggaccagagattctgcgtctcttgttgagttcccgagtgaggcagacaatgccagtccacagactcacattttgagatacagcacctgggccattgtgttccaatgtgcttgataacctggagcacctattaaatatccaagttgccaggactttcttctggaaatcttaattcagtatgttttgtttggagccttggacgtttgggaaaactagaatttctttctctccctttagacaaaagtcaactactgctgaggcatgggcttaataaatgttgactaaaatatccaactcaacaaccaatcctgtataattttcaaactctgtcaataacttgctgggtccaacctgcagaccctggctgcgtgatggatgaagaaatgcactcagacacaggtatcctgtgaaagaatggggtaggggactgggcagctcccagacactgaggagggtgctataaagagtcagcaggtgctataaagagtcaccaggcacagccctgtcaggctggggctccaggcatttattcagtacagatttaatgacaaagttctcaagtaaacaccacaccactagagggtaattaacattgctgacctcctgagtagagagcagtcatgcgcccgcaaatgatcaaaggtctgttttaggaccacatgagtaaacaagctatttagataaacttctctacattcctatgtatctacgccctaagcttttaagagaattcagctgccttcagccaaatcttttactgaaggtatgcaaacctcccagccttccaagaagttttgtgtctatctcctacaacttaatttttataatttctcccaccaccctgacagatcccctacaaaagaccatgtttcttctcagcttgctcagtccagctgagccagctttccactggactcctgaatgtgagaaggacacaggctcccaggaccatccagaagcatctctcatcaccttaaagctctgaaacactggctgggtgcagaggctcacacaagtaatcccaacacattaagaggctgaggtgggaggattgcttgaggccaggaattcaagaccagcctaggcagcatagcaagaccccatctctacaaaaagtacaccccaaaattacctgggtgtggtggcacatgcctatagtctcaattaggaggctgaggtgggactattctttgatcccaggagtttgaggctgcagtggggtatgatcgcaccaccgcactccagcctgggagacagattgagaccatctctaaaacaacaacaggccaggtgctgtggcttatgcctgtaatcccagcaa

SEQ ID NO: 463514 - DNA, 666 bp, Homo sapiens
gaggcacctgaggaactaagagcccaggaagaaaggacagtaatgaaaaagccaacaaatgagaccaattctactctaaaagtcaccaggaaaaattcagctccactggtcctggctctaagtctactagcaaaatcttccagagaagtggaaaagccatcagccaatgtttggaaaccattttccattataaaagaaattcttccaaatcacacaaaacactctgacacttctccaattccccctatcatggggctggcagcagccgctttgcgtcctgaatgtcatgacagtgatgataacagtaatgatgataacagcaatgatgaagtctcacatttaaaattttcaagtcactcatcacatcccaagtcactcccttcattaccttttatttatactggagtcatcctgtgtgcctcagtcagaccattttgtatgtacaatgaccgacaatgagatttaacatgcagtttgcagatcctcccttctctgggtcacctgaaaataagccacaaacaaaggaatgaaattgttgatgaaaagggaagaggcaagactccatatgaagaatacaactgactcacctgtctgtacatgcctctgtgtgtgtgttttatattggtgctggtgaagatagttctttatgctgatgcttaataaggt

SEQ ID NO: 463515 - DNA, 849 bp, Homo sapiens
gaggcacctgaggaactaagagcccaggaagaaaggacagtaatgaaaaagccaacaaatgagaccaattctactctaaaagtcaccaggaaaaattcagctccactggtcctggctctaagtctactagcaaaatcttccagagaagtggaaaagccatcagccaatgtttggaaaccattttccattataaaagaaattcttccaaatcacacaaaacactctgacacttctccaattccccctatcatggggctggcagcagccgctttgcgtcctgaatgtcatgacagtgatgataacagtaatgatgataacagcaatgatgaagtctcacatttaaaattttcaagtcactcatcacatcccaagtcactcccttcattaccttttatttatactggagtcatcctgtgtgcctcagtcagaccattttgtatgtacaatgaccatctgaggcactgcctataaagtggaagatataattataatactacagacgtcattccagctttccagttgcttatggtccagcagggaggatgcacatgggaaaaataataactaatgacaaatgtgatgagtcttaacaaagaagaagagcatattgcaagggaatgtaattcactccagggacaatgagatttaacatgcagtttgcagatcctcccttctctgggtcacctgaaaataagccacaaacaaaggaatgaaattgttgatgaaaagggaagaggcaagactccatatgaagaatacaactgactcacctgtctgtacatgcctctgtgtgtgtgttttatattggtgctggtgaagatagttctttatgctgatgcttaataaggt

SEQ ID NO: 463516 - DNA, 3168 bp, Homo sapiens
aattttatagggtagagtacaagttatggaagataaattaaaagcagctaatattcaaaccagtgaatcagagacaagattatataataagtgtcaagatctggagtcgctaatacaggaaaaagatgacgtcattcaaaacttggaattgcaacttgaagagcagctggaattggagaatcagaatcttcgtttgatcaaccaaaaccaaactgaagagataagaacaatgcagtcaaaactacaagaagttcaaggaaagaagtcatccactgtctctacactaaagctttcggaaggccagcgcctgagcagtttgacctttgggtgctttttatctcgagcaaggagtcctcctcaagtagtaaaatctgaggaaatgagcaagatatcatcgaaagaacctgagttcactgaaggaaaagacatggaagaaatggaaattccagaaaagtctgttgataaccaagttctagaaaacaacagaggccagagaacattgcatcaaaccccttgtggctcagaacagaatcggaaaacaagaacaagctttgccacagatggtggcatctcccagaattctggggctcctgtgagtgactggagctctgatgaggaagacgggagcaaaggaagatccaagtccagatgcacatccaccctctccagtcacacatctgaggaaggggtccagtgtagcaggatgggaagtgaaatgtatctgacagcatctgatgacagcagctctatatttgaggaagagacttttggcataaagagaccagaacacaagaagctatattcttggcagcaggaggcacagtggaaagctctaaatagtcctcttggaaagggaaattctgaattaagtaaaaaggaacaagatagttcctcggatgaactgaataaaaaatttcaatcccagagactcgattattcatcttcatcgagtgaagccaacaccccaagccctattttgaccccagctttaatgccaaagcatcctaactcactctctggaaaaggaacacaattagtgccttcatcacacctgccacccccaaagttaaggattcctaatgttttcagtataagtgtagcactagccaaaaggcacttaagccagccacagttaagctctgacaggatgtttggtacaaatagaaacgctataagcatgatacgaccactgagacctcaggaaactgatcttgatctagttgatggagacagtacagaagttttagagaatatggacacgagttgtgatgatggattattttcctatgactccttggactctccaaattcagatgaccaggaacactgtgactcagcaaagaaggtggcatacagcaaacctccaactcctcccctgcaccgttttccttcttgggaaagcagaatttatgctgtagccaaatcaggtattcgaatgtctgaggccttcaatatggagagtgttaataaaaattctgctgcaaccctttcctatactacatcaggactttatacatctctgatatacaagaacatgaccaccccagtgtatacaactttgaaggggaaggcgacccaaataagtagcagccctttcctggatgactcatctgggtcagaggaagaagacagctccagatccagctcccggacgtcagagtcagactcacgcagtaggagtgggccaggcagccccagagccatgaaacgaggtgtgtctctctcctctgtggcttctgaaagtgattatgctattcctcctgatgcttactccacagacacggagtactcacagccagagcagaagctcccaaaaacttgctcatcttccagtgataatgggaaaaatgaaccactggaaaaatctggttatttattaaaaatgagtggtaaagtcaagtcttggaagcggcggtggtttgttcttaaaggtggtgaattactttactacaaatctccgagtgatgtaattagaaaaccccagggccatattgaacttagtgcatcctgtagtattttaagaggagataacaaacaaacagttcaggtacttaacttttttttttttttttttttttttgtatcatgccagactcaattctcaattatccaacctaatggaaaggagataggataattcagtgtttctttattcactttggggggttagtttgatgccttggaagtatgtgaaactccacgaatttttggttaaaactataatgtaagttaggtgtgtgttgagtaactcccaccacactttacctttcttcctttatactcttctttcctcatatttaatctcctaggtattttcagctgtccaactgtgaagctattttaaggaagggttatctggtaaatgaattctcaataagatgttagttatataatgtactgtgaaattcaggaatgtttgtattttaatatagaatctgaaaatgacagttcttatatgaacttcagatgccataacaccaaagtgggaaatatattgcaagaaagggaaaatgtgacaaataaacaagatataaaatcataaccccaaaattaggtaaactggagtaacaaagttatttccacaaaaatttaattgctgtaattctcacaaagtggttaaaatattctaactgatatggagtcatttatttagaaactgggacttgagatttagcatgtttgcttctgtgttaagtaatgacgtttgaataatgaacaaggaaatgctaacaatcctaaatcttcacagttttctttcctatacctttctcgttgcattctagttgaccactgaaaaacacacatactatctgactgcagattctcccaatatattggaagagtggattaaagtgttacagaatgttcttcgagtacaagctgccaacccactttccctgcagcctgagggcaaacccaccatgaagggattgctcactaaggtaaaacatggatattccaagagagtctggtgtacactaataggaaagacattatattattttcggagtcaagaagataagtttcctttaggtcagatcaaactctgggaggctaaagtggaagaggttgacagatcttgtgattcagatgaagattatgaagccagtggacgaagtctgttatccacacattatactatcgttatccatcccaaagaccaaggtc

SEQ ID NO: 463517 - DNA, 1763 bp, Homo sapiens
aattttatagggtagagtacaagttatggaagataaattaaaagcagctaatattcaaaccagtgaatcagagacaagattatataataagtgtcaagatctggagtcgctaatacaggaaaaagatgacgtcattcaaaacttggaattgcaacttgaagagcagctggaattggagaatcagaatcttcgtttgatcaaccaaaaccaaactgaagagataagaacaatgcagtcaaaactacaagaagttcaaggaaagaagtcatccactgtctctacactaaagctttcggaaggccagcgcctgagcagtttgacctttgggtgctttttatctcgagcaaggagtcctcctcaagtagtaaaatctgaggaaatgagcaagatatcatcgaaagaacctgagttcactgaaggaaaagacatggaagaaatggaaattccagaaaagtctgttgataaccaagttctagaaaacaacagaggccagagaacattgcatcaaaccccttgtggctcagaacagaatcggaaaacaagaacaagctttgccacagatggtggcatctcccagaattctggggctcctgtgagtgactggagctctgatgaggaagacgggagcaaaggaagatccaagtccagatgcacatccaccctctccagtcacacatctgaggaaggggtccagtgtagcaggatgggaagtgaaatgtatctgacagcatctgatgacagcagctctatatttgaggaagagacttttggcataaagagaccagaacacaagaagctatattcttggcagcaggaggcacagtggaaagctctaaatagtcctcttggaaagggaaattctgaattaagtaaaaaggaacaagatagttcctcggatgaactgaataaaaaatttcaatcccagagactcgattattcatcttcatcgagtgaagccaacaccccaagccctattttgaccccagctttaatgccaaagcatcctaactcactctctggaaaaggaacacaattagtgccttcatcacacctgccacccccaaagttaaggattcctaatgttttcagtataagtgtagcactagccaaaaggcacttaagccagccacagttaagctctgacaggatgtttggtacaaatagaaacgctataagcatgatacgaccactgagacctcaggaaactgatcttgatctagttgatggagacagtacagaagttttagagaatatggacacgagttgtgatgatggattattttcctatgactccttggactctccaaattcagatgaccaggaacactgtgactcagcaaagaaggtggcatacagcaaacctccaactcctcccctgcaccgttttccttcttgggaaagcagaatttatgctgtagccaaatcaggtattcgaatgtctgatgcaggatcaaaggcaggggaaagtgctcaatgggacagttacttcttctctagtgcagaagctacccctgtacaatgggggcaacatttttggatgcacagggtgtgcctggcacttggggggagattgaggaagccagctgcattgggagttggttggggctatggtgatggggatggctttctagaacctggggctggaactgggctttggaggctgggtggaatttgggggaggtggctgaatagtgtctttagtggataaggtgtgtagggaagccaagggatttgctctgggcctaagggtcctgcttgttcct

SEQ ID NO: 463518 - DNA, 2963 bp, Homo sapiens
agcaaggtgcagtggctcttgcctgcaatcccagtgctttgtgattagaggattagaggattggaacttaagccccacccaccaacatctggaagggctgagggtgcaagaaatttagctctattaaaaatttaaacactgcagtcggctcgagtactcccagtaacgaggaggtgttctcggtcgtcccaccctcccctgccgtcgccgggctgcgccgccggagccgggacgcgcctccgctgccctcgcctcctccgtccccgctgccctcgccgcccccgtccccgctgccctcgccgcctccgtccccgcggccgccgctcccctcgtcgtccgcgcgcacacgatgaagaaggagtccctcaaccagagcctcgccgagtggaagctcttcatctacaacccgaccaccggagagttcctgtggcgcaccgccaagagctggggtttgatcttgctcttctacctaattttttatgggttcctggctgcactcttctcattcacgatgtgggttatgcttcagactcaacgatgaggttccaaaataccgtgaccagattcttaacccaggactgatggtttttccaaaaccagtcactgcattggaatatgcattcagtaggtctgatctaacttcgtatgcagggtacactgaagaccttaagaagtttctaaaaccatatactttagaagaacagaaaaacctcacagtctgtcctgatggagcactttttgaacagaagggtccagtttatgttgcttgtcaatctcccatttcgttacttcaagcatgccgtggtatgaatgatcttgatttcggctattctcaaagaaacccttgtattcttgtgaaaatgaacagaataattggattaaagtctgaaggagtgccaaggatagattgtgtttcgaagaatgaagatataccaaatgtagcagtttatcctcataatggaattatagacttaaaatatttcccatattatggggaaaaactgcatgtggggtatctacagccattggttgctgttcaggtcagctttgctcctaacgatactgggaaagaagtaacagttgaatgcaagattgatggatcagccaaccttaaaagtcaggatgatcgtgacaagtttttgggacgagttatgttcaaaatcacagcatgtgcatacaagccaggccctggggaattctactaccatgggagatacacgcagacaatgctctctctctccgactacatgaggtattgcagagtgtattaattctctctctctctttttttttttttttttttgagatggagtctggctctgtcgcccaggctggagtgcaatggcatgatctcagctcactgcaagctctgcctcctaggttcacgccattctcctgcctcagcctcccgagtagctgggactacaggcgcccgccaccacacccagtgagaattcaaggggaaacagaaataaatgcagctggagaaccatcccaccatcccgaccacaactgatcttccctggacacgatgaaccacgctgtccaaaccgtcttcactcccgccaacaccagccaccccctcaactatgaaatgctcaaggaggagcatgaggtggctgtgctgagggtgccccacaaccctgttcccccgacatccaccgtgatccacatccacagtgagaccactgtgcccagccatgtcgtctggtccctgttcaacactctcttcatgaattgatgccatctgggcttcatagcattcacctactccgtgaagtctagggacaggaagatggttggcgacctgactggggcccaggcctacgcctccactgccaagtgcctgaacgtttgcaccctcatcctgggcatccgtgtgaccacaacactcatcatccttttcaccagtagttctatgataatattccaagcaatttctcaaatgataaagaatctccaaggccagcagtagcgcccaggtactcgctgtccattgcgggccctgcaccctgggcctgagttctgtatcagccctttattctcacacacttttctacaatggcattcaataaagtgcacgtgttcctggaaaaaagaaggaaagaaagaaatgcagctgttcagtcctccacattcagcccagaggtctttatactctgaacccacttcagccagacttttatccctgccactttgctgaaactgttgttatcaagaaagttgctaagtattgggaagctgttaagctcattacggcaaggacaacttttccagacttcaagattttatttgaaagcttgagttttatcattggcaacaaatactgtccattgttttcttgagggaacaggtccacttagttattttggagaaaatctctgcctcataccctagtctgaagaatgactgtcagttgttctttcacataaaaataaagttgcctgaaaaaaatggctggttcggctttcaactcaacaactgcacaagtactttcactcaggatctttgtcctggaacacggcagatgctctatgtattctccccattttgtcctactaaatgttaactcaagggttgagatttaatacaattaaaaaattttattgcttcatcaaggacattcttcagggacactggctgttttcttcttaactgctcctatgtaataaagagtatgatgaccactggtacggtttggtgccattgctttgattcatgctaaagtatgagccattttgttcaccattgttttcataccattagtgaaaatgtcatcagagtgaaaaagccaaataatgtcttagtattattatgaagtaacttttgacctctcagatgcccctgaaaatgtcttggttttttattcttcccgtcagttcttctcttgtctatttacataccataactacatgggagtgtcctcaggatgctctttaacaagtcatcaccatcataatgta

SEQ ID NO: 463519 - DNA, 2144 bp, Homo sapiens
  misc_feature (2106)..(2106): n is a, c, g, or t
agcaaggtgcagtggctcttgcctgcaatcccagtgctttgtgattagaggattagaggattggaacttaagccccacccaccaacatctggaagggctgagggtgcaagaaatttagctctattaaaaatttaaacactgcagtcggctcgagtactcccagtaacgaggaggtgttctcggtcgtcccaccctcccctgccgtcgccgggctgcgccgccggagccgggacgcgcctccgctgccctcgcctcctccgtccccgctgccctcgccgcccccgtccccgctgccctcgccgcctccgtccccgcggccgccgctcccctcgtcgtccgcgcgcacacgatgaagaaggagtccctcaaccagagcctcgccgagtggaagctcttcatctacaacccgaccaccggagagttcctgtggcgcaccgccaagagctggggtttgatcttgctcttctacctaattttttatgggttcctggctgcactcttctcattcacgatgtgggttatgcttcagactcaacgatgaggttccaaaataccgtgaccagattcttaacccaggactgatggtttttccaaaaccagtcactgcattggaatatgcattcagtaggtctgatctaacttcgtatgcagggtacactgaagaccttaagaagtttctaaaaccatatactttagaagaacagaaaaacctcacagtctgtcctgatggagcactttttgaacagaagggtccagtttatgttgcttgtcaatctcccatttcgttacttcaagcatgccgtggtatgaatgatcttgatttcggctattctcaaagaaacccttgtattcttgtgaaaatgaacagaataattggattaaagtctgaaggagtgccaaggatagattgtgtttcgaagaatgaagatataccaaatgtagcagtttatcctcataatggaattatagacttaaaatatttcccatattatggggaaaaactgcatgtggggtatctacagccattggttgctgttcaggtcagctttgctcctaacgatactgggaaagaagtaacagttgaatgcaagattgatggatcagccaaccttaaaagtcaggatgatcgtgacaagtttttgggacgagttatgttcaaaatcacagcatgtgcatacaagccaggccctggggaattctactaccatgggagatacacgcagacaatgctctctctctccgactacatgaggtattgcagagtgtattaattctctctctctctttttttttttttttttttgagatggagtctggctctgtcgcccaggctggagtgcaatggcatgatctcagctcactgcaagctctgcctcctaggttcacgccattctcctgcctcagcctcccgagtagctgggactacaggcgcccgccaccacacccagtgagaattcaaggggaaacagaaataaatgcagctggagaaccatcccaccatcccgaccacaactgatcttccctggacacgatgaaccacgctgtccaaaccgtcttcactcccgccaacaccagccaccccctcaactatgaaatgctcaaggaggagcatgaggtggctgtgctgagggtgccccacaaccctgttcccccgacatccaccgtgatccacatccacagtgagaccactgtgcccagccatgtcgtctggtccctgttcaacactctcttcatgaattgatgccatctgggcttcatagcattcacctactccgtgaagtctagggacaggaagatggttggcgacctgactggggcccaggcctacgcctccactgccaagtgcctgaacgtttgcaccctcatcctgggcatccgtgtgaccacaacactcatcatccttttcaccagtagttctatgataatattccaagcaatttctcaaatgataaagaatctccaaggccagcagtagcgcccaggtactcgctgtccattgcgggccctgcaccctgggcctgagttctgtatcagccctttattctcacacacttttctacaatggcattcaataaaaacctggcctcgttggccttagaggggganctctggggccgttccgtgtagggggtgattctgaacct

SEQ ID NO: 463520 - DNA, 2624 bp, Homo sapiens
acagtgcatttcttaatggaattagctcttcttgggcaaggcgcaaatatatatacagatacaccacaaggccataactattttaacaaatgtataaataaaatactttggggaagaaaacaagtacttccctcttctttgcaaggaaagacctgggaaaacttccttaagaccaaggagatgagacagaggaaactcccaaaggagctttcttggctccttcccagaaagccagcagagatggggtttcaccatgttggccagactggtctcaaactcttgacctcaagtgatccacccgcctcggcctcccaaagtgctgggattacaggcatgtgccaccgcgcccggcctaaatatttgttttttaaatatcttgaagatacatttgcatatacgatagaaaccaaaacgttagcaaagctactttgggtggtaggattagggtaacttagatctttcccctttggtggtctttttgttttcttttcctttttgggagacagggtcttgctctatcacccaggctggagtgcagcagcgcagtcatggcagccttgacctcccaggctcaagtgatcctctcacttcagccttccaagtagctgacaccaaacatatgcaccaccacgcccagctaatttttttttaattttttttgtagagaagaggatctcactgtgttgccgaggcttgtttcgaacttctgggctcaagtgatcctcatgcctctgcctcccaaatagctagaattacaggcacaatccaccacgcccggctaactttgtatttttagtagaggtggggtttcatcatgttggccaggctggtctcaaactcctgacctcaggtgatctgcccacctcggcctcccaaagtgctgggattacaggcatgagccaccacgcccagcccatacctaacccttttctttttcctcttgtactgtttcctccagattttctagaataagtgtgtttattttgttaatgaaactaacaacaaaaaaactctaaaagacctaaatctaaggagtttagcaccaaaaaaattatcaagacggtgcttagtgttttgtcaagagcaaacacacaggagatgacaattcaattcataaaatccttctagtggtcaaactgtccatatatcatccaaagccttaaaaataaaacttttgatttaataattccacttccaagaaattaatccaaataaaatgatcagtgataaaaacaaaattgttcaagggtatatatacatatcatttacaatagcaaaacattaaaaacaactttactttccaacaattcattcatccatttaataaatatttattcagtacctatgtgccaggcactggagatacagcagtaaacaaactgtacaaaaatctatatcaaagtacctgccctcaatggagctcacagtctagtgggggttgaaagacaggatatagacaataaaataaatatgtaaaatatttgtcatgttacattttgatacacaacatgaagaaaaattaagcaaggaagagagatagggagtaaagggtggagggttatatagattgtcaggaaaggtctaaggtggcagcatttgaggaaaggcttaaagaaagacactattgctttatatgtagacaggatatacttggcattgaatgtatcatacccttttaaactgctctgatgataatgcaatatacttttttattctaagtagaaaaataatctaagacctaatgattccacagaccttaaaaagttcaagccttggccgggcgcagtggctcatgcttgcactcccagcactttgggaggacaaggtagacggatcacctgaggtcaggagttcgagaccagcctggccaacatggtgaaaccccgtctctactaaaattataaaaatcagctgggcgtggtggtgggtgcctgtaatctcagctactcaggaggttgagggagaagaatcacttgaaccctggaggcagaggttgcagtgagctgagatcatgccactgcactccagcctgggcgacagagcgaggctgactccatctcaaaaaaaaaaaaaaaaaaaaaaagttaaagcttacagccactcatggtctgttcctaccaaaattttcaattttctcccatcttcacaattgtccccagatacaaataaattgcttcatttttaagtatcccttattgaacatgttttacattattcacaaaaatgatgaccttaataaacaccgtatcacttagtgcttctgtctcatttagagttaattgcacactggttcgatgttaacaatctaaatcctgattctcaagtaccctgggcacagctctttacctcaagtttcacaaagaacgtcatacgtgaagaaaaattaggtagtactctctactcctactgcaactttccagctcaggattacttgggttacttaagggcctcatatactccctttgccagaaggaattttgacagatgatacaaatagggcactatgcctacttacacctgcattcctcagtgcatcagcatttcagatgactaagggaatgctcctaagctctaatgtctgcaattgtacagatgtacaattagaaacatattaatttgatact

SEQ ID NO: 463521 - DNA, 1232 bp, Homo sapiens
ggtttcctgagacctcccagccacgcttcctgtacagcctgcagaactgtgtgacgcagctcgagcggggactccaggccctggaggattcctctccccaggacctcttgtgtgcagctggattgcttccctccggttctgaaaacagccccgcagaccccaggccgtgctcaatggcaatgaaacccacttctgctaaacgcaggagcgcctatttggaggaagattttttccttgaaatgattccaactaatttcatgcctttcgtgtaagaattcttcgaacagccgtggccctcctttcctcctttgttcctgcaaacagctctgtttcctcccgaggacccgaggcctcaggcctcccccgacaccggctcccttggctgccgcgtcccggcaggtggcgctgagccaccgcctttcatggcgacggtgcttcccgcgatcgggctcgcttagattttcctctgacgcaacaatttacagaatccactgttgatttagggatctggggagcctaacttaaaattaagtaaatacataaaccagggagccagtgtcttccgaacatgagcgttcatcggcacctcggtcctcgggtgaggcccggccccggctgctgctggccgctggtgcctgccggacaccctcgctccgggagagcaggatccccggccttgcgcggagcagagggacgaaggcgccgcagcccaggcctctcccagggtggtcttgagacacttcccagactggacacggagcgggaggaccgagacgcacgccctccctacggcctgcagcgcctgcctgtgcagatggcgccgtcagcccggcgtcagggtggccgtttgggggctggtggcagctttgtgctcctgtctgcagacgctgtcagagatggattggggacaatcctgcggggaggtgctgaggagggcagctacgacaactggccccacaccaggccctgggaagctcaaggtgccaggagtcctcggaaggggcgctacatctgtagggggcctggctctcggttgcggcccccaggcatgggaccagcttgctctcaggccaaggggagagggggcaaagcgcccacaaggccagtgtctgtgaccctgtgtccctcacccaacgtgggacctcccagaaccttcctccagtggcaccagtgaccgggggcagctttgaggtggtgggagatgatttagagcaacagtgggcagtttgcct

SEQ ID NO: 463522 - DNA, 462 bp, Homo sapiens
ctcagctggccgccctgctggggccaggtgacgtgcgagattccacagcctgcgggtctcgcagcagggatgttagggacggtctgagcttctctggtcctgttttggttttgtttgaaagggcttctcagagagatgctcctgattttttttttttttaatagactttcccctcctatcctaggctcaactccgaatggattggattgcgagtctgcacgtgagaaaaccgtttggcttggcttggacccctgccgccccccacctcctccacacacacccagtccaggggtcccctttatcaccctttgcttgcaactccaaaagaagttgcccacctcctgagtcacaacacaaggtcgaataattcctctagatgaaagatcagtttcatttcaaaacgagaataggttcctttttttattttctccacatggtacaaaataaacagaatttgcttta

SEQ ID NO: 463523 - DNA, 743 bp, Homo sapiens
  misc_feature (1)..(1): n is a, c, g, or t
  misc_feature (4)..(4): n is a, c, g, or t
  misc_feature (7)..(9): n is a, c, g, or t
  misc_feature (11)..(12): n is a, c, g, or t
  misc_feature (14)..(16): n is a, c, g, or t
ngcncannnanntnnnagcgagggagaagagtggatgttaagaaacaaaacaagaaattgcaaaagggagatatcagatagaaaggagaacgtaggaaatgcaactgggaaagaatttcaagaaaataaggataaagggcagggagggctgaaaggagggccagagggaggaaaagcaggagggagatttttggttttcaattccctggtgaggctgctggcgtccgcgccctcaacgccccagccttccaagttgaggcgaaagccacctcctcgggcctgctcgcgtggaggaggcttttccaggcacagcctttctcatggtaatcagcccccggcatcacctcccggccgcggctgcgcccgctcggagcgcggctcgcggaccccggggaccggaaacagggcggcgggcggggagcaggcgagcgagccaggctcaactccgaatggattggattgcgagtctgcacgtgagaaaaccgtttggcttggcttggacccctgccgccccccacctcctccacacacacccagtccaggggtcccctttatcaccctttgcttgcaactccaaaagaagttgcccacctcctgagtcacaacacaaggtcgaataattcctctagatgaaagatcagtttcatttcaaaacgagaataggttcctttttttattttctccacatggtacaaaataaacagaatttgctttaaaaaaaatcattagctgtggccaaattc

SEQ ID NO: 463524 - DNA, 1318 bp, Homo sapiens
  misc_feature (2)..(4): n is a, c, g, or t
  misc_feature (6)..(6): n is a, c, g, or t
tnnncngagcagcctacagagtctgacctacactgagggattgggctcctgcccttcccaacacagggggcacggagccgccacggccccttggctgggattagcccgtgtgtccccctcaccagaaatcagccccttcatggggccgcctcacactcccagcccagccctgtgggctttcagcaccgacgtggggacgctcactattgcagcaccgacaaggggcaccaacacggggatgttcacaattccagcaccgacatggggacgctcactattccagcaccgacacggggatgctcactattccagcaccgacgtggggacgctcgctatttcagcaccgacaaggggcaccgacacggggacgctcactattccagcaccgacaaggggcaccgacacggggacactcactattccagcaccgacacggggacgttcactatttcagcaccgacacggggacgatcactattccagcaccgacacggggacgttcactatttcagcaccgacacggggacgatcactattccagcaccgacacggggacgctcactattccagcaccgacaaggggcaccgacatggggatgctcactattccagcactgacaaggggcaccgatacggggacgcccactctaccagcaccgacacggggacgctcactattgcagcaccgacaaggggcaccgacatggggacgctcactattccagcaccgacacggggcaccgacatggggacgctcactattccagcaccgacacggggtcgctcactattccagcaccgacacggggacactcactattccagcaccgacacggggcaccgacacggggacgctcactattccagcaccgacacggggacgctcactattccagcaccgacacggggcaccgacacggggacgctcactgttccagcaccgatacggggcaccaacatgaggacgctcactattgcagcaccgatacagggatgctcactattccagcgctaatacggggacgttcactattccagcaccgacacggggacgttcacccttccagcaccaacacggggacgtttactattccagcaccgacaaggggcactgacaggggaatgcacactattccagcactgacacagggatgctcactattccagcacggacacgggtcactgacacagtgacggtcactattccagcacggacaaggggcaccgatatggggacgctcactattcaagcgccgacatgggaacactcactagtattccagtgttcccgacacgggaacactcacttctcagtaac

SEQ ID NO: 463525 - DNA, 1006 bp, Homo sapiens
ttttcataagggttaatattattattgatttccttaagtctttccaacatccacgactgtgcattaatcagtagctaaaaagaccagaaaagacagaaaaatttaactactttgttccctaattcaaatttcttcaagaagtccttctaaagatatggaactcctgcatttttcataaaacagtggttagatcaatttccgtgtaagcaatgaatcatctttatacttcacaaaagatggggagcaaagtttgacttaccaaagaaaggctgactgattagtctctgggtgaacagtctggtgggaagaccacagattcctgacccctgcacaggtttaacatgaagccctccaaggaacctttcagaactgcagcaatgacttacggtggcttcagagtggggtggttggatgaatctgaggatgtggaacccgtggatatggagggctgactcaatgccttgatgagcttgaagataagtatatacccccgaaaccaccaccacaaacaatgccataaacttaaccactgcctctaaaaaacttcctggtgctcaggcctggcctcacaaaagggaacaaccgttcatgtccagacacattgcagacttctggcaaagcagcctgagctcacgaaaatttacacttttcctggcaactggccgagagtatgagcaggacttggcttgggtttgctttcagttagagggtgggagtggagggaggaaggtggggctgggggatggggcagcaacatttaaaataccaaataaaactgagcatgtgaacgaagctcagagttgccattttggtcctgccctccgagtgaggatccattttgggtcccaccctcgtgtagccattctccatctcccctctgaaaaacttgagagaaaccagccgtctgccagtccacagcccgtgtgtcatttccttctccaagcctcactctttccacagaggagacttttcaaattaacgttttcagttcattaaagaccttttc

SEQ ID NO: 463526 - DNA, 3574 bp, Homo sapiens
  misc_feature (2)..(3): n is a, c, g, or t
  misc_feature (7)..(7): n is a, c, g, or t
  misc_feature (10)..(10): n is a, c, g, or t
tnnatanacnctcagcccaaatcgtactaaatgggaaatgttagaagcattcccattaagaactggaagaggacaagggtgccaactttcactattcatattcaacatagtactggaagtcctagccagagcaatcaggccagagaaacaaataaaaggcatccaaataggaaaagaagtcaaattgtctctcttcattgatgagattattctatacctagaaaaccctaaagactccactaaaaggttcctggagctaataaacaacttcagtaaagattcaggacacaaaaccaatgtacaaaaatcagtagcattcccatacaccataacattcaagctgggagccaaatcaagaatacaatgccatttacaacacacaaacacacacacacacacacacacacacacacacacacccctaggaatacatataaccaggggggtgaaaggtctctatgaagggaactataaaacattgctgaaagaaatcatagatgacacaaacaaatagagaagcaccccatgctcctggattggaagaatcaatatcatgaacatggccataatacgcaaagcaatcagtctacagattcaatgctattcctatcaaactaccaatgtcattttttacagaattatacaaaacaattgtaaaattcacatagaactgaaaaagagcctgaagagccaaagcaaatataagcaaaaagaacaaagccagagaaacagctttggaatagccaataattcatattagcaaaaataaaaacgtataatggcataaaacctacccaatgggctgtatctatttatttatttatttaatggataattatatgattaaatatatacacaaaataattatacatatttatatattaaagtgatatgtttcaacacatatatacattgtgtaataatcaaatcagggcatttagcatttttattatatcaaagattcatcgtttctttgtggtgagaacattcaaaatcatctcttctggttattttgaaatatactacactattattaattttaattacctttattcacaatagcacgtcagcacttattccttctatctaactgtgaccctataaccattagccaacgtctccctcttccccctccgcactcaattccccagcctctggtaatcactattctactctctacttctataagatcgacttttgggtgcagcacactagcatggcacatgtatacatatgtaactaacctgcacattgtgcacatgtaccctaaaacttaaagtataataataataaaatttaaaaaaagatcgacttttttagattctgcatatgagtgatatcatgcagcatttgtctttctgtgcctagctcacttcggttaatttcttctaggttcaactacattggtgcaaatgacaataattcattcattttttatggctgaatagtattcaatatatacatattttcttcctccattcatctgttgatgaacacttgagttgattccatatcttggctattgtaaatagcactgcaataaacatggtagtccatatatctatttgacatattaatttcatttttgggggaaggcgaagggaaaattttcccatggccctggcaattgtaaaggtttttaatgttttaaaagtttttgctagtgattgtattagctatataataataataaccataagtagaagacctccagacatataaaatgtaggtgagtaacttagctacagtttttcagatgtatattttgttaatatgatttttaatgaatgaaaaatcataaaattaagatatattttaacctaaaatataaaataaaatgtgaaagtcacttctccttatcaaagcctaccacattgtctggtgtttgaaattatttaggttgttttcttgtctatgaaagcatgtatctagatctgtatctgtatacacatacagaaacacatgtagatatgtagactttccaaacacaaaaatatccttacttaattaaaagtacattgaactataaatgtttattcatctttgattttataattatatttatcctatacttcataggtcaactttttaataactaatttatatttttaaatgtattgaccaaatatgcccatcttatccttcataagcatttatgttttatctatatgtagttttatctcattctttatccttatgtatattttgcttcttgccttttctttcatagatgctttttattctctaaaattatagtaaaaaatttacttggattgtcaaataaataaataaataaatgtgttatatttatttatttatttatatttatgagaagagtttggctcatcttatggaaaggagacatagagcgtatcaatcacataaagcagaatttaccaatacaggtcaatatgccactgggggaattttttagctacctgcgataaaaaaagaaaatacagtgttcataattttaatgattttcttttaatccaacatcatattgtgtccagaattggttccttctggtgggttcttggtctcgctgacttcaagaatgaagccgcagaacctcacggccttcctgactaccaacagccagcacttgtgactctttgtaaagagtttactcttatagaagaaaaatgcaccaacaatgtgaatgaaaagccagaaattctaggaaatagaggtctttctccatcagcacaactaatgaatgacataaactggtgtataattcattacttctccaggagaatgattctgagatgtatggtctgctttacctcccaaatataacttccttgataatatgctttttgctaaatttttcccttcttaccttaattcctcactttcttatcattattttcctgaataaactactagcacttagattattgtctcaggttctggtttttgtgaaaccatagtaagacacacagtaccatatgtgatcctgggaagcaaagcctcaggattgggttctagaatttgatcacttttgggccaggtattttattttaaaaagggccattttattaaaggtaaggggtggtaataaactctggcatgatgatgtgagaaatagtgcagatgaaagatgacacattgctttactcagaatctctaacattggaggtctgcagggagaaataaagttgtaaggaggatagagctttttgttaactgttattgagttcttgaaaagaaaaaaacagcaactactgaccaaatatgaactcagagctcagagtcaaggtcataggctctatagaaaggagaccctcatctcctgcagctgcagggaaatctgcacagaaaaatgcctaaaatctgtttatgaaaaaaaaagaaaaaaatgcatttttggaccaatacatcttctatagcaaagcaatggtcttgatagggaaggagaggtatctgaaatagagacacctcagtgattgcaattgaaaatcttgaacacctcagtttccatgacctctctgggctgtcataagtggctttctttcttgtgctaggggatatcaaagtacctttgattggagacttcaaaaaagcaata

SEQ ID NO: 463527 - DNA, 472 bp, Homo sapiens
  misc_feature (437)..(438): n is a, c, g, or t
ccaagcgtgaacgactctcttaatttccaccgctacagaattggttccttctggtgggttcttggtctcgctgacttcaagaatgaagccgcagaacctcacggccttcctgactaccaacagccagcacttgtgactctttgtaaagagtttactcttatagaagaaaaatgcaccaacaatgtgaatgaaaagccagaaattctaggaaatagaggtctttctccatcagcacaactaatgaatgacataaactggtgtataattcattacttctccaggagaatgattctgagatgtatggtctgctttacctcccaaatataacttccttgataatatgctttttgctaaatttttcccttcttaccttaattcctcactttcttatcattattttcctgaataaactactagcagatgcggccgactacccnnccccaccccccccgcgacgtgttaagaacgtacc

SEQ ID NO: 463528 - DNA, 452 bp, Homo sapiens
ccaagcgtgaacgactctcttaatttccaccgctacagaattggttccttctggtgggttcttggtctcgctgacttcaagaatgaagccgcagaacctcacggccttcctgactaccaacagccagcacttgtgactctttgtaaagagtttactcttatagaagaaaaatgcaccaacaatgtgaatgaaaagccagaaattctaggaaatagaggtctttctccatcagcacaactaatgaatgacataaactggtgtataattcattacttctccaggagaatgattctgagatgtatggtctgctttacctcccaaatataacttccttgataatatgctttttgctaaatttttcccttcttaccttaattcctcactttcttatcattattttcctgaataaactactagcaaaaacaaaaacacaaatggcctcgctggactca

SEQ ID NO: 463529 - DNA, 343 bp, Homo sapiens
ccaagcgtgaacgactctcttaatttccaccgctacagaattggttccttctggtgggttcttggtctcgctgacttcaagaatgaagccgcagaacctcacggccttcctgactaccaacagccagcacttgtgactctttgtaaagagtttactcttatagaagaaaaatgcaccaacaatgtgaatgaaaagccagaaattctaggaaatagaggtctttctccatcagcacaactaatgaatgacataaactggtgtataattcattacttctccaggagaatgattctgagatgtatggtctgctttacctcccaaatataacttccttgataatatg

SEQ ID NO: 463530 - DNA, 1099 bp, Homo sapiens
ccaagcgtgaacgactctcttaatttccaccgctacagaattggttccttctggtgggttcttggtctcgctgacttcaagaatgaagccgcagaacctcacggccttcctgactaccaacagccagcacttgtgactctttgtaaagagtttactcttatagaagaaaaatgcaccaacaatgtgaatgaaaagccagaaattctaggaaatagaggtctttctccatcagcacaactaatgaatgacataaactggtgtataattcattacttctccaggagaatgattctgagatgtatggtctgctttacctcccaaatataacttccttgataatatgctttttgctaaatttttcccttcttaccttaattcctcactttcttatcattattttcctgaataaactactagcacttagattattgtctcaggttctggtttttgtgaaaccatagtaagacacacagtaccatatgtgatcctgggaagcaaagcctcaggattgggttctagaatttgatcacttttgggccaggtattttattttaaaaagggccattttattaaaggtaaggggtggtaataaactctggcatgatgatgtgagaaatagtgcagatgaaagatgacacattgctttactcagaatctctaacattggaggtctgcagggagaaataaagttgtaaggaggatagagctttttgttaactgttattgagttcttgaaaagaaaaaaacagcaactactgaccaaatatgaactcagagctcagagtcaaggtcataggctctatagaaaggagaccctcatctcctgcagctgcagggaaatctgcacagaaaaatgcctaaaatctgtttatgaaaaaaaaagaaaaaaatgcatttttggaccaatacatcttctatagcaaagcaatggtcttgatagggaaggagaggtatctgaaatagagacacctcagtgattgcaattgaaaatcttgaacacctcagtttccatgacctctctgggctgtcataagtggctttctttcttgtgctaggggatatcaaagtacctttgattggagacttcaaaaaagcaata

SEQ ID NO: 463531 - DNA, 2972 bp, Homo sapiens
agcccctgtgctgcaccgcggggaacctggcgtccctgcttagaacacatgcagcgtctcgggccggctaggggtacaccaaagcggacaaaagccactgaggggaaggacctcggcaaaacctgagtcctgtcctctcgctttcctccccgtgcacagcgagcttcaccacttgctccgcaccttctccatcaactactacctgtccctgggatctgtccagtcgcccagctaaagtgctcagcaggtcagcagcgcggcgagcttctatgcaggcgtggggtctggggctcctggatctctgtgtcccatttcacagagattgccacctactgccgcctgctagaagatggggaggacttcaatcttggtggtattctggacagcagcaaatacctgtaaagcatccaaaagaccaactcccacaggatagtggacggcaaagtggtgtctgagaccaacatcacagacgtcttgaggtgctaaaccagcagaagcaaggtccctttgcggagcaggagggcaataaaaacttctgtggtcaaaaaaaaaaaaaaaaaaaaaaattaccctcgcatcacagaggtgttttcctcacgcaaacgtaatatagattcattaatacatagatgtggaaattagggcaatttccacaactactcacccagagaggattaaaaaaataattgaccaccaactaattaaataaatacagaagtcataaataaagcatgagtaatgtttatacagtcaaacgaacagagaattatgagatccacgagaaagttctaaacgaagtcgtgggcgccatgatgtaccacaccttctccctcaccagggaagacctggaaaatttcaaggccctgagagtgatcgtgcaggtgggcagtggctacgacaacgtggccatcaaggctgctggcgagctcgaaattgctgtgtgcagcatcccgtccgcagccgtggaagagacagccgactccaccaccggccacatcctcaatctgtactgggggaacaggtcgctgtaccaggcactgagggaaggcacgcgagttcagagcgtggagcagattggcgaggtggcctcagtaaaggctcgcattcgtggggagatattgggcctcatcggcttcggtcgcacgcagcaggaggatgggatcgagcggtccctgggtgtgcatagggtctacacccagcaggatttgctgtatcagaacgactgcgtcttcttgcattgcaatctcaacgaacaaaactaccaccttatccatgactttactataaagcagatgaggcagggagcattccttgtgaacgcagcccgtggtggcctggagggcagaatacgaggggcagccctcgacgtgaatgagtcggagccctttagttttgctcggggtctgttgaaagatgcctggaatctcatctgcactcctctcactgcctgctacagccagcaggtgtcactggagatgagcgaggcagttgccactgagatccgccaagccatcataagtcgcatcccgggaagcttaagaaactgtgtgaacaaggaattctttgtcacatcagcgctttggaggacttctgcagccagggaagacatcatccctggagacatcccagtgactgacaacctcccaacagtggtacatccttcccaagggccctctcccaacagcccacaaaacacggggacagtcgagagcatcccaacgagcaatagcagagaatgccggaagaaaactgacaatgtcgtctgcttacggaagctctgaaagactagggtgtgatttattaacgcccaacttctattattgtgtgttaagtttttcatctgtgcatcaaatcacaaagaataaatagaacttttccctttatcagtcccttaggcacagcaggtcctgaacaccctgcttatatgttgcatcagcagttcaaatatgaaaataaaaaccatgaagaggaaatccgcatcctgtgactggagtcccttcagtctacagggactggttaccgctttttgctaataggaagattacattactagaaaatgtggagtaaactgtttgcctgtggtaaacacctgcatgcaaaggattgaagacagtaccggctcctgtacagagacgcgtctctcacatctgagctgcatattgagcggcaagttggttgtaagttcagtaaaagccgctgatgatgcaaaaaaaaaaaaaaaaagtattaagtttcacaagttgttagtaatcaagtatattttctcagtttcagatcctctgcgattttattgagtggaaagtcttgcgctgaaagggttcaagaaaaataatattgcatttccttatgtcacaggaaacacttttaatggtaacttgtcagactatgaacaaacccactttttaagatattgataaagtcttcttttcttcacgtgatattttatacaagtacacttcagatgtattggatgtggctgattttaacaaatcctattagatttgtatcaattagttacatgttctattcatagtcttttgtgaatcattgcctttttgtttaaaaagatggcctattttgagcctttgtataagtacattcctgtttttgtgacaaaagaaaaactttaaatttgtcccaaagagaaaaataatggctatcagaagtatgctttgttttagtgcgagttaccgttactgtatttgtgtattgtaaaggtggacattctaattacattaaaatgtaattagaaaaaagtgcttaatgaacaaaaacagaacatagacaacaaaagaatattagaagtgatgcatgaagaaaacgagatatcaataaaaagatttttaaaaaccaagaaaaattgtgactctgaagaacacagtaactatattaaaaatttaatcagcagtcacaaaagtggatttaataaagcagaaaaaattagacagttgataacattgcacttataaata

SEQ ID NO: 463532 - DNA, 2921 bp, Homo sapiens
agcccctgtgctgcaccgcggggaacctggcgtccctgcttagaacacatgcagcgtctcgggccggctaggggtacaccaaagcggacaaaagccactgaggggaagcgagcttcaccacttgctccgcaccttctccatcaactactacctgtccctgggatctgtccagtcgcccagctaaagtgctcagcaggtcagcagcgcggcgagcttctatgcaggcgtggggtctggggctcctggatctctgtgtcccatttcacagagattgccacctactgccgcctgctagaagatggggaggacttcaatcttggtggtattctggacagcagcaaatacctgtaaagcatccaaaagaccaactcccacaggatagtggacggcaaagtggtgtctgagaccaacatcacagacgtcttgaggtgctaaaccagcagaagcaaggtccctttgcggagcaggagggcaataaaaacttctgtggtcaaaaaaaaaaaaaaaaaaaaaaattaccctcgcatcacagaggtgttttcctcacgcaaacgtaatatagattcattaatacatagatgtggaaattagggcaatttccacaactactcacccagagaggattaaaaaaataattgaccaccaactaattaaataaatacagaagtcataaataaagcatgagtaatgtttatacagtcaaacgaacagagaattatgagatccacgagaaagttctaaacgaagtcgtgggcgccatgatgtaccacaccttctccctcaccagggaagacctggaaaatttcaaggccctgagagtgatcgtgcaggtgggcagtggctacgacaacgtggccatcaaggctgctggcgagctcgaaattgctgtgtgcagcatcccgtccgcagccgtggaagagacagccgactccaccaccggccacatcctcaatctgtactgggggaacaggtcgctgtaccaggcactgagggaaggcacgcgagttcagagcgtggagcagattggcgaggtggcctcagtaaaggctcgcattcgtggggagatattgggcctcatcggcttcggtcgcacgcagcaggaggatgggatcgagcggtccctgggtgtgcatagggtctacacccagcaggatttgctgtatcagaacgactgcgtcttcttgcattgcaatctcaacgaacaaaactaccaccttatccatgactttactataaagcagatgaggcagggagcattccttgtgaacgcagcccgtggtggcctggagggcagaatacgaggggcagccctcgacgtgaatgagtcggagccctttagttttgctcggggtctgttgaaagatgcctggaatctcatctgcactcctctcactgcctgctacagccagcaggtgtcactggagatgagcgaggcagttgccactgagatccgccaagccatcataagtcgcatcccgggaagcttaagaaactgtgtgaacaaggaattctttgtcacatcagcgctttggaggacttctgcagccagggaagacatcatccctggagacatcccagtgactgacaacctcccaacagtggtacatccttcccaagggccctctcccaacagcccacaaaacacggggacagtcgagagcatcccaacgagcaatagcagagaatgccggaagaaaactgacaatgtcgtctgcttacggaagctctgaaagactagggtgtgatttattaacgcccaacttctattattgtgtgttaagtttttcatctgtgcatcaaatcacaaagaataaatagaacttttccctttatcagtcccttaggcacagcaggtcctgaacaccctgcttatatgttgcatcagcagttcaaatatgaaaataaaaaccatgaagaggaaatccgcatcctgtgactggagtcccttcagtctacagggactggttaccgctttttgctaataggaagattacattactagaaaatgtggagtaaactgtttgcctgtggtaaacacctgcatgcaaaggattgaagacagtaccggctcctgtacagagacgcgtctctcacatctgagctgcatattgagcggcaagttggttgtaagttcagtaaaagccgctgatgatgcaaaaaaaaaaaaaaaaagtattaagtttcacaagttgttagtaatcaagtatattttctcagtttcagatcctctgcgattttattgagtggaaagtcttgcgctgaaagggttcaagaaaaataatattgcatttccttatgtcacaggaaacacttttaatggtaacttgtcagactatgaacaaacccactttttaagatattgataaagtcttcttttcttcacgtgatattttatacaagtacacttcagatgtattggatgtggctgattttaacaaatcctattagatttgtatcaattagttacatgttctattcatagtcttttgtgaatcattgcctttttgtttaaaaagatggcctattttgagcctttgtataagtacattcctgtttttgtgacaaaagaaaaactttaaatttgtcccaaagagaaaaataatggctatcagaagtatgctttgttttagtgcgagttaccgttactgtatttgtgtattgtaaaggtggacattctaattacattaaaatgtaattagaaaaaagtgcttaatgaacaaaaacagaacatagacaacaaaagaatattagaagtgatgcatgaagaaaacgagatatcaataaaaagatttttaaaaaccaagaaaaattgtgactctgaagaacacagtaactatattaaaaatttaatcagcagtcacaaaagtggatttaataaagcagaaaaaattagacagttgataacattgcacttataaata

SEQ ID NO: 463533 - DNA, 2939 bp, Homo sapiens
tttcttataacaatgtaaacaataataatatctaagtgagataccgttttaatgcatttcaataattatcttcaggacctcggcaaaacctgagtcctgtcctctcgctttcctccccgtgcacagcgagcttcaccacttgctccgcaccttctccatcaactactacctgtccctgggatctgtccagtcgcccagctaaagtgctcagcaggtcagcagcgcggcgagcttctatgcaggcgtggggtctggggctcctggatctctgtgtcccatttcacagagattgccacctactgccgcctgctagaagatggggaggacttcaatcttggtggtattctggacagcagcaaatacctgtaaagcatccaaaagaccaactcccacaggatagtggacggcaaagtggtgtctgagaccaacatcacagacgtcttgaggtgctaaaccagcagaagcaaggtccctttgcggagcaggagggcaataaaaacttctgtggtcaaaaaaaaaaaaaaaaaaaaaaattaccctcgcatcacagaggtgttttcctcacgcaaacgtaatatagattcattaatacatagatgtggaaattagggcaatttccacaactactcacccagagaggattaaaaaaataattgaccaccaactaattaaataaatacagaagtcataaataaagcatgagtaatgtttatacagtcaaacgaacagagaattatgagatccacgagaaagttctaaacgaagtcgtgggcgccatgatgtaccacaccttctccctcaccagggaagacctggaaaatttcaaggccctgagagtgatcgtgcaggtgggcagtggctacgacaacgtggccatcaaggctgctggcgagctcgaaattgctgtgtgcagcatcccgtccgcagccgtggaagagacagccgactccaccaccggccacatcctcaatctgtactgggggaacaggtcgctgtaccaggcactgagggaaggcacgcgagttcagagcgtggagcagattggcgaggtggcctcagtaaaggctcgcattcgtggggagatattgggcctcatcggcttcggtcgcacgcagcaggaggatgggatcgagcggtccctgggtgtgcatagggtctacacccagcaggatttgctgtatcagaacgactgcgtcttcttgcattgcaatctcaacgaacaaaactaccaccttatccatgactttactataaagcagatgaggcagggagcattccttgtgaacgcagcccgtggtggcctggagggcagaatacgaggggcagccctcgacgtgaatgagtcggagccctttagttttgctcggggtctgttgaaagatgcctggaatctcatctgcactcctctcactgcctgctacagccagcaggtgtcactggagatgagcgaggcagttgccactgagatccgccaagccatcataagtcgcatcccgggaagcttaagaaactgtgtgaacaaggaattctttgtcacatcagcgctttggaggacttctgcagccagggaagacatcatccctggagacatcccagtgactgacaacctcccaacagtggtacatccttcccaagggccctctcccaacagcccacaaaacacggggacagtcgagagcatcccaacgagcaatagcagagaatgccggaagaaaactgacaatgtcgtctgcttacggaagctctgaaagactagggtgtgatttattaacgcccaacttctattattgtgtgttaagtttttcatctgtgcatcaaatcacaaagaataaatagaacttttccctttatcagtcccttaggcacagcaggtcctgaacaccctgcttatatgttgcatcagcagttcaaatatgaaaataaaaaccatgaagaggaaatccgcatcctgtgactggagtcccttcagtctacagggactggttaccgctttttgctaataggaagattacattactagaaaatgtggagtaaactgtttgcctgtggtaaacacctgcatgcaaaggattgaagacagtaccggctcctgtacagagacgcgtctctcacatctgagctgcatattgagcggcaagttggttgtaagttcagtaaaagccgctgatgatgcaaaaaaaaaaaaaaaaagtattaagtttcacaagttgttagtaatcaagtatattttctcagtttcagatcctctgcgattttattgagtggaaagtcttgcgctgaaagggttcaagaaaaataatattgcatttccttatgtcacaggaaacacttttaatggtaacttgtcagactatgaacaaacccactttttaagatattgataaagtcttcttttcttcacgtgatattttatacaagtacacttcagatgtattggatgtggctgattttaacaaatcctattagatttgtatcaattagttacatgttctattcatagtcttttgtgaatcattgcctttttgtttaaaaagatggcctattttgagcctttgtataagtacattcctgtttttgtgacaaaagaaaaactttaaatttgtcccaaagagaaaaataatggctatcagaagtatgctttgttttagtgcgagttaccgttactgtatttgtgtattgtaaaggtggacattctaattacattaaaatgtaattagaaaaaagtgcttaatgaacaaaaacagaacatagacaacaaaagaatattagaagtgatgcatgaagaaaacgagatatcaataaaaagatttttaaaaaccaagaaaaattgtgactctgaagaacacagtaactatattaaaaatttaatcagcagtcacaaaagtggatttaataaagcagaaaaaattagacagttgataacattgcacttataaata

SEQ ID NO: 463534 - DNA, 744 bp, Homo sapiens
tatagttcctattttataaatggagagatgaggccctgagagctcttatatggtagaaccaggatttggatccaagtttgtctggtctggagtccatgtactttctattctgcactactgcttctgaagagtggattgacaattattctctggactttttggtaaccaagaacttctagcaactaaccctggcatgaccaccagaatctgcagggctgagagaagaaagaaaggcaaaagtggatgaatgcagctgaagatgctgtggaactcctatcacattccaagtgctgtgttgatatctggagatatagacaagatcgaagcagatgcagtctttcacatgaatatttgaatcaggcagtatgttccccaaattagcaaagtatctcccagattttttctttgatgatatatttgaaatcctaatgctgaaagttaaattatcagggttttaaaactagaagcagtcattatcagaattttatatactatttatttttaagaacgtaatttgactgtttaagtcttattataattttaagtgaagtactttgggcagtcataaataaagtaatgggcaggtatttagtattcatattgtgtggattcatatccatactctgccactcagtatctctgggattttgatgaatgatcaaactctctgagcctcagttttctaatctgtaaagcagaaatgataatggtatgtagtgataattaaacaatttactagttgta

SEQ ID NO: 463535 - DNA, 960 bp, Homo sapiens
tatgttgcaattaactggtgggttttgtgaacatgccaacaatgctcgagtcatctgaattagaagtgataaccagtgaggcccaggggccaccagagagcctcacggtgaggtgctggatgatactctcagacccttctcctcaagtaaaggaggacatgctacacaaggaaggattgcaagtttatggaggtggctttataggcatggacgtgtgctctaactctgagctatgtggaactaagatctcctcgaagcatctgaagaagacttttctagacagagaaaatcctttcaaggagagcactgatggcccacccctgattgtggccctggtcttcatgtctgcatcagcctcagccatctcaagaccacaacaggaacatagccaagtcagagaaggaagaccaaaagcaccagggcccttcatattattaagctgctaaattaactaatcttggaaacttctagactctacaattcttgttgtatgagaaatcatctactacataaaattctggtttcatacttggccattcctgcttaacggagctaacaaagaaatttaagagtggattgacaattattctctggactttttggtaaccaagaacttctagcaactaaccctggcatgaccaccagaatctgcagggctgagagaagaaagaaaggcaaaagtggatgaatgcagctgaagatgctgtggaactcctatcacattccaagtgctgtgttgatatctggagatatagacaagatcgaagcagatgcagtctttcacatgaatatttgaatcaggcattaatggaatggcttcaataatacagtaaaattaagatattcaaacaagcaggatgcaggtgatgggtattggcctcagctttagagaccagaggttaaatctcagtgctgcctgccacaaaacgatccatgtaagtcaataaacaatgcttttta

SEQ ID NO: 463536 - DNA, 997 bp, Homo sapiens
tatagttcctattttataaatggagagatgaggccctgagagctcttatatggtagaaccaggatttggatccaagtttgtctggtctggagtccatgtactttctattctgcactactgcttctgaagagtggattgacaattattctctggactttttggtaaccaagaacttctagcaactaaccctggcatgaccaccagaatctgcagggctgagagaagaaagaaaggcaaaagtggatgaatgcagctgaagatgctgtggaactcctatcacattccaagtgctgtgttgatatctggagatatagacaagatcgaagcagatgcagtctttcacatgaatatttgaatcaggcattaatggaatggcttcaataatacagtaaaattaagatattcaaacaagcaggatgcaggtgatgggtattggcctcagctttagagaccagaggttaaatctcagtgctgcctgccacaaaacgatccatgtaagtcaataaacaatgctttttaaaatattattataaagatatagtgtgtggatccctctcaattgtccattcttccctgtcacaaaaatttgcctgcttttcgttaccatgtgagaggcaaatgaattgaactaaatggtttctaatgccctgtccacctctaaaattctatagaactgtgatttgattccaatgggccatatcaggactcggcattattttcatcagtgaaccatttcattagaaatttatttttccaaatgatattagtaaatattgaaggaggcttctcccacagagcttcttgtacaaattaaaacagggcagtagaaggttttcaggttggtgaagtcaactctggcttttagtcaaccattccaaaaaaacattttctttagaatccaagggcttgcaattgttctgaataaagcataaagaagctgttctgatttattaaataaaaagagtaccaaatatatgatttttaaaatgtttcaaag

SEQ ID NO: 463537 - DNA, 1314 bp, Homo sapiens
tatgttgcaattaactggtgggttttgtgaacatgccaacaatgctcgagtcatctgaattagaagtgataaccagtgaggcccaggggccaccagagagcctcacggtgaggtgctggatgatactctcagacccttctcctcaagtaaaggaggacatgctacacaaggaaggattgcaagtttatggaggtggctttataggcatggacgtgtgctctaactctgagctatgtggaactaagatctcctcgaagcatctgaagaagacttttctagacagagaaaatcctttcaaggagagcactgatggcccacccctgattgtggccctggtcttcatgtctgcatcagcctcagccatctcaagaccacaacaggaacatagccaagtcagagaaggaagaccaaaagcaccagggcccttcatattattaagctgctaaattaactaatcttggaaacttctagactctacaattcttgttgtatgagagtggattgacaattattctctggactttttggtaaccaagaacttctagcaactaaccctggcatgaccaccagaatctgcagggctgagagaagaaagaaaggcaaaagtggatgaatgcagctgaagatgctgtggaactcctatcacattccaagtgctgtgttgatatctggagatatagacaagatcgaagcagatgcagtctttcacatgaatatttgaatcaggcacaggatgcaggtgatgggtattggcctcagctttagagaccagaggttaaatctcagtgctgcctgccacaaaacgatccatgtaagtcaataaacaatgctttttaaaatattattataaagatatagtgtgtggatccctctcaattgtccattcttccctgtcacaaaaatttgcctgcttttcgttaccatgtgagaggcaaatgaattgaactaaatggtttctaatgccctgtccacctctaaaattctatagaactgtgatttgattccaatgggccatatcaggactcggcattattttcatcagtgaaccatttcattagaaatttatttttccaaatgatattagtaaatattgaaggaggcttctcccacagagcttcttgtacaaattaaaacagggcagtagaaggttttcaggttggtgaagtcaactctggcttttagtcaaccattccaaaaaaacattttctttagaatccaagggcttgcaattgttctgaataaagcataaagaagctgttctgatttattaaataaaaagagtaccaaatatatgatttttaaaatgtttcaaag

SEQ ID NO: 463538 - DNA, 1110 bp, Homo sapiens
tatgttgcaattaactggtgggttttgtgaacatgccaacaatgctcgagtcatctgaattagaagtgataaccagtgaggcccaggggccaccagagagcctcacggtgaggtgctggatgatactctcagacccttctcctcaagtaaaggaggacatgctacacaaggaaggattgcaagtttatggaggtggctttataggcatggacgtgtgctctaactctgagctatgtggaactaagatctcctcgaagcatctgaagaagacttttctagacagagaaaatcctttcaaggagagcactgatggcccacccctgattgtggccctggtcttcatgtctgcatcagcctcagccatctcaagaccacaacaggaacatagccaagtcagagaaggaagaccaaaagcaccagggcccttcatattattaagctgctaaattaactaatcttggaaacttctagactctacaattcttgttgtatgagagtggattgacaattattctctggactttttggtaaccaagaacttctagcaactaaccctggcatgaccaccagaatctgcagggctgagagaagaaagaaaggcaaaagtggatgaatgcagctgaagatgctgtggaactcctatcacattccaagtgctgtgttgatatctggagatatagacaagatcgaagcagatgcagtctttcacatgaatatttgaatcaggcagtatgttccccaaattagcaaagtatctcccagattttttctttgatgatatatttgaaatcctaatgctgaaagttaaattatcagggttttaaaactagaagcagtcattatcagaattttatatactatttatttttaagaacgtaatttgactgtttaagtcttattataattttaagtgaagtactttgggcagtcataaataaagtaatgggcaggtatttagtattcatattgtgtggattcatatccatactctgccactcagtatctctgggattttgatgaatgatcaaactctctgagcctcagttttctaatctgtaaagcagaaatgataatggtatgtagtgataattaaacaatttactagttgta

SEQ ID NO: 463539 - DNA, 1613 bp, Homo sapiens
ctggattcaatccagaaaacaaaatccactctcctagaggtttacgcgggtcattgggcattcttgagaaatagccacagcgtaacctcatcgcttgctcacttgcaccatgcttgctggaatcgccacggcaaggttttacaccgcttcccctctcccaccctcgggcccacctttcctgtcctttgaggaggacccgcggcagcaggcactggagctggtggtgcaggaggtctccagcgtgctcaggtcggcggaggagaaggtggtggtctgtcacgtggtgggccaggctattcagttcttggtcagcgagacgcctgccttgggtgctggatgccggctgtacgacatgcggctctcccctttccatttacaggaccaggtggctgagacaagtgcgatgtctgacgttctcaaggacatcttgaagcatttggctggttctgcctctccatcagtggttctgattaccaagcccacgactgtaaaggaagctcagaacttacagtgtgctgcatctactgctcaggaatcctgtcctcctaaacctccaagggctcacgagctgaagctactggtgaggaacatccacgtcttgctgctcagcgagcccggtgcctcaggccacattaatgcagtgtgcgtcgtgcagctgaacgatcctgttcagaggttctccagcaccctgacgaaaaacactccggacctcatgtgggaagaggaattcaccttcgagttgaatgccaagtcgaaggagttacacctgcagatttcagaggctgggcgatcctcagaaggtctgctggcgacggcgacagttcctctggacttatttaagaagcagccttctgggccacagagcttcacgctgaccagcgggtctgcctgcggcagctcggtgctgggctcggtcacggcagagttctcttacatggaacctggtgaattgaaatcctggcccatccctccccctgttcctgctgcaaaaatagaaaaggaccgcacggtgatgccctgtgggactgtggtcactactgtcactgctgtgaagaccaagcctcgcgtcgacgtggggagggcgtccccgctgagctctgattctccggtgaagactcccatcaaggtgaaggtgatcgagaaggacatctctgtccaggccatcgcctgccgcagcgcccccgtcagcaaaacactctcttcttcagacacagaattgttggtgttgaatggttcggatccagtggctgaagtggccattcgacagctcagtgaatcttcaaagctgaaactcaagtcgccacggaagaaaagcactattatcatatcagggatctccaaggtaccatcgtggtggctggggaggtgttcatctggtcatctgtcagtgacctgctgctcctctgccctttgaagaagttagcccaagcacttggttaacgtccagagagttccatttacaaatgtcaaattatgttcctcaccccacaaaggagtcatgtgtggtgttgtgtttacacagtttatcctattcaccaaggacatgggagactttctaatcagggacgctttacacgttgagaggttggcaaatcatttcaagaaaaattatc

SEQ ID NO: 463540 - DNA, 5612 bp, Homo sapiens
ctggattcaatccagaaaacaaaatccactctcctagaggtttacgcgggtcattgggcattcttgagaaatagccacagcgtaacctcatcgcttgctcacttgcaccatgcttgctggaatcgccacggcaaggttttacaccgcttcccctctcccaccctcgggcccacctttcctgtcctttgaggaggacccgcggcagcaggcactggagctggtggtgcaggaggtctccagcgtgctcaggtcggcggaggagaaggtggtggtctgtcacgtggtgggccaggctattcagttcttggtcagcgagacgcctgccttgggtgctggatgccggctgtacgacatgcggctctcccctttccatttacaggaccaggtggctgagacaagtgcgatgtctgacgttctcaaggacatcttgaagcatttggctggttctgcctctccatcagtggttctgattaccaagcccacgactgtaaaggaagctcagaacttacagtgtgctgcatctactgctcaggaatcctgtcctcctaaacctccaagggctcacgagctgaagctactggtgaggaacatccacgtcttgctgctcagcgagcccggtgcctcaggccacattaatgcagtgtgcgtcgtgcagctgaacgatcctgttcagaggttctccagcaccctgacgaaaaacactccggacctcatgtgggaagaggaattcaccttcgagttgaatgccaagtcgaaggagttacacctgcagatttcagaggctgggcgatcctcagaaggtctgctggcgacggcgacagttcctctggacttatttaagaagcagccttctgggccacagagcttcacgctgaccagcgggtctgcctgcggcagctcggtgctgggctcggtcacggcagagttctcttacatggaacctggtgaattgaaatcctggcccatccctccccctgttcctgctgcaaaaatagaaaaggaccgcacgtgaatcttcaaagctgaaactcaagtcgccacggaagaaaagcactattatcatatcagggatctccaagtatctcaggaccacgacgctgccctgatgcagggctacacggcctctgtggacagcacccaccaggaggacgccccatcccatccggagagggcggcagcctctgccccgccagaggaagccgagtcagcccaggcatcccttgcccccaagccccaggaggacgagctagactcctgggacttggagaaggagccacaggccgcggcatggagcagccaggtcctgctggaccccgacggtgatgagctgtcagagagctccatgagtgtcttggagccgggcactgccaaaaagcataaaggaggaattctaaggaaaggtgcaaagctgttcttccgccggcggcatcaacagaaagacccaggcatgagtcagtcacacaatgaccttgtgttcctggagcagccagagggttcccggaggaaaggcatcaccctcaccaggatcctgaacaagaagctgctctccaggcacagaaacaagaacaccatgaacggtgcccccgtggagccctgcacgtagggcctgaggtcatcacctccaagccagaagacgtgcacccatgttaactaccctcaccaggacgcagccagtgtgtccgccggatgtccagatgccccgcttgtcttgctgggtttcttccaaccatctcgtcatttaaagggaaaacaaaatctgagtctccagccaggaggcttctcccagagaggacaaaaaagcccaacttgccaccagatgctaaatgagacttgacagctgcagagcttgggctgtgctcatagctaagggttagggttcaatattagaaggagattaacattataagtgaaataatatgctctaatagattgtggagggcaggtttgagggacttagtttacctattctacactaacaagtgttgttttgggtccatgcctggaccatgtcacaaaaaggaggtgcccccctgtgctgtcactgtgaatggaaaggatgggtcacctctcttcatctgctgcttggaataaaaaatgcagctggccctgagtacagggaagtggaacataggcaggattttggattaatagagaaattttgataagaatggagacgctacgacagatgtaggaagtcatctacctttgatattagccatagaacttgaacactaactatatcctatgcatagtatgcagaacacttttctaagtttactttgagcctacttgcaagtggaagatatatatattctcacatggtttttacatttttctctatcgtgttaaaagctctaataatgctagtggagcagttgacatccagggttttttttcctgcctgtcatacttgctaaacaagagcacagcgggcctgtcagatgaagtcaggagccatacgtgaccgctcgtagaacacagtaaccaaacacatacatggattttgccaagtgctgccagtagccaaaacaaagtctttttagggcaatagaggaaattattttgtgtctcaggtgtcagtcttaggaatggaagtttaataacaaatgggccaaactcgcaggacattccttctatgagcgcttcagaattttgctgtgaacagtcctcttggacacaggttggggtgcccttgtttgggtttgttttggtggaaaacatcacaaacctggcacaccatttgaatatccctaatatcattccagtcgctttcctcatcagttgcctttctatttcagttcattcacagatctcacttctgaatgtgccacttccagtagacatgctggtcaaagagcagtcatcattggggtgaagtgttcttgacagtttaatatgattcacttttctccaaagacatgtaaaaggctgttacgaaagcttggcttctgtcatggagacggaaatgggcaagcttccttccgtagcctcttgttaatccttaaacattaaatatttcgggggtaatagagccactggtgagtaaaaacctatataaaaaccaaaattataggattttttcttttttagtaaaaacctgtatcaaaaccaaaattataggatttttttcttttttagtaaaaacctatataaaaaccaaaattataggattttttcttttttagtaaaaacctatatgaaaaccaaaattataggatttttttcttttttagtaaaaacctgtataaaaaccaaaattataggatttttttttcttcttttttagagagagagattagaaaacgacattaggaatttcactttaaaatgcgcattacaaacttcttaggtgttccaggaattatcaagtgactttaaaatgacttttccaacctgctttgtttttaaaaattatattccagttttaatcattgtaaaaaaagcacctggagtttcaaaacatgtgaatactaccaagtttctgtccccaaagtcaggcatcactgctagtcttttgggacagatgggacagatgttcactttaatgttttacttgaagttttactgctctttgccatgtggtaaaaagaggctgagacatatttaagaattccaagaggatattatgtgtcagaatttcagacactgatgagaagtttttaattgttcttttttatttgattttggaattcaggtgcactctattcaagtgcaaggatatcagaagtttttttttatttaaaaaatttttttttcgagatggagtttcactctgttgcccaggctggagtgcaatggcagcttactgcaacctccacctcctggttcaagcgattctcctgcctcagcctcccaagtagctgggattacaggcacgcgccaccacacctggctaattctatttagtagaaatggagtctcaccatgttggtcaggctggtctcgaactcctgacctcaggtgatccacccaccttggcctcccagcgtgctgggattataggcatgagccaccaggccggccccaggattttatattaagccttcttgctctcaaaaaaaaaaaaaggttttaactattccatttccagatgaatcccatgagcgctgcttactgttgaataccaaggtctagggctctgcttcctgtagacacgcacacgttgtctccatccaatggccttttctgaagttacagaaaacaccaacatgggagggagtttatgaagcaaaggcaaaggcaacacgtcggctagcttcagggtagcaccgtgagaaatgggctgtattgatactgtgaatgtttgttttccaagctgttttatacaggtttgttttttcatggtgtagggtatttatgacaaagtaaatgttgtgaaggttaaagataaattaagattatccaccaaatgctaaaaatactgatgtgtaaatcacctttatcgcctcacctcttctacaagcttttgtggcttgagggcttttgtttttggcttttgtctggatgaaagttttgcccagttgtgttttaaaaacaattcctcatgaacactaagattaattgtgtctgtatctctggaactgggtgctcatgttggttttaatgagcttgcaacccttccccgtttgctttgtttaaggaggtgcctctgttctttgtggaggagtgaaatggagctttaagtgtgtgtgtgtgttatgtgtgtttgcacacacgcgtgtgttattgtagcaataacaaaaagtagccatctccttgttccagctgaaaacctgctgtgagagttttgacagagcactttattttcgtcaagtttcaagtctgagttcaaaaccagccctgatcccttatgaccaactgctactcgaccagtcgccactcagtggccacctggtgcccgtttagatttttgcttgggttttactggccacctctatagacgagagttgcaaagttgctttgagcagagagggaaagattaatttacactgctggccaccgaaggcaggtgtttcctgggtagtaatctcacggctcttgatctggaaacttcagagtacaaattggtggatggtggaaggcaggacacgtatctctgtctgacggaaaacagacctcggggctggcgtaaaccctgctgccaggccctctccccactgccccaaaccggcctagacacgaagaccaaagcagcctgcacagggcaaggcccccgcggaatcctgcagagcaaactcaggttaacttgggtccatgaccgtttgcattcgaaacacaatacactgcctcgttctctcagttagcagctgggcagcagcgcaccattcatcatttaggcttgtggtttgttgtttactctaccaatgttatgtcgaaactgcattgtaaaaagagaagaaaatggcaggttttccaggtccacggaaaggtttggcctgacgctggagtgcggtgatgaacttacgtgacaatgattgtattcctcagtagcactttaaacgccgaagacagccctgcagcaagcctgcacacgggcttgggtgggttcctttggagaagatgtggctggaacacaaacaatctttgaaagaaataaatgtgcacacagaaca

SEQ ID NO: 463541 - DNA, 4071 bp, Homo sapiens
gttcagaggatcccttagcacatttagtcatgaacggtgcccccgtggagccctgcacgtagggcctgaggtcatcacctccaagccagaagacgtgcacccatgttaactaccctcaccaggacgcagccagtgtgtccgccggatgtccagatgccccgcttgtcttgctgggtttcttccaaccatctcgtcatttaaagggaaaacaaaatctgagtctccagccaggaggcttctcccagagaggacaaaaaagcccaacttgccaccagatgctaaatgagacttgacagctgcagagcttgggctgtgctcatagctaagggttagggttcaatattagaaggagattaacattataagtgaaataatatgctctaatagattgtggagggcaggtttgagggacttagtttacctattctacactaacaagtgttgttttgggtccatgcctggaccatgtcacaaaaaggaggtgcccccctgtgctgtcactgtgaatggaaaggatgggtcacctctcttcatctgctgcttggaataaaaaatgcagctggccctgagtacagggaagtggaacataggcaggattttggattaatagagaaattttgataagaatggagacgctacgacagatgtaggaagtcatctacctttgatattagccatagaacttgaacactaactatatcctatgcatagtatgcagaacacttttctaagtttactttgagcctacttgcaagtggaagatatatatattctcacatggtttttacatttttctctatcgtgttaaaagctctaataatgctagtggagcagttgacatccagggttttttttcctgcctgtcatacttgctaaacaagagcacagcgggcctgtcagatgaagtcaggagccatacgtgaccgctcgtagaacacagtaaccaaacacatacatggattttgccaagtgctgccagtagccaaaacaaagtctttttagggcaatagaggaaattattttgtgtctcaggtgtcagtcttaggaatggaagtttaataacaaatgggccaaactcgcaggacattccttctatgagcgcttcagaattttgctgtgaacagtcctcttggacacaggttggggtgcccttgtttgggtttgttttggtggaaaacatcacaaacctggcacaccatttgaatatccctaatatcattccagtcgctttcctcatcagttgcctttctatttcagttcattcacagatctcacttctgaatgtgccacttccagtagacatgctggtcaaagagcagtcatcattggggtgaagtgttcttgacagtttaatatgattcacttttctccaaagacatgtaaaaggctgttacgaaagcttggcttctgtcatggagacggaaatgggcaagcttccttccgtagcctcttgttaatccttaaacattaaatatttcgggggtaatagagccactggtgagtaaaaacctatataaaaaccaaaattataggattttttcttttttagtaaaaacctgtatcaaaaccaaaattataggatttttttcttttttagtaaaaacctatataaaaaccaaaattataggattttttcttttttagtaaaaacctatatgaaaaccaaaattataggatttttttcttttttagtaaaaacctgtataaaaaccaaaattataggatttttttttcttcttttttagagagagagattagaaaacgacattaggaatttcactttaaaatgcgcattacaaacttcttaggtgttccaggaattatcaagtgactttaaaatgacttttccaacctgctttgtttttaaaaattatattccagttttaatcattgtaaaaaaagcacctggagtttcaaaacatgtgaatactaccaagtttctgtccccaaagtcaggcatcactgctagtcttttgggacagatgggacagatgttcactttaatgttttacttgaagttttactgctctttgccatgtggtaaaaagaggctgagacatatttaagaattccaagaggatattatgtgtcagaatttcagacactgatgagaagtttttaattgttcttttttatttgattttggaattcaggtgcactctattcaagtgcaaggatatcagaagtttttttttatttaaaaaatttttttttcgagatggagtttcactctgttgcccaggctggagtgcaatggcagcttactgcaacctccacctcctggttcaagcgattctcctgcctcagcctcccaagtagctgggattacaggcacgcgccaccacacctggctaattctatttagtagaaatggagtctcaccatgttggtcaggctggtctcgaactcctgacctcaggtgatccacccaccttggcctcccagcgtgctgggattataggcatgagccaccaggccggccccaggattttatattaagccttcttgctctcaaaaaaaaaaaaaggttttaactattccatttccagatgaatcccatgagcgctgcttactgttgaataccaaggtctagggctctgcttcctgtagacacgcacacgttgtctccatccaatggccttttctgaagttacagaaaacaccaacatgggagggagtttatgaagcaaaggcaaaggcaacacgtcggctagcttcagggtagcaccgtgagaaatgggctgtattgatactgtgaatgtttgttttccaagctgttttatacaggtttgttttttcatggtgtagggtatttatgacaaagtaaatgttgtgaaggttaaagataaattaagattatccaccaaatgctaaaaatactgatgtgtaaatcacctttatcgcctcacctcttctacaagcttttgtggcttgagggcttttgtttttggcttttgtctggatgaaagttttgcccagttgtgttttaaaaacaattcctcatgaacactaagattaattgtgtctgtatctctggaactgggtgctcatgttggttttaatgagcttgcaacccttccccgtttgctttgtttaaggaggtgcctctgttctttgtggaggagtgaaatggagctttaagtgtgtgtgtgtgttatgtgtgtttgcacacacgcgtgtgttattgtagcaataacaaaaagtagccatctccttgttccagctgaaaacctgctgtgagagttttgacagagcactttattttcgtcaagtttcaagtctgagttcaaaaccagccctgatcccttatgaccaactgctactcgaccagtcgccactcagtggccacctggtgcccgtttagatttttgcttgggttttactggccacctctatagacgagagttgcaaagttgctttgagcagagagggaaagattaatttacactgctggccaccgaaggcaggtgtttcctgggtagtaatctcacggctcttgatctggaaacttcagagtacaaattggtggatggtggaaggcaggacacgtatctctgtctgacggaaaacagacctcggggctggcgtaaaccctgctgccaggccctctccccactgccccaaaccggcctagacacgaagaccaaagcagcctgcacagggcaaggcccccgcggaatcctgcagagcaaactcaggttaacttgggtccatgaccgtttgcattcgaaacacaatacactgcctcgttctctcagttagcagctgggcagcagcgcaccattcatcatttaggcttgtggtttgttgtttactctaccaatgttatgtcgaaactgcattgtaaaaagagaagaaaatggcaggttttccaggtccacggaaaggtttggcctgacgctggagtgcggtgatgaacttacgtgacaatgattgtattcctcagtagcactttaaacgccgaagacagccctgcagcaagcctgcacacgggcttgggtgggttcctttggagaagatgtggctggaacacaaacaatctttgaaagaaataaatgtgcacacagaaca

SEQ ID NO: 463542 - DNA, 1400 bp, Homo sapiens
  misc_feature (10)..(10): n is a, c, g, or t
taagcccaanctgaattccgggcaaaggcaacacgtcggctagcttcagggtagcaccgtgagaaatgggctgtattgatactgtgaatgtttgttttccaagctgttttatacaggtttgttttttcatggtgtagggtatttatgacaaagtaaatgttgtgaaggttaaagataaattaagattatccaccaaatgctaaaaatactgatgtgtaaatcacctttatcgcctcacctcttctacaagcttttgtggcttgagggcttttgtttttggcttttgtctggatgaaagttttgcccagttgtgttttaaaaacaattcctcatgaacactaagattaattgtgtctgtatctctggaactgggtgctcatgttggttttaatgagcttgcaacccttccccgtttgctttgtttaaggaggtgcctctgttctttgtggaggagtgaaatggagctttaagtgtgtgtgtgtgttatgtgtgtttgcacacacgcgtgtgttattgtagcaataacaaaaagtagccatctccttgttccagctgaaaacctgctgtgagagttttgacagagcactttattttcgtcaagtttcaagtctgagttcaaaaccagccctgatcccttatgaccaactgctactcgaccagtcgccactcagtggccacctggtgcccgtttagatttttgcttgggttttactggccacctctatagacgagagttgcaaagttgctttgagcagagagggaaagattaatttacactgctggccaccgaaggcaggtgtttcctgggtagtaatctcacggctcttgatctggaaacttcagagtacaaattggtggatggtggaaggcaggacacgtatctctgtctgacggaaaacagacctcggggctggcgtaaaccctgctgccaggccctctccccactgccccaaaccggcctagacacgaagaccaaagcagcctgcacagggcaaggcccccgcggaatcctgcagagcaaactcaggttaacttgggtccatgaccgtttgcattcgaaacacaatacactgcctcgttctctcagttagcagctgggcagcagcgcaccattcatcatttaggcttgtggtttgttgtttactctaccaatgttatgtcgaaactgcattgtaaaaagagaagaaaatggcaggttttccaggtccacggaaaggtttggcctgacgctggagtgcggtgatgaacttacgtgacaatgattgtattcctcagtagcactttaaacgccgaagacagccctgcagcaagcctgcacacgggcttgggtgggttcctttggagaagatgtggctggaacacaaacaatctttgaaagaaataaatgtgcacacagaaca

SEQ ID NO: 463543 - DNA, 5555 bp, Homo sapiens
ctggattcaatccagaaaacaaaatccactctcctagaggtttacgcgggtcattgggcattcttgagaaatagccacagcgtaacctcatcgcttgctcacttgcaccatgcttgctggaatcgccacggcaaggttttacaccgcttcccctctcccaccctcgggcccacctttcctgtcctttgaggaggacccgcggcagcaggcactggagctggtggtgcaggaggtctccagcgtgctcaggtcggcggaggagaaggtggtggtctgtcacgtggtgggccaggctattcagttcttggtcagcgagacgcctgccttgggtgctggatgccggctgtacgacatgcggctctcccctttccatttacaggaccaggtggctgagacaagtgcgatgtctgacgttctcaaggacatcttgaagcatttggctggttctgcctctccatcagtggttctgattaccaagcccacgactgtaaaggaagctcagaacttacagtgtgctgcatctactgctcaggaatcctgtcctcctaaacctccaagggctcacgagctgaagctactggtgaggaacatccacgtcttgctgctcagcgagcccggtgcctcaggccacattaatgcagtgtgcgtcgtgcagctgaacgatcctgttcagaggttctccagcaccctgacgaaaaacactccggacctcatgtgggaagaggaattcaccttcgagttgaatgccaagtcgaaggagttacacctgcagatttcagaggctgggcgatcctcagaaggtctgctggcgacggcgacagttcctctggacttatttaagaagcagccttctgggccacagagcttcacgctgaccagcgggtctgcctgcggcagctcggtgctgggctcggtcacggcagagttctcttacatggaacctggtgaattgaaatcctggcccatccctccccctgttcctgctgcaaaaatagaaaaggaccgcacgtgaatcttcaaagctgaaactcaagtcgccacggaagaaaagcactattatcatatcagggatctccaagtatctcaggaccacgacgctgccctgatgcagggctacacggcctctgtggacagcacccaccaggaggacgccccatcccatccggagagggcggcagcctctgccccgccagaggaagccgagtcagcccaggcatcccttgcccccaagccccaggaggacgagctagactcctgggacttggagaaggagccacaggccgcggcatggagcagccaggtcctgctggaccccgacggtgatgagctgtcagagagctccatgagtgtcttggagccgggcactgccaaaaagcataaaggaggaattctaaggaaaggtgcaaagctgttcttccgccggcggcatcaacagaaagacccaggcatgagtcagtcacacaatgaccttgtgttcctggagcagccagagggttcccggaggaaaggcatcaccctcaccaggatcctgaacaagaagctgctctccaggcacagaaacaagaacaccatgaacggtgcccccgtggagccctgcacgtagggcctgaggtcatcacctccaagccagaagacgtgcacccatgttaactaccctcaccaggacgcagccagtgtgtccgccggatgtccagatgccccgcttgtcttgctgggtttcttccaaccatctcgtcatttaaagggaaaacaaaatctgagtctccagccaggaggcttctcccagagaggacaaaaaagcccaacttgccaccagatgctaaatgagacttgacagctgcagagcttgggctgtgctcatagctaagggttagggttcaatattagaaggagattaacattataagtgaaataatatgctctaatagattgtggagggcaggtttgagggacttagtttacctattctacactaacaagtgttgttttgggtccatgcctggaccatgtcacaaaaaggaggtgcccccctgtgctgtcactgtgaatggaaaggatgggtcacctctcttcatctgctgcttggaataaaaaatgcagctggccctgagtacagggaagtggaacataggcaggattttggattaatagagaaattttgataagaatggagacgctacgacagatgtaggaagtcatctacctttgatattagccatagaacttgaacactaactatatcctatgcatagtatgcagaacacttttctaagtttactttgagcctacttgcaagtggaagatatatatattctcacatggtttttacatttttctctatcgtgttaaaagctctaataatgctagtggagcagttgacatccagggttttttttcctgcctgtcatacttgctaaacaagagcacagcgggcctgtcagatgaagtcaggagccatacgtgaccgctcgtagaacacagtaaccaaacacatacatggattttgccaagtgctgccagtagccaaaacaaagtctttttagggcaatagaggaaattattttgtgtctcaggtgtcagtcttaggaatggaagtttaataacaaatgggccaaactcgcaggacattccttctatgagcgcttcagaattttgctgtgaacagtcctcttggacacaggttggggtgcccttgtttgggtttgttttggtggaaaacatcacaaacctggcacaccatttgaatatccctaatatcattccagtcgctttcctcatcagttgcctttctatttcagttcattcacagatctcacttctgaatgtgccacttccagtagacatgctggtcaaagagcagtcatcattggggtgaagtgttcttgacagtttaatatgattcacttttctccaaagacatgtaaaaggctgttacgaaagcttggcttctgtcatggagacggaaatgggcaagcttccttccgtagcctcttgttaatccttaaacattaaatatttcgggggtaatagagccactggtgagtaaaaacctatataaaaaccaaaattataggattttttcttttttagtaaaaacctgtatcaaaaccaaaattataggatttttttcttttttagtaaaaacctatataaaaaccaaaattataggattttttcttttttagtaaaaacctatatgaaaaccaaaattataggatttttttcttttttagtaaaaacctgtataaaaaccaaaattataggatttttttttcttcttttttagagagagagattagaaaacgacattaggaatttcactttaaaatgcgcattacaaacttcttaggtgttccaggaattatcaagtgactttaaaatgacttttccaacctgctttgtttttaaaaattatattccagttttaatcattgtaaaaaaagcacctggagtttcaaaacatgtgaatactaccaagtttctgtccccaaagtcaggcatcactgctagtcttttgggacagatgggacagatgttcactttaatgttttacttgaagttttactgctctttgccatgtggtaaaaagaggctgagacatatttaagaattccaagaggatattatgtgtcagaatttcagacactgatgagaagtttttaattgttcttttttatttgattttggaattcaggtgcactctattcaagtgcaaggatatcagaagtttttttttatttaaaaaatttttttttcgagatggagtttcactctgttgcccaggctggagtgcaatggcagcttactgcaacctccacctcctggttcaagcgattctcctgcctcagcctcccaagtagctgggattacaggcacgcgccaccacacctggctaattctatttagtagaaatggagtctcaccatgttggtcaggctggtctcgaactcctgacctcaggtgatccacccaccttggcctcccagcgtgctgggattataggcatgagccaccaggccggccccaggattttatattaagccttcttgctctcaaaaaaaaaaaaaggttttaactattccatttccagatgaatcccatgagcgctgcttactgttgaataccaaggtctagggctctgcttcctgtagacacgcacacgttgtctccatccaatggccttttctgaagttacagaaaacaccaacatgggagggagtttatgaagcaaaggcaaaggcaacacgtcggctagcttcagggtagcaccgtgagaaatgggctgtattgatactgtgaatgtttgttttccaagctgttttatacaggtttgttttttcatggtgtagggtatttatgacaaagtaaatgttgtgaaggttaaagataaattaagattatccaccaaatgctaaaaatactgatgtgtaaatcacctttatcgcctcacctcttctacaagcttttgtggcttgagggcttttgtttttggcttttgtctggatgaaagttttgcccagttgtgttttaaaaacaattcctcatgaacactaagattaattgtgtctgtatctctggaactgggtgctcatgttggttttaatgagcttgcaacccttccccgtttgctttgtttaaggaggtgcctctgttctttgtggaggagtgaaatggagctttaagtgtgtgtgtgtgttatgtgtgtttgcacacacgcgtgtgttattgtagcaataacaaaaagtagccatctccttgttccagctgaaaacctgctgtgagagttttgacagagcactttattttcgtcaagtttcaagtctgagtggccacctggtgcccgtttagatttttgcttgggttttactggccacctctatagacgagagttgcaaagttgctttgagcagagagggaaagattaatttacactgctggccaccgaaggcaggtgtttcctgggtagtaatctcacggctcttgatctggaaacttcagagtacaaattggtggatggtggaaggcaggacacgtatctctgtctgacggaaaacagacctcggggctggcgtaaaccctgctgccaggccctctccccactgccccaaaccggcctagacacgaagaccaaagcagcctgcacagggcaaggcccccgcggaatcctgcagagcaaactcaggttaacttgggtccatgaccgtttgcattcgaaacacaatacactgcctcgttctctcagttagcagctgggcagcagcgcaccattcatcatttaggcttgtggtttgttgtttactctaccaatgttatgtcgaaactgcattgtaaaaagagaagaaaatggcaggttttccaggtccacggaaaggtttggcctgacgctggagtgcggtgatgaacttacgtgacaatgattgtattcctcagtagcactttaaacgccgaagacagccctgcagcaagcctgcacacgggcttgggtgggttcctttggagaagatgtggctggaacacaaacaatctttgaaagaaataaatgtgcacacagaaca

SEQ ID NO: 463544 - DNA, 5792 bp, Homo sapiens
ctggattcaatccagaaaacaaaatccactctcctagaggtttacgcgggtcattgggcattcttgagaaatagccacagcgtaacctcatcgcttgctcacttgcaccatgcttgctggaatcgccacggcaaggttttacaccgcttcccctctcccaccctcgggcccacctttcctgtcctttgaggaggacccgcggcagcaggcactggagctggtggtgcaggaggtctccagcgtgctcaggtcggcggaggagaaggtggtggtctgtcacgtggtgggccaggctattcagttcttggtcagcgagacgcctgccttgggtgctggatgccggctgtacgacatgcggctctcccctttccatttacaggaccaggtggctgagacaagtgcgatgtctgacgttctcaaggacatcttgaagcatttggctggttctgcctctccatcagtggttctgattaccaagcccacgactgtaaaggaagctcagaacttacagtgtgctgcatctactgctcaggaatcctgtcctcctaaacctccaagggctcacgagctgaagctactggtgaggaacatccacgtcttgctgctcagcgagcccggtgcctcaggccacattaatgcagtgtgcgtcgtgcagctgaacgatcctgttcagaggttctccagcaccctgacgaaaaacactccggacctcatgtgggaagaggaattcaccttcgagttgaatgccaagtcgaaggagttacacctgcagatttcagaggctgggcgatcctcagaaggtctgctggcgacggcgacagttcctctggacttatttaagaagcagccttctgggccacagagcttcacgctgaccagcgggtctgcctgcggcagctcggtgctgggctcggtcacggcagagttctcttacatggaacctggtgaattgaaatcctggcccatccctccccctgttcctgctgcaaaaatagaaaaggaccgcacgtgaatcttcaaagctgaaactcaagtcgccacggaagaaaagcactattatcatatcagggatctccaagtatctcaggaccacgacgctgccctgatgcagggctacacggcctctgtggacagcacccaccaggaggacgccccatcccatccggagagggcggcagcctctgccccgccagaggaagccgagtcagcccaggcatcccttgcccccaagccccaggaggacgagctagactcctgggacttggagaaggagccacaggccgcggcatggagcagccaggtcctgctggaccccgacggtgatgagctgtcagagagctccatgagtgtcttggagccgggcactgccaaaaagcataaaggaggaattctaaggaaaggtgcaaagctgttcttccgccggcggcatcaacagaaagacccaggcatgagtcagtcacacaatgaccttgtgttcctggagcagccagagggttcccggaggaaaggcatcaccctcaccaggatcctgaacaagaagctgctctccaggcacagaaacaagaacaccatgaacggtgcccccgtggagccctgcacgtagggcctgaggtcatcacctccaagccagaagacgtgcacccatgttaactaccctcaccaggacgcagccagtgtgtccgccggatgtccagatgccccgcttgtcttgctgggtttcttccaaccatctcgtcatttaaagggaaaacaaaatctgagtctccagccaggaggcttctcccagagaggacaaaaaagcccaacttgccaccagatgctaaatgagacttgacagctgcagagcttgggctgtgctcatagctaagggttagggttcaatattagaaggagattaacattataagtgaaataatatgctctaatagattgtggagggcaggtttgagggacttagtttacctattctacactaacaagtgttgttttgggtccatgcctggaccatgtcacaaaaaggaggtgcccccctgtgctgtcactgtgaatggaaaggatgggtcacctctcttcatctgctgcttggaataaaaaatgcagctggccctgagtacagggaagtggaacataggcaggattttggattaatagagaaattttgataagaatggagacgctacgacagatgtaggaagtcatctacctttgatattagccatagaacttgaacactaactatatcctatgcatagtatgcagaacacttttctaagtttactttgagcctacttgcaagtggaagatatatatattctcacatggtttttacatttttctctatcgtgttaaaagctctaataatgctagtggagcagttgacatccagggttttttttcctgcctgtcatacttgctaaacaagagcacagcgggcctgtcagatgaagtcaggagccatacgtgaccgctcgtagaacacagtaaccaaacacatacatggattttgccaagtgctgccagtagccaaaacaaagtctttttagggcaatagaggaaattattttgtgtctcaggtgtcagtcttaggaatggaagtttaataacaaatgggccaaactcgcaggacattccttctatgagcgcttcagaattttgctgtgaacagtcctcttggacacaggttggggtgcccttgtttgggtttgttttggtggaaaacatcacaaacctggcacaccatttgaatatccctaatatcattccagtcgctttcctcatcagttgcctttctatttcagttcattcacagatctcacttctgaatgtgccacttccagtagacatgctggtcaaagagcagtcatcattggggtgaagtgttcttgacagtttaatatgattcacttttctccaaagacatgtaaaaggctgttacgaaagcttggcttctgtcatggagacggaaatgggcaagcttccttccgtagcctcttgttaatccttaaacattaaatatttcgggggtaatagagccactggtgagtaaaaacctatataaaaaccaaaattataggattttttcttttttagtaaaaacctgtatcaaaaccaaaattataggatttttttcttttttagtaaaaacctatataaaaaccaaaattataggattttttcttttttagtaaaaacctatatgaaaaccaaaattataggatttttttcttttttagtaaaaacctgtataaaaaccaaaattataggatttttttttcttcttttttagagagagagattagaaaacgacattaggaatttcactttaaaatgcgcattacaaacttcttaggtgttccaggaattatcaagtgactttaaaatgacttttccaacctgctttgtttttaaaaattatattccagttttaatcattgtaaaaaaagcacctggagtttcaaaacatgtgaatactaccaagtttctgtccccaaagtcaggcatcactgctagtcttttgggacagatgggacagatgttcactttaatgttttacttgaagttttactgctctttgccatgtggtaaaaagaggctgagacatatttaagaattccaagaggatattatgtgtcagaatttcagacactgatgagaagtttttaattgttcttttttatttgattttggaattcaggtgcactctattcaagtgcaaggatatcagaagtttttttttatttaaaaaatttttttttcgagatggagtttcactctgttgcccaggctggagtgcaatggcagcttactgcaacctccacctcctggttcaagcgattctcctgcctcagcctcccaagtagctgggattacaggcacgcgccaccacacctggctaattctatttagtagaaatggagtctcaccatgttggtcaggctggtctcgaactcctgacctcaggtgatccacccaccttggcctcccagcgtgctgggattataggcatgagccaccaggccggccccaggattttatattaagccttcttgctctcaaaaaaaaaaaaaggttttaactattccatttccagatgaatcccatgagcgctgcttactgttgaataccaaggtctagggctctgcttcctgtagacacgcacacgttgtctccatccaatggccttttctgaagttacagaaaacaccaacatgggagggagtttatgaagcaaaggcaaaggcaacacgtcggctagcttcagggtagcaccgtgagaaatgggctgtattgatactgtgaatgtttgttttccaagctgttttatacaggtttgttttttcatggtgtagggtatttatgacaaagtaaatgttgtgaaggttaaagataaattaagattatccaccaaatgctaaaaatactgatgtgtaaatcacctttatcgcctcacctcttctacaagcttttgtggcttgagggcttttgtttttggcttttgtctggatgaaagttttgcccagttgtgttttaaaaacaattcctcatgaacactaagattaattgtgtctgtatctctggaactgggtgctcatgttggttttaatgagcttgcaacccttccccgtttgctttgtttaaggaggtgcctctgttctttgtggaggagtgaaatggagctttaagtgtgtgtgtgtgttatgtgtgtttgcacacacgcgtgtgttattgtagcaataacaaaaagtagccatctccttgttccagctgaaaacctgctgtgagagttttgacagagcactttattttcgtcaagtttcaagtctgagttcaaaaccagccctgatcccttatgaccaactgctactcgaccagtcgccactcagtggccacctggtgcccgtttagatttttgcttgggttttactggccacctctatagacgagagttgcaaagttgctttgagcagagagggaaagattaatttacactgctggccaccgaaggcaggtgtttcctgggtagtaatctcacggctcttgatctggaaacttcagagtacaaattggtggatggtggaaggcaggacacgtatctctgtctgacggaaaacagacctcggggctggcgtaaaccctgctgccaggccctctccccactgccccaaaccggcctagacacgaagaccaaagcagcctgcacagggcaaggcccccgcggaatcctgcagagcaaactcaggttaacttgggtccatgaccgtttgcattcgaaacacaatacactgcctcgttctctcagttagcagctgggcagcagcgcaccattcatcatttaggcttgtggtttgttgtttactctaccaatgttatgtcgaaactgcattgtaaaaagagaagaaaatggcaggttttccaggtccacggaaaggtttggcctgacgctggagtgcggtgatgaacttacgtgacaatgattgtattcctcagtagcactttaaacgccgaagacagccctgcagcaagcctgcacacgggcttgggtgggttcctttggagaagatgtggctggaacacaaacaatctttgaaagaaataaatgtgcacacagaacaaaaaaaaaaaaaaaaaaaaattggggcggcggccggcccggaaaaagttcaacaccctggttggggccgggcccactagggaatgcacacgcccaagcgtcccggagaccggccgacaggcggtcccccaaaaaaccgggaacgggtgacaccaggccgggccggtcaaggcggctacga

SEQ ID NO: 463545 - DNA, 734 bp, Homo sapiens
gccgtataaaacacagcccctatgaagatttttgcttgggttttactggccacctctatagacgagagttgcaaagttgctttgagcagagagggaaagattaatttacactgctggccaccgaaggcaggtgtttcctgggtagtaatctcacggctcttgatctggaaacttcagagtacaaattggtggatggtggaaggcaggacacgtatctctgtctgacggaaaacagacctcggggctggcgtaaaccctgctgccaggccctctccccactgccccaaaccggcctagacacgaagaccaaagcagcctgcacagggcaaggcccccgcggaatcctgcagagcaaactcaggttaacttgggtccatgaccgtttgcattcgaaacacaatacactgcctcgttctctcagttagcagctgggcagcagcgcaccattcatcatttaggcttgtggtttgttgtttactctaccaatgttatgtcgaaactgcattgtaaaaagagaagaaaatggcaggttttccaggtccacggaaaggtttggcctgacgctggagtgcggtgatgaacttacgtgacaatgattgtattcctcagtagcactttaaacgccgaagacagccctgcagcaagcctgcacacgggcttgggtgggttcctttggagaagatgtggctggaacacaaacaatctttgaaagaaataaatgtgcacacagaaca

SEQ ID NO: 463546 - DNA, 1826 bp, Homo sapiens
ctggattcaatccagaaaacaaaatccactctcctagaggtttacgcgggtcattgggcattcttgagaaatagccacagcgtaacctcatcgcttgctcacttgcaccatgcttgctggaatcgccacggcaaggttttacaccgcttcccctctcccaccctcgggcccacctttcctgtcctttgaggaggacccgcggcagcaggcactggagctggtggtgcaggaggtctccagcgtgctcaggtcggcggaggagaaggtggtggtctgtcacgtggtgggccaggctattcagttcttggtcagcgagacgcctgccttgggtgctggatgccggctgtacgacatgcggctctcccctttccatttacaggaccaggtggctgagacaagtgcgatgtctgacgttctcaaggacatcttgaagcatttggctggttctgcctctccatcagtggttctgattaccaagcccacgactgtaaaggaagctcagaacttacagtgtgctgcatctactgctcaggaatcctgtcctcctaaacctccaagggctcacgagctgaagctactggtgaggaacatccacgtcttgctgctcagcgagcccggtgcctcaggccacattaatgcagtgtgcgtcgtgcagctgaacgatcctgttcagaggttctccagcaccctgacgaaaaacactccggacctcatgtgggaagaggaattcaccttcgagttgaatgccaagtcgaaggagttacacctgcagatttcagaggctgggcgatcctcagaaggtctgctggcgacggcgacagttcctctggacttatttaagaagcagccttctgggccacagagcttcacgctgaccagcgggtctgcctgcggcagctcggtgctgggctcggtcacggcagagttctcttacatggaacctggtgaattgaaatcctggcccatccctccccctgttcctgctgcaaaaatagaaaaggaccgcacgtgaatcttcaaagctgaaactcaagtcgccacggaagaaaagcactattatcatatcagggatctccaagtatctcaggaccacgacgctgccctgatgcagggctacacggcctctgtggacagcacccaccaggaggacgccccatcccatccggagagggcggcagcctctgccccgccagaggaagccgagtcagcccaggcatcccttgcccccaagccccaggaggacgagctagactcctgggacttggagaaggagccacaggccgcggcatggagcagccaggtcctgctggaccccgacggtgatgagctgtcagagagctccatgagtgtcttggagccgggcactgccaaaaagcataaaggaggaattctaaggaaaggtgcaaagctgttcttccgccggcggcatcaacagaaagacccaggcatgagtcagtcacacaatgaccttgtgttcctggagcagccagagggttcccggaggaaaggcatcaccctcaccaggatcctgaacaagaagctgctctccaggcacagaaacaagaacaccatgaacggtgcccccgtggagccctgcacgtagggcctgaggtcatcacctccaagccagaagacgtgcacccatgttaactaccctcaccaggacgcagccagtgtgtccgccggatgtccagatgccccgcttgttttaaacgccgaagacagccctgcagcaagcctgcacacgggcttgggtgggttcctttggagaagatgtggctggaacacaaacaatctttgaaagaaataaatgtgcacacagaaca

SEQ ID NO: 463547 - DNA, 5553 bp, Homo sapiens
ctggattcaatccagaaaacaaaatccactctcctagaggtttacgcgggtcattgggcattcttgagaaatagccacagcgtaacctcatcgcttgctcacttgcaccatgcttgctggaatcgccacggcaaggttttacaccgcttcccctctcccaccctcgggcccacctttcctgtcctttgaggaggacccgcggcagcaggcactggagctggtggtgcaggaggtctccagcgtgctcaggtcggcggaggagaaggtggtggtctgtcacgtggtgggccaggctattcagttcttggtcagcgagacgcctgccttgggtgctggatgccggctgtacgacatgcggctctcccctttccatttacaggaccaggtggctgagacaagtgcgatgtctgacgttctcaaggacatcttgaagcatttggctggttctgcctctccatcagtggttctgattaccaagcccacgactgtaaaggaagctcagaacttacagtgtgctgcatctactgctcaggaatcctgtcctcctaaacctccaagggctcacgagctgaagctactggtgaggaacatccacgtcttgctgctcagcgagcccggtgcctcaggccacattaatgcagtgtgcgtcgtgcagctgaacgatcctgttcagaggttctccagcaccctgacgaaaaacactccggacctcatgtgggaagaggaattcaccttcgagttgaatgccaagtcgaaggagttacacctgcagatttcagaggctgggcgatcctcagaaggtctgctggcgacggcgacagttcctctggacttatttaagaagcagccttctgggccacagagcttcacgctgaccagcgggtctgcctgcggcagctcggtgctgggctcggtcacggcagagttctcttacatggaacctggtgaattgaaatcctggcccatccctccccctgttcctgctgcaaaaatagaaaaggaccgcacgtgaatcttcaaagctgaaactcaagtcgccacggaagaaaagcactattatcatatcagggatctccaagtatctcaggaccacgacgctgccctgatgcagggctacacggcctctgtggacagcacccaccaggaggacgccccatcccatccggagagggcggcagcctctgccccgccagaggaagccgagtcagcccaggcatcccttgcccccaagccccaggaggacgagctagactcctgggacttggagaaggagccacaggccgcggcatggagcagccaggtcctgctggaccccgacggtgatgagctgtcagagagctccatgagtgtcttggagccgggcactgccaaaaagcataaaggaggaattctaaggaaaggtgcaaagctgttcttccgccggcggcatcaacagaaagacccaggcatgagtcagtcacacaatgaccttgtgttcctggagcagccagagggttcccggaggaaaggcatcaccctcaccaggatcctgaacaagaagctgctctccaggcacagaaacaagaacaccatgaacggtgcccccgtggagccctgcacgtagggcctgaggtcatcacctccaagccagaagacgtgcacccatgttaactaccctcaccaggacgcagccagtgtgtccgccggatgtccagatgccccgcttgtcttgctgggtttcttccaaccatctcgtcatttaaagggaaaacaaaatctgagtctccagccaggaggcttctcccagagaggacaaaaaagcccaacttgccaccagatgctaaatgagacttgacagctgcagagcttgggctgtgctcatagctaagggttagggttcaatattagaaggagattaacattataagtgaaataatatgctctaatagattgtggagggcaggtttgagggacttagtttacctattctacactaacaagtgttgttttgggtccatgcctggaccatgtcacaaaaaggaggtgcccccctgtgctgtcactgtgaatggaaaggatgggtcacctctcttcatctgctgcttggaataaaaaatgcagctggccctgagtacagggaagtggaacataggcaggattttggattaatagagaaattttgataagaatggagacgctacgacagatgtaggaagtcatctacctttgatattagccatagaacttgaacactaactatatcctatgcatagtatgcagaacacttttctaagtttactttgagcctacttgcaagtggaagatatatatattctcacatggtttttacatttttctctatcgtgttaaaagctctaataatgctagtggagcagttgacatccagggttttttttcctgcctgtcatacttgctaaacaagagcacagcgggcctgtcagatgaagtcaggagccatacgtgaccgctcgtagaacacagtaaccaaacacatacatggattttgccaagtgctgccagtagccaaaacaaagtctttttagggcaatagaggaaattattttgtgtctcaggtgtcagtcttaggaatggaagtttaataacaaatgggccaaactcgcaggacattccttctatgagcgcttcagaattttgctgtgaacagtcctcttggacacaggttggggtgcccttgtttgggtttgttttggtggaaaacatcacaaacctggcacaccatttgaatatccctaatatcattccagtcgctttcctcatcagttgcctttctatttcagttcattcacagatctcacttctgaatgtgccacttccagtagacatgctggtcaaagagcagtcatcattggggtgaagtgttcttgacagtttaatatgattcacttttctccaaagacatgtaaaaggctgttacgaaagcttggcttctgtcatggagacggaaatgggcaagcttccttccgtagcctcttgttaatccttaaacattaaatatttcgggggtaatagagccactggtgagtaaaaacctatataaaaaccaaaattataggattttttcttttttagtaaaaacctgtatcaaaaccaaaattataggatttttttcttttttagtaaaaacctatataaaaaccaaaattataggattttttcttttttagtaaaaacctatatgaaaaccaaaattataggatttttttcttttttagtaaaaacctgtataaaaaccaaaattataggatttttttttcttcttttttagagagagagattagaaaacgacattaggaatttcactttaaaatgcgcattacaaacttcttaggtgttccaggaattatcaagtgactttaaaatgacttttccaacctgctttgtttttaaaaattatattccagttttaatcattgtaaaaaaagcacctggagtttcaaaacatgtgaatactaccaagtttctgtccccaaagtcaggcatcactgctagtcttttgggacagatgggacagatgttcactttaatgttttacttgaagttttactgctctttgccatgtggtaaaaagaggctgagacatatttaagaattccaagaggatattatgtgtcagaatttcagacactgatgagaagtttttaattgttcttttttatttgattttggaattcaggtgcactctattcaagtgcaaggatatcagaagtttttttttatttaaaaaatttttttttcgagatggagtttcactctgttgcccaggctggagtgcaatggcagcttactgcaacctccacctcctggttcaagcgattctcctgcctcagcctcccaagtagctgggattacaggcacgcgccaccacacctggctaattctatttagtagaaatggagtctcaccatgttggtcaggctggtctcgaactcctgacctcaggtgatccacccaccttggcctcccagcgtgctgggattataggcatgagccaccaggccggccccaggattttatattaagccttcttgctctcaaaaaaaaaaaaaggttttaactattccatttccagatgaatcccatgagcgctgcttactgttgaataccaaggtctagggctctgcttcctgtagacacgcacacgttgtctccatccaatggccttttctgaagttacagaaaacaccaacatgggagggagtttatgaagcaaaggcaaaggcaacacgtcggctagcttcagggtagcaccgtgagaaatgggctgtattgatactgtgaatgtttgttttccaagctgttttatacaggtttgttttttcatggtgtagggtatttatgacaaagtaaatgttgtgaaggttaaagataaattaagattatccaccaaatgctaaaaatactgatgtgtaaatcacctttatcgcctcacctcttctacaagcttttgtggcttgagggcttttgtttttggcttttgtctggatgaaagttttgcccagttgtgttttaaaaacaattcctcatgaacactaagattaattgtgtctgtatctctggaactgggtgctcatgttggttttaatgagcttgcaacccttccccgtttgctttgtttaaggaggtgcctctgttctttgtggaggagtgaaatggagctttaagtgtgtgtgtgtgttatgtgtgtttgcacacacgcgtgtgttattgtagcaataacaaaaagtagccatctccttgttccagctgttcaaaaccagccctgatcccttatgaccaactgctactcgaccagtcgccactcagtggccacctggtgcccgtttagatttttgcttgggttttactggccacctctatagacgagagttgcaaagttgctttgagcagagagggaaagattaatttacactgctggccaccgaaggcaggtgtttcctgggtagtaatctcacggctcttgatctggaaacttcagagtacaaattggtggatggtggaaggcaggacacgtatctctgtctgacggaaaacagacctcggggctggcgtaaaccctgctgccaggccctctccccactgccccaaaccggcctagacacgaagaccaaagcagcctgcacagggcaaggcccccgcggaatcctgcagagcaaactcaggttaacttgggtccatgaccgtttgcattcgaaacacaatacactgcctcgttctctcagttagcagctgggcagcagcgcaccattcatcatttaggcttgtggtttgttgtttactctaccaatgttatgtcgaaactgcattgtaaaaagagaagaaaatggcaggttttccaggtccacggaaaggtttggcctgacgctggagtgcggtgatgaacttacgtgacaatgattgtattcctcagtagcactttaaacgccgaagacagccctgcagcaagcctgcacacgggcttgggtgggttcctttggagaagatgtggctggaacacaaacaatctttgaaagaaataaatgtgcacacagaaca

SEQ ID NO: 463548 - DNA, 4661 bp, Homo sapiens
  misc_feature (6)..(9): n is a, c, g, or t
gagacnnnnatttcagctcacactccccatgctattaatttgttaaaggctttggtgttgtacagtactgaataactgccaatgccatctgcctgtggccttctcaagtttgtctgcacctgtggttatcctgacttcaaacccggggagacagaggctagaagaggcagacagctcttgtgtattctgtccagtgcaaagaacacctggaactctgagccctaaccttaaatgcaagacctcatctgcaggtgttcctcatccttttagcccctcagtgatgtaagcaacaaacgtcacccagctcctggggcacacttcactcccagatgagcttgtcctggatttgcagggagcctggctccctagaccttttggccagatccccacaggggaattgtgcaggtgcgccctccccagatccccagttggtattggaatcacaccaactgtcacacatggggagggcagctgcacccagccaccctctgacttctctcctcccacagattggccatctgcaagcttcccttctccgtggagagcaggaagacagtcatgggacctcagggagccaggagacaggctttcttggcatttggggatgtcactgtggatttcacccagaaggaatggaggctgctgagccctgctcagagggccctgtacagggaggtgacactggagaactacagccacctggtctcactaggaattctccattctaaaccagaactcatcaggcggctagagcaaggggaagtgccctggggagaagagagaagacgccggccaggcccctgtgcaggaatatatgcagaacatgtcctgcggcccaagaatcttggacttgcacatcagaggcaacagcaactacaattttctgatcaaagcttccagagtgacacagctgaaggtcaagagaaagaaaaaagcactaagcccatggcattttccagcccacccctaagacatgcagtaagctcaaggaggaggaacagtgtagtggaaatagagtctagtcaaggccagagggaaaatcctacagaaatagacaaagtattgaaaggaatagaaaattcaagatggggagcattcaagtgtgcagagcgtgggcaagacttcagccggaagatgatggtaatcatacacaaaaaagcacattccaggcagaaactttttacatgcagggagtgtcaccagggctttagagatgagtcagcattgctcttgcaccagaacacacacacaggagagaagtcctatgtgtgcagtgtgtgtgggcgaggcttcagcctcaaggccaacctcctcagacaccagaggacacactcaggagagaagccttttctgtgcaaggtgtgtggacgaggctataccagtaagtcatacctcactgtgcatgagagaacacacacaggagagaagccttatgaatgccaggagtgtgggcgaaggtttaacgataagtcctcatacaacaagcacttgaaggcgcattcaggggagaagccttttgtgtgcaaggagtgtgggcgaggctatactaataagtcatacttcgttgtgcacaagagaatacactcaggagagaagccttacagatgccaggagtgtggccgaggctttagcaataagtcacaccttatcacacaccagaggacacactcaggggagaagccctttgcgtgcaggcagtgtaagcaaagttttagcgtgaaaggaagtctcctcagacaccagagaacacactcaggggagaagccttttgtgtgcaaggattgtgagcgaagctttagccaaaagtcaactcttgtctaccaccagagaacacactcaggggagaaaccttttgtttgtagagaatgtgggcaaggatttattcagaagtcaacccttgtgaaacatcagatcacacactcagaggagaagccttttgtgtgcaaggactgtggacgaggctttatccaaaagtcaaccttcactttacaccagaggacacactcagaggagaagccttatggatgtcgggagtgtgggcgaaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcatgtgcaagcagtgtgagaaaagttttagtttgaaggcaaatcttcttagacatcagtggacacactcgggggaaaggccatttaattgcaaggattgcgggcgaggcttcatcctaaaatcaactctcctcttccaccagaagacacactcaggggagaagcctttcatctgtagtgaatgtgggcaaggatttatctggaagtcaaatcttgtgaaacaccagcttgcacattctggcaagcagccttttgtatgcaaggagtgtgggcgaggcttcaactggaagggaaatctcctcacacaccagaggacacactcaggggagaagcccttcgtgtgtaatgtgtgtgggcaaggcttcagctggaagagaagtctcaccagacaccactggcggatacactcaaaggagaagccttttgtttgccaggagtgtaagcgaggctataccagtaagtcagacctcactgtgcatgaaagaatacacacaggagagaggccttatgaatgccaagagtgtggacgaaagtttagcaataagtcatactacagtaagcacttaaagagacacttacgtgagaagcgtttttgtacagggagtgtgggtgaggcttcatcttgaagttatatctcaccatccatcagaggacacactcaggagagtaactttgctttgttacaagctttagttgaggctgcataacttgttcgtgaagatataacagaggcagacagaatccagagggctacagagaacctgaattcaacccatgtgtccccaagagattcagagaaaagaggtcaatgtttagggaacagagatgccagttgaggggagggcattacctgggctattggggaaatgtggtctctttcctactgagcacatattcttgttgtatttgtgccaggctgtgctttctaaggactgctcttagccagtgactgcagagcagggataccaaggcaggcctgttacactctccccaacctccttggactgcaaacaatctaggacacctccaccaaacctcctcttgcactttccctctggcttccctcccagccttccttggtttggatgttttgtcccctccttaatttatgttgaaactctacataaactgtttactgttgaaacagtgtaagtattaggaggtgggacctttgggaagtgattaagtcaagtcacgaagatagagctttgcgaatgggatcaggtgcccttatgaaaaggcttgatagagggagtttgtcctgtggcccttctattttctgctctgtgaggacacaatgctcctcccttccaaaagatgcagcatgaaggcatcatcttggaaacagacatgagccctcaacagacaactgcacctactgatgttttgatgttgaacttcccagcctccagaactctgggaaaataaagtcctctttatacatttcctagtcagtggtattttattataacagctcaaatagactaagtaactgctcccctcatcattctctcacagtcatatctggaaataaaatctctgtatatgcagtcccatattggtctttgcagagaactccctccaacacagctgataccaagaacagtctgacaaaacaagtggtaaaatagggatctggggaccactcacctgcctggcaggagtaaagcatgttggctggtggggcacaggtaggtggttagctgcaaaatatttcacaggtgatttcctgagaaaatgcctcaatgatagagaatgctgtggcagatgtgatgatgcaggcctttgaaaatgtagggaaagtgcctacaaagagcagagtagactgattatcgccgatctgcattaccacctgcagaaggaccttgagaaattgaagacttcattcagccattagcaaacagttaatggttaagtaaaccaggactccctggtgagtgcttacaaggcctttatcttcttggatagaaggcagaattattgcccaaatatgtgggctgaaggcctgtagcagagctctacagatgttggaatgctcagccaatgcatgtctattttgtagaggtcagacccttcgtaaggaaaatctgggatcctgaaaaatgacaccggaacatctccatggatgcccaagattgcctctgccatgctcccagccacagaccatctgggtgtgtagagatggcccatccttccttaggaatagcatttccaccattcattaccacagaaccttcacaattaaggccagcttaatgagcatgtgccctacatagctgcacacaacccttgtccagcacagggaagatacatgcaatatgcctatccttttgtaaatggtatttgtgatgcttgcccttcaacttccataactttcctcatactcattttgagtttcactgcacattgtgggttcaccagaattctgtgctcctcttccatattaaacacatttacatctgagtgatctggg

SEQ ID NO: 463549 - DNA, 600 bp, Homo sapiens
ggctggctgagcagagacaagggctgcccacactgggactggtagaggaagccggccctgacggatgggtggtctcgcccttcctgggttcatcctgctgcaggtgggcctgagtcgcagatcaggaagcaccgggaagatgcaggcctgcatggtgccggggctggccctctgcctcctactggggcctcttgcaggggccaagcctgtgcaggaggaaggagacccttacgcggagctgccggccatgccctactggcctttctccacctctgacttctggaactatgtgcagcacttccaggccctgggggcctacccccagatcgaggacatggcccgaaccttctttgcccacttccccctggggagcacgctgggcttccacgttccctatcaggaggactgaatggtgtccagcctggtgcccgcccaccccgccaggctgcactcggtcgggcctccacaggcatggagtccccgcaaaaacctggcccctgcaggagtcaggcctggtctcacgctcaataaactccggactgaagatgcacaaccagcgttgtggacgcggccgcgaatttagtagtagtaggcggccgc

SEQ ID NO: 463550 - DNA, 3659 bp, Homo sapiens
ggctggctgagcagagacaagggctgcccacactgggactggtagaggaagccggccctgacggatgggtggtctcgcccttcctgggttcatcctgctgcaggtgggcctgagtcgcagatcaggaagcaccgggaagatgcaggcctgcatggtgccggggctggccctctgcctcctactggggcctcttgcaggggccaagcctgtgcaggaggaaggagacccttacgcggagctgccggccatgccctactggcctttctccacctctgacttctggaactatgtgcagcacttccaggccctgggggcctacccccagatcgaggacatggcccgaaccttctttgcccacttccccctggggagcacgctgggcttccacgttccctatcaggaggactgaatggtgtccagcctggtgcccgcccaccccgccaggctgcactcggtcgggcctccacaggcatggagtccccgcaaaaacctggcccctgcaggagtcaggcctggtctcacgctcaataaactccggactgaagatgcacaaccagcgttgtggggacagcgggggacgcttccctttttcatttattataaataacgctgctgtgaacgtggggtaaagacgccccttggagcctcggcttttggtcctctgggcttgtgcccggaaggggagtgctgggccacgtgggtgtccgtgtttgattttctgggacctgcccccccccgtctcccgccccggctgccgcgtctcactccccgccgcggtgcgaggggccccgtgtgccgcgcacccttccacccgtgttttgctgtttttttgactctgggcgtcccaggggtgcagcggccgtggggccctggtttgctttcacctcttcatctgctcactggccgcgagtgtgtcttcttcagacaaacgtctgaaggtcaagccctgggctcctgtgaacccggccgtctttgcggcagagtctgaggctccttctttattctggatccggcctctggtcggaggcgtgctctgcaggcactgctcccattgctggcagccttttctccccgtggccgcccggccgcccatcagaggcgttgcagacgcccgccctcgccagcgcaaagacaaacgccggtggccgcggacgcgccggcggccgggagcaccccagcgggcgggcaccacagaggcgcggtcctccggcgtctagatctgccatgtggcgcgcgccggaagcggctctgaggccggaagtgagcctagagcgccgcggccccgagatgaagccggcggtggacgagatgttccccgagggcgccgggccctacgtggacctggacgaggtggcacgggcccggcgggagtctccgagcgtggggagcggggaagggggagcggaagggcggcgtcctggtgcgcgggtcccggggaggggaggccgggcgggtgggcgatgggcgcggctcccaggctccctgccccgcggagagcaaatcccggtttctccgagcacctggtgaaaggcggcgaccgaccgcggcgggaagcgtgtgccctagcccgggggaccaggaggcgcagcctgagggttgagtgcctgctgggtgcccccacggcccccgggaacacacccgtggtcagaggagttgcgtttgctgctcttcgatggctgcagcaccccatgggggcccgcggtgtcatagaaagccgaaggcgcaccgacggatggaccctcagggctttgagggggctcagcaaaggtacagctgaggagtcgactctgtggccaaatgctgggggacacattggtgtttgccagatcgtgaaaccatctggaaccatgctaaagagggtggctctgtgcaccccgctcccgaagcacttccattaaacccaggcttctcagtcctgttttacagtcctaggcttcacagtcctaggcgatgtggagccaccggagggctttacagtggggagtgagaggctccgacttgctctgtagggtggcagcatttacggaagagagagggaagggatcctgagtggaggcgatgggctcaatttcgcatgtttgtggcctctggcgatgtccggcgagggatcggaaagctctccttgaggggcacagagaagtagtggtgcttaggtcagtggtaggtttcttttttaaaggcagacaggaatcaaggaacagaagcccttgagagaccttaaaaatcattcctttgaattcctccccctccccccaatacacattcctgtgtctggaactaaaatgttgactccaacttgagcctgtttcccctcacccatcttctttttttgtgggggtagtggccctgcaatgcacttatcacctgttctttcggaaaacgcacctgacataaccttgcctttccattccccaggcgggaggcagcaccgggctcttgatggacttggcagccaatgaaaaggccgttcatgcagacttttttaacgattttgaagatctttttgatgatgatgacatccagtgagatgccctctggctgcaggcggggccaagcccttggtacagagccgcagtgtgagcctgcgcaggacagtttcaggtggttttaaagaacacgtggaaatcccttgaatttaggacctggttaaccagaaagataagactgttcttaacgacctagatgattctgttcatctctgaacgggatcaggttttgtcctcactccaattaaaagaaagcaatgtcacatgtggagtgatctctttcttgcacttatgagtgaatgttgcagtccctaaacgtctctgtgtgtttgtgtgtgcatgcatgtgcgtgcatctgtcagcacgctgagagaaccacatttgtctggtagcagataccttgtgttaaggtgctgtatgtgctggagcaggaggcagcgcggcccgtgcacagctgggcctgctgacagcacttggaggaccttgccacggggccgcccctctgctgtgtgggcaggttcccactgtgtgtgtctgtcagcacagtcgtccttatgctgtcctctggcctccacgtcagggcagctgcccctaggcttaagaactaggacgacaggatgcgactgcaggagacgccttctacgtggaaatgcacattggtccatttcaaaggagagtgtaacgcccatgtgggaagaggggtcttgtttcctgtaggcccagctcagtagtcgatactggctgtaaagcagtgaagttgctgtttgacatccatctcgaagtgaagagtgtttctcaggccaggagacgcccaggcccaggacttcagcagttcccattttcagagttaaagcccctcagtggagggacctgctgcccccgctactgagaacccgctgaagggtgtcaccttgtcatgtttacagaagagacatttgtactggaggccaggtgagatcttaagcagaaccgaatgtcagctctgcctctttttctcatgagtggtgagtggatttccaccctgtcatcctgatggagctcctgtcctttgttggggctcagcagctcaggactgcccaggacaagccagcagtcctccatggttcccgcactgcagcgagggcagtcggagcacggggtccgtgggaaggcagcagagcggcctgtggtgtc

SEQ ID NO: 463551 - DNA, 706 bp, Homo sapiens
ctgtctcatgtgtcatgaactctccagtgatgattatggaagatgaaggcctcatgttctctcacactggaactctgagaccacttgcagaagaaaggatggcactagcttatgaatttcttgtgttgttcctgaacggctgccctgaggcccatggttctccaaagtccttgcagcaatgtttacagacaggaaatggcatgactctgagacagatggaggacggactgagtgtctgcaattgtaaggacatatcatactgttcatgtactgtattagtaattagagattcctggatagtgaaagatctgcactgggagcttactaccggggagcacattttctcacagccgcctctaatctcccacggaagctttcaaacttctcagcatgccttggtgacgtctccagcagagggtactcgcttcaatccccatgctgctgtgggtgggccacaacaacagatgactttttaaatgacatgctgtttcctgttctgctacttatagtttctgaagaaccaagttatatagaaagaagaagaaggtaaaggctgtgaaggaaaaagagaagaaactaactgcaagtaaaaaaaatgaaggccatatatttgttgctatgatctgaatgtctgtgttccctcctcaaaatatatgttaaaatcctaacccctaaagtgaaggcattagaaggtggaatctttgga

SEQ ID NO: 463552 - DNA, 1464 bp, Homo sapiens
aggaagagcacacaccgaagctcctagtgctggtgatgaatccagaccccacgcagaaaccgctgagtgtgcaatgtgcctctgtttcctgctgcataagaagggatgatgatagtactgacttcatggatttgttgggagaatttaaggagatgaaacctgcgaggcacctaggacagcacctgacacttaggtttactccagtaatatgggcgcaccttacaactatggccttcgccattccaggggcctgcatcaggagccacactccagcacccacccccacagtcatggaaaattacaacacagatgttcatacgggatcttccttctattgcccagtgccccgtgaagcccttgaacaaaaccagaagaaagtgaaaaataaacagccttatacggttgtcatcatcctatccccagtgatggagccatacttgggtctgaaatattttgacacagatgaagcaagtctttgcaatttccaaaggaaaggcttctgtgacacactctcttgtttgaaggagtgacaataacctgagaattgctggtagaattatttgttgttattactgtcatcaaaagatatttaattagaatctcttttatatgtgactgataaagccagtgaaatggtcacactgattctacagtaagccatttttgagcacctattatacacaaagcactgtgcaggaaggttgcatagtaagttgagtgtgacccagactccaactctgagaagcttataatagggtgaaggagacagagacagaaaggcaggctcttaatccagggaactacaggaggtaagcacaagggagacagaagcagaggcgggagacgtgacttagccttaccttccgaaactccacactggcatgaggaatagtgatatgcacttgtggaggaatggtctatagaatgaggataaagaggttaaagttttgcgatatctttcaattagtgattctgtaaccaaaacccagagaagcaggttatgatggagtcatcagcaacacatccctttttagcttaacttaggagttctcttaaatcagggtgctaagtgggaaccaaaaaaaccccagctttgtctgtccgagcttgcactgactgggccacgtcgggtgggttgcttattcatttgcccaacgtattttattccagtaatcattcatggcagtcactcaatgtctctgagcactagtttctgcaaaactttatgtatgacataaagtataacatactttatgcccatagaagtatctactctgttgtgagggtaaattagacaacatagccaacctgaaaagtctaattctaatgaatttgtaatgaaatattatcctaagtgattatttcctaaacctgtaaatgtaatcagtttcttaattatctgtgcatgttcacacatagttaaagacattaagttgatgtgtttctaaatttcttttttacatc

SEQ ID NO: 463553 - DNA, 1410 bp, Homo sapiens
aggaagagcacacaccgaagctcctagtgctggtgatgaatccagaccccacgcagaaaccgctgagtgtgcaatgtgcctctgtttcctgctgcataagaagggatgatgatagtactgacttcatggatttgttgggagaatttaaggagatgaaacctgcgaggcacctaggacagcacctgacacttaggtttactccagtaatatgggcgcaccttacaactatggccttcgccattccaggggcctgcatcaggagccacactccagcacccacccccacagtcatggaaaattacaacacagatgttcatacgggatcttccttctattgcccagtgccccgtgaagcccttgaacaaaaccagaagaaagtgaaaaataaacagccttatacggttgtcatcatcctatccccagtgatggagccatacttgggtctgaaatattttgacacagatgaagcaagtctttgcaatttccaaaggaaaggcttctgtgacacactctcttgtttgaaggagtgacaataacctgagaattgctggtagaattatttgttgttattactgtcatcggtcacactgattctacagtaagccatttttgagcacctattatacacaaagcactgtgcaggaaggttgcatagtaagttgagtgtgacccagactccaactctgagaagcttataatagggtgaaggagacagagacagaaaggcaggctcttaatccagggaactacaggaggtaagcacaagggagacagaagcagaggcgggagacgtgacttagccttaccttccgaaactccacactggcatgaggaatagtgatatgcacttgtggaggaatggtctatagaatgaggataaagaggttaaagttttgcgatatctttcaattagtgattctgtaaccaaaacccagagaagcaggttatgatggagtcatcagcaacacatccctttttagcttaacttaggagttctcttaaatcagggtgctaagtgggaaccaaaaaaaccccagctttgtctgtccgagcttgcactgactgggccacgtcgggtgggttgcttattcatttgcccaacgtattttattccagtaatcattcatggcagtcactcaatgtctctgagcactagtttctgcaaaactttatgtatgacataaagtataacatactttatgcccatagaagtatctactctgttgtgagggtaaattagacaacatagccaacctgaaaagtctaattctaatgaatttgtaatgaaatattatcctaagtgattatttcctaaacctgtaaatgtaatcagtttcttaattatctgtgcatgttcacacatagttaaagacattaagttgatgtgtttctaaatttcttttttacatc

SEQ ID NO: 463554 - DNA, 933 bp, Homo sapiens
gaacattaaagctgtgagtaaatgcctatggaatttcccagaagcctctgggtctacgtgcagctctctctttgtggctgagaagaatctgtctaagagctaatgaatgctctcaagaatcccagtcttacaggaaatgcataattactctactgctctaacaggcaccacatccagaacctaatccctaagtggttaaccacagggcagcagtctcccgacgacctgttcatttccaccagcctggggttcaggaggatttttcagccaatcctttagatacttggtttagcaaatctaattatgatctttatgcacacaatgttttccccaagattatatcatgtccctggcattccagaaactaagttacaaggctttgttcaatttttcaaattttttccagagttcaatcattcctatgtcattcactcacatttatttaaattcctttgtgataaacttttaggagggctgtcatgtggtagagctgtgcagaaattattgtgtacctacaccattaaaagtggaatgggcatcaccagcaagaggcaggagaaaagacagtgtggctgggacttgctcctggagagcagcactttccagaagccactcaccatcacagagaagaagcttgggacatacttgacacccacagagaacataacaattccaacagtggacagtaggggacataaagttgggtggggggagcaacaggagggggttactggaggggagggagcaaggagatacgaatcctgtgtttatgaaggccgaatgtggatgggagttgaaagggaccagaaaccagagcactaaattctttacctgcaaagagagatgtgagatgagcgttaccccctagtggtggcccagaattataaaccctgccaataaagcagtaattttcaaatttcatttgcctaaaaa

SEQ ID NO: 463555 - DNA, 462 bp, Homo sapiens
tctgtttagatgggctatgaatcataagcacatttaatacaaaaggcgcacttttggtagtcactttccacatggcatttcaagagtacgaccgcttaagacatgcagtaggccaatcaggattggtttgtcaagaaaagcaaggattaaacaacttcatccttatctgaaacaaatgtgttacggaaacttaaaagaaaatttttgactttcatatttcaaaacattttacaacatctagaaatgttttgttttctttggatatatgttcttccagcttgggggtttggggcttgctttattataaagtggagaagttttttttttgagtgtataaattatggtattacctttcaaagttataaaatattttatggatttttatatgatataaaaatgtacacattaaagccgtttcattattggataaaaaaatctcgcctctttagcctcacctggcgt

SEQ ID NO: 463556 - DNA, 3256 bp, Homo sapiens
tctgaggcaggcctgcatgacagagaggctttcagtgtgcaccgcagtaatagctccaaagcagggaaatgagaatcgaaaacaacagtttgtccaaggaagagacaatgttcacaaagaaaatccatttttagatgttaccttttacaaggaaactaaatcaccatttcatgaaattaagaacagatgtaaagctaacagtgttgtgccatcaaataaaagagaaaataacatttcatcatctgtactaaaaatatcaaaatctcaaaaccagcccagcttggaaattgccaaacctagctattttagagatagcggcacaataagtgtccctcagtttccaatggacttaaatagcaaaatgtcctctgtctatttaaaggaaatagcgaagaaaaagaatgacaaaaaagaggcatatgttagggatttcacaaacatttactggtcccaaaatagacctgatgttaagaagcaaaagttacagaatgataaaaaaactgtagaagcggaaaacattttttccaaatgttatgaaaatgactacccatcactcagcagccaaaatacttgtaagagaaaagacttgatcagttcaaactactgtaactgcagtagtatccagtgtaatgtaagagactctagaaagaatttcgctatactagaaaatgcaaattgggaggaagcagaatgtctggacagttacgtacttaccaggctggaaaaatctcaaaactgggactgtaacgttagacatattttgagaagaaatagaggaaattgttggattataaataattgcaagactaaatgtgaaaatatgaaaaaaactgaagaaaaatggaattggctattattattagaaatagaccttttaagcaaggaagattaccactgtgcaaaagtcatcaatgcatatgaagaacaatcaaagcttctcgtaagagaaatattaggtagtcagacagctttaataacgactgtttggctaaatggtaaaggagaaaatgataatactctacagttgagatacaatactacacaaaaagtctttcatgtgaacaacccttttgaaagtttcattatagaaattttttatttccataaaagtatttcaggaaataaaaaagataatagtattttaacctgctgtaacattttgaagtgtaaaaagcaaattggtataattggtattcaaaatctaataaccagaaacatgaatacaaatataaagaatggaattttaagcatatatttacaagatagtgtttcagaacctttagatattctattgaaaactaacatagcttttttgctcaataactttgactctttaacaagaattgaaaatgattttgaattagaagaggaatgcattttcaagtgcatgctttatttgaagtatccaaaaaatatagtggaaaatcatactgcatatctagtaaagattttaacttcttcaagactattagaagataatatgaaacctatgttaaagaaaaggaagttatttagaactgaacaagtttttgaaaagtctaagaaaaaactcattaattccttcagtatgacaactcaaaatacaggttttccgatttttgaaacatatgaaaaaattccccttttaatggactttgatgacatggatgaaatttctttaataagagaaattacttgtcagaatatgagttgtcctcaacaagttgtgaatgtggaaaattgggctcactataattctagtactgttaaagcacatggtaattcttgtcctcaatttatacagaacaaccgaggatacattaatgaaaatttttatgaagtaaatatgcacagccaagatttaaatatggaaagaaaacagggacataataagatcagtaactttgactgtgagcacatatttgaagatctctgcaatgttaggcaacaggccataccagcaagccacaacataatacataatgaagagacccataccacttctataactcaagtactaaatttttggaacttgctaagtgaaatagaagaaaaaaaatatgacttaattttgaaagaggaagtaaaagtcacagctgaaagtttaacaaatagttgccaagttcacaaagatactaagatagaaaaggaagagaaagatagtttttttccaatggatgacatgttttctgtacagtcagtttcattaataagtaaggaagtaaatgtggaagaaaataaatatgttaatcaaaattatgtaacaaatacaaatgaatatgagagtattttgccagaaagggagatagctaattcaaaggattttcacagaaagaatgactctgcattatatattaatcatcaatttgaaactggtctgagtgaagggaatgatgaatgttttcaggacttagctgctaaatatttatcaacagaagctctgacaatagtaaaagattttgagatgaagagaaaatttgacttagtacttgaagaacttcgtatgtttcatgaaattagtagggaaaatgaacttctaagcactgtggaaacaaacaatgggcaagaaaattactttggagaaaatgatgctgagaaggtaaaaatggagatagaaaaagatttgaaaatggttgtggtcaacaaaatacgtgcatcttcctcgttccatgatactatagcagatcctaatatgggcaaaagtcaccaaagtttatttaaatggaaaactgtacccaataatggagaacaggaagttcctaatgagagttgttatccaagtagatcagaggaagaattactttactctacttctgagaaagattgtgaaacacctttacctaaaagacctgcttttctccctgatgaatgtaaagaagaatttaattatttattgagaggaggtagtcactttccacatggcatttcaagagtacgaccgcttaagacatgcagtaggccaatcaggattggtttgtcaagaaaagcaaggattaaacaacttcatccttatctgaaacaaatgtgttacggaaacttaaaagaaaatttttgactttcatatttcaaaacattttacaacatctagaaatgttttgttttctttggatatatgttcttccagcttgggggtttggggcttgctttattataaagtggagaagttttttttttgagtgtataaattatggtattacctttcaaagttataaaatattttatggatttttatatgatataaaaatgtacacattaaagccgtttcattattggataa

SEQ ID NO: 463557 - DNA, 4125 bp, Homo sapiens
  misc_feature (3)..(6): n is a, c, g, or t
  misc_feature (8)..(8): n is a, c, g, or t
  misc_feature (10)..(10): n is a, c, g, or t
  misc_feature (12)..(12): n is a, c, g, or t
ctnnnntnananattggtttcagcaggtacaaaccttttcctgctggatcccttgactggatcacagtcaagtgggcctggagccatattacatggctgctgcctggtctgcagctgaatctctgattggcaggccgctatcaaggcataggttggtgatgcagtttctgctggatcctcaggagaactggactgcctctgataccctgattgaacaggactggagccagagttttgccacctcctgcctggatattaaaactcttgcaaaggcagttttgtccatgaatggctgccagatcattgtttgtgtggggagaggacattggtgtgtcatttctataccatctggctacgagaggagccgactgaaagtcacactgccggaggaggggagaggtgctcttccgtttctggtgtctgtagccatctccagtggtagctgcagtgataataatgctgcggtgccgacagttctggaaggagcaacaacagtgatttcagcagcagcagtattgcgggatccccacgatggagcaagggaaataattctggaagcaatgacaatatcagctgtggctatagcagctgagatgtgagttctcacggtggcagcttcaaggacagtagtgatggtccaatggcgcccagacctagaaatgcacatttcctcagcaccggctccagatgctgagcttggacagctgacgccttggatcatctgccactgatctctggtcaacatttttatcacccaacacaaaagaagcagagatttatcaagttacctgaccctttcatcttttgctacacatactcttgtaattgatctctccatgaattgttttctgtttaaaatatctagaatgttttctgcttcctgacttgattctaatattgtatagtgccactatctgtgctgagtttttcaaaggtcagagcagattgaacctttgtggtttcattttccctgattttgatttttcttatggggaacctgtgtggctgcattcaaggtgactcgaagaagccttccaaaaagcgtgtgaaaaggaagccctactctactaccaaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtgggaaaccttggcaactattaatatttttactatcgcttcagctttgccttttccagaatgtcatatagttggaatcatatattatgtagttttttcagatgaatttattgcactaaattgatgtacgctttagctgctttcatgtcttttttatgccttaatggcaaaaaatggcacattaaatcaccaaataatattgcattaaatgaatttttgtctttttattcacctgttgaagaattcggtagatttcatgagagaaaccatctgggcctggtgctttctttttcggaatgctcttaatgtgaattcaacttatttaatagacataagtttattcaaattaggatcctagcatgaccttgggaagattgcctttcaaggaattgatacatttcactgaggttatcaaactgcgctcatagaactgttcatgatattccttttaatgcctaacagttcagtagagatggctcctcttttatttctgaaattggtcatttgtgttatcttctttttcttggttagcctgcatatcaattcattcattgtaatgagcatatcaaagaaccagcttttggttttattgattttctgatgatttcagtgttttaattttattgatttctgtgatgttgtttattacttttacttgctttccattgcattcctctattttctatagttccctaattgaaacatgatattactgattttaggtcttgtgatttttagtatattgcatccaatgctatagatttccctctaaggactgcttttgctacatccagaaatcttgccaagtcacattttcttttaatgtagttaaaagtacttttaattttctattgagacttcttctttaacccaacagttatttaaaagtgcattgctaatttgcaaatatttggggattttgtggctcttttacagttgttgattttttgttgtcaggtgtgtgttgcaaaagcagtcgtctacctcatcttgccaccacccaagatggcccaggatgtgggctctccctgagtgaatctttggcaatctgccaacctgatgtgttcggcctccttctttagtctgagcttgccttctgcttagaaagggccattctcagttctggcagggagttttcccaacattgagaaggtggcattcttactccccactgcagcctgcacctctgaccggtggtcagcagacaggacagaggtcctcattagacagagttcagcagggtctctgaccaaagtgcatcttcagagtctgcacctacccactgtgaccacgggcaggctctgagtcctaaagcaggaggaactgtgcgaccatcctgattggaaatttgtgaggatcaccgtgttactcaagtaaggtctttggaaagtgtcgtattactactgtttgtgaactgcttgttggtggcctggctgagccacacactttatgaaaaccaggacccctcagctggtgtgggtgtctatgcagcctgagaccctcatgtgaacagcctcgtggcagctgtctttgccccttgccaccatcagtgcctccttgttcctgggcactgctttctctgatggtgctccattgttttcctgcacctcagtgtctacagctggatgtctcttccgcaatctaggcgagggggcatcaatggcagttctgctgtggcactgccctccttcttagcttgtcttgctctgtcttaggctccctcaaagatcccacccttcaggttcttccacaagtttcttattgaaatccgagcagaaaactatgaccaatatgaccaatcctatacccactgaagacatgaatgaagaattaaaacaattctccatggactctaccatatagatccctagaagtaatttctaaaaaaaaaaaaaaatcaaggaagatgtaatagttttccataaattagaataccctacatgtacaattaaatgaaatggctagtatagtcttgaaaccaaaaccagataaggtaaattaaattctgtgatattttaaaatactgtaaattctgactaatgtgagttaatctcaatatatgaaatagtagattaacattgaaaatgcaataaataaaattagctacctcaagagtttaatggaaaaaaatgtgattattgcaatagattcaggaaattcatgaataacattcaccctatatttgtaggacaactatctaactttaagtgacctgtgacaaccatttgaattaatgctgctttcacagcatatctcttggcttgttaaaaacccgacaagaatttccgtaacattaatttatttttaacacctatattgggtgtgaacccaccataaagtttgcccactgaaaaggtctacaatttgatgctttattaaattgatactgtgtgcacccatcaccacgatctaatttaaatatgtttccctcacccaagttctctcttgcgcactggcagttaatccccactcccatctccagccctaagcaatactgctgtgacattccatctccataaatttcccatttgcttaatagaaatggacatatatatatatttggaatctgacttccttcatttagcatactatgtttgaagttaattgacgtgttagcacgtgctggtcatgtgttttccttcatagtctgctgtgtttactcatacagatagtgtttattcatttatcagttaatggacatttaattgttttgttattttctttgatgagtaatgtagctttgagcattcatatacagtcatgtaatgcataatgacattttggtc

SEQ ID NO: 463558 - DNA, 991 bp, Homo sapiens
  misc_feature (2)..(2): n is a, c, g, or t
  misc_feature (6)..(6): n is a, c, g, or t
  misc_feature (9)..(9): n is a, c, g, or t
  misc_feature (11)..(11): n is a, c, g, or t
  misc_feature (14)..(14): n is a, c, g, or t
tnaatntgntnacntaacaaataatcaccagaatgggagtgaatgacttgtggcaaattttggagcctgttaagcaacacatccccttgcgtaatcttggtgggaaaaccattgcagttgatctgagtctctgggtgtgtgaggcacagacagtcaaaaaaatgatgggcagcgtcatgaagccccacctcaggaacttattttttcgtatctcatatttaacacaaatggatgtaaaactggtatttgttatggaaggggaaccaccaaagctgaaagctgatgtcataagcaagaggaatcagtctcggtatgggtcttctggaaaatcgtggtctcagaaaacagggagatcacattttaaatcagtcttaagagagtgcctccatatgctcgaatgcttaggaatcccctgggttcaggctgctggggaagctgaagccatgtgtgcttatctcaatgctggtggtcatgtcgatggctgcctcaccaatgatggagatactttcctttatggggcccagactgtttacaggaatttcactatgaatacaaaggtgtttattttctttctctttttcagcatttgtttacgaactaccttttttaaagggctgattaaatgaaatagtagatataaaatgcttactgacccacatgttgactgttacacaatgtcatctatcaagagtaaactaggtttggatagagatgctctggttggattagcaatacttcttggctgtgattatctcccaaagttttcagtattctttgtgcacatgctcaatgctattactgttgctaagtcacgtgatcattgggataagccattcatatttccatgcctctcagcgttgtgctgggttttgttcatggaaatatttgtatcttaagatgcacaatctagtgctctgtaacaaataggtataacagaagattaatgttttatttaattttatatattactctttactcttctttctgatat

SEQ ID NO: 463559 - DNA, 836 bp, Homo sapiens
catagctgaacgactctcttaattttccaccgctacacgaacttattttttcgtatctcatatttaacacaaatggatgtaaaactggtatttgttatggaaggggaaccaccaaagctgaaagctgatgtcataagcaagaggaatcagtctcggtatgggtcttctggaaaatcgtggtctcagaaaacagggagatcacattttaaatcagtcttaagagagtgcctccatatgctcgaatgcttaggaatcccctgggttcaggctgctggggaagctgaagccatgtgtgcttatctcaatgctggtggtcatgtcgatggctgcctcaccaatgatggagatactttcctttatggggcccagactgtttacaggaatttcactatgaatacaaaggtgtttattttctttctctttttcagcatttgtttacgaactaccttttttaaagggctgattaaatgaaatagtagatataaaatgcttactgacccacatgttgactgttacacaatgtcatctatcaagagtaaactaggtttggatagagatgctctggttggattagcaatacttcttggctgtgattatctcccaaagttttcagtattctttgtgcacatgctcaatgctattactgttgctaagtcacgtgatcattgggataagccattcatatttccatgcctctcagcgttgtgctgggttttgttcatggaaatatttgtatcttaagatgcacaatctagtgctctgtaacaaataggtataacagaagattaatgttttatttaattttatatattactctttactcttctttctgatat

SEQ ID NO: 463560 - DNA, 387 bp, Homo sapiens
acctgctttttgttttcagtgcctccatatgctcgaatgcttaggaatcccctgggttcaggctgctggggaagctgaagccatgtgtgcttatctcaatgctggtggtcatgtcgatggctgcctcaccaatgatggagatactttcctttatggggcccagactgtttacaggaatttcactatgaatacaaaggacccacatgttgactgttacacaatgtcatctatcaagagtaaactaggtttggatagagatgctctggttggattagcaatacttcttggctgtgattatctcccaaagggagtccctggagttggaaaagagcaagcattaaaacttatacagattttgaaagggcaaagtttacttcagaggtaact

SEQ ID NO: 463561 - DNA, 993 bp, Homo sapiens
atttactatgtaacctgctattatggagttaaaagaagctccccttcattggctcgtcagctttcagagtagcgaaagtacgcataaagcacagggtgccggcccaccgagctgcgctcccttcccgggggtgcccgagagagagcacgcgagcccggcgcagccaaacccgggcaggggtgggtccccaccgcgtgtgcgtgtgccagcctgggagtgtcggcgcgagcgtggcggcgcgggtgtgcgagggagtgcgcgcgggtgggagcgccaggggctggcggggcccgcgccctgggacgagcccctcgtgctccggctctgcgctcccgcagcgcccacgcagccgagaggagtgggtgatgacttcgtgacctcaacgtcctcccccgtccctcgacatgttcccgcgcctgaaaggtgcagaaaactccccccaccgctctggacgagactgagctaggcgtcgagggcgggcgccgccgcagaccggagctcgggctcgctggccgctcaggcgcagcggtgtggagggaacggacgcgcggcaaggcgacccgctctgggcaacgcgggcgcagctgccccgacgcaaggcactagctggtcgggggctcgggcgagccggggccggcgtgccggggcgtgcgctctctcggcaggcgagcgccgggctccgcggaggtccctgcgcccactgcctgcttctccgcccggcgacccggagtccccaggctgcggtgcgccaggccagacctgaccgagggcggaagacccgagcggcagggaggcagaaagaaaagagtgagaggcagaaggaagaaagaggagaaagagaagacaaatgtttttcccttcttgaagaggtggtcttgactactgctcaaccacagcctactgaaagagccctggaaaatctgagttctagatctgcctgtaccactgtgggacccaaggcaagtcaacttctcctcaggccccagtttccta

SEQ ID NO: 463562 - DNA, 4010 bp, Homo sapiens
cgggccaccctgccctgccacaggctgatctgccgcccaccatccctgcagctgcccatgtgtgctgtgggagatacgactgaggcctttttctgcctggataatgtggggtgaggaagaggctgagatcaaggtgacctttcagccccttacagccgtcatctacgaggtgcaggccacgtgctggtacggggcgggcagccggcagaggagcagcatccagctgcaggctgtggccaagtgcgcccagctgctggtgagcataaagcacaagtgcccggaggaccaggatgccgagggcttccagaagctgttgtactttggctctgttgctgtgggctgcacctcggagaggcagatcaggctacacaacccgtcggcggtaaatgcccccttcaggattgaaatttccccggatgaactggccgaagaccaggccttctcatgccccacggcccatggcatcgtgcttccgggagagaagaaatgtgtgtcggtgttcttccaccccaagactctggacaccagaactgtggactactgctccatcatgccttctggctgtgcctccaagaccctgcttaaagtcgttggtttctgtagaggccctgctgtgtccctgcagcactactgtgtcaacttcagctgggtcaaccttggggagcgctccgagcagcccctgtggattgagaaccaatcggactgcacggcccacttccagtttgccatcgactgcttggagagtgtctttaccatcaggcctgcctttgggacgctggtgggcaaggcccgtatgaccctgcactgtgccttccagcccactcaccccatcatctgctttcggcgtgtggcctgtctcatccaccaccaggacccactgttcctggacctgatggggacctgccactcggacagcaccaagccagccatcctgaagcctcagcacctcacctggtaccgcacacacctggcccggggcctgacgctctacccccctgacatcctggatgccatgctgaaggagaagaagctggcacaggaccagaacggggctctcatgattcccatccaggatctggaggacatgccggccccgcagtacccttatatcccccccatgaccgagttcttcttcgacggcaccagcgacataaccatcttccccccgcccatcagtgtagagcctgtcgaggtagacttcggtgcctgcccagggcctgaggcccccaaccctgtacccctgtgcctgatgaaccacaccaagggcaagatcatggtggtctggacgcgaaggtctgactgccccttctgggtgactccagagagctgcgacgtgcccccactcaagtccatggccatgcgcctgcacttccagccgcctcaccccaactgcctttacacggtggagctcgaagccttcgccatctataaggtgtgtgcacgcaatgagagggaggaatgcggggtcctgcagagctacagtaatattgaggaggactgcaccatgtgcccatcctggtgcctgacggtgcgggcacgaggccacagctatttcgctggctttgagcaccacatcccccagtattccctagatgtccccaagagaggctcagacgtcatccttcggcccacttcggccttgtggacccggggccaccagatcatcctcatctgcacctaccctgagggcagctcctggaagcagcacactttctatctgcagtgcaatgcttccccccagtatctcaaggccttgcctgtcccccttatggggtctgaggccaagaaagagggtgcagagaacccagaggaaggatctgggggaggcaaaagacacctgcaggaggtgagcatgtacagccgggaggagccactgcagctgaagctggacacccacaaaagcctctacttcaagcccacctgggtgggctgctcctccaccagccccttcaccttccgcaacccctcgcgtctgcccctgcagttcgagtggagggtctctgagcagcatcgaaagctgctggctgtccagccctccagggggctaatccagcccaacgagagacttacgctgacgtggaccttcagccctttggaggagaccaagtacctgttccaagtggggatgtgggtctgggaagccggcctgtccccaaatgccaaccccgctgccaccacccactacatgctccggctggtgggcgttgggctcaccagcagcctctctgcaaaggaaaaggagctggcctttgggaatgtgctggtgaacagcaagcagtccaggttccttgtcctcctgaatgacggcaactgcaccctctattaccgcctctacctggagcagggcagccctgaggccgttgacaaccaccccctcgataacaaggctggggagaagcaggagctgtgctgcgtctccctggtggccgtgtaccccttgctttccatcctggatgtcagctccatgggcagtgctgagggtatcacccggaagcacctgtggcgcctcttctctctggacctgcttaacagttacttggagcgtgaccccaccccctgtgagctcacctacaaggtgcccacccggcacagcatgagccagatcccccccgtcctcacccctttaaggcttgacttcaatttcggggccgcaccattcaaggccccaccttccgtggtattcctggccctgaagaacagcggagtggtgtccctggactggtatggcttgaagggggccactggggggcctgggagacaagtgcctagaggctgaaggagaacaagagctgcactctcttgcccgtggtggcctggctgcttgctgtctgtgaagagtggacctcacattgacggctgtggaggccagggtggaactggggttgccagcaggactccgggcctgtcaccggctgagacacggtgataggctcagaagcggtgggactgccctgatggagcctgggcatagtggccttaataacttaacaaatgagacacattcactgggcatctgctgcatgccaggacctgcgctttacaagtcttttctcctccaatcctgtgggaaactcctctctagactctttcatggacagggaggctgagggtcagcaaggttaaggactcagcgaagaccattcagccatgaatggacagagccaggttcaaagctgaatttgtccagtccagagcccttgcctaccccagttagtcagcaagaagactgagttgcttctacatagtacgcactgcctcgttgctggagcccgcctgacggagccccagcttagtggaggctgggcctgaatgggggcaagttgagggtctctggtggggaaggacagggacctgctgccggggacagagctgcccccgagggtcctggctgaggggcttttctcccccagaggctcagaacttgtgcccagcaaacatcctgcttccatgcatggacttttcctccctccaccatgtgcctttgtttcctagtaaactccttttgatgacttccaactttgcttggctaaagagaggtggaaaaaaaagtgtccccatctgggtcagacttaggagagggatccaggggtctggccagggcatggcagtgagtgggggagaatgaaaatatgcaggtgggggctcctgtgatcaggaactcgctggcctgagcagagagagccttggggaatgtggagtgagaggggtggggtctgcatcatcagatgggcactagcagcccctcactctctgactgtcccctttctcctccatggtggaggaagatggggaaactggctctttagggggctcctgtctgagaagggccagaactgtgagtaactgagggcttctagctctgaatgactgggaaccttggcagagctgccagcctggtggggaaggccagggcctgccttgagctccagacctgccattcactgggctctttgagtgggcccggagccaggccctacagggctccagggagagggttgggggcagaaaaa

SEQ ID NO: 463563 - DNA, 2418 bp, Homo sapiens
tttatctttttaattctctgcttcattggcatagccttgactggcaaacagtagtgggctcctggtttcatattccataatgcaaacatctactgaggaccatgctagacagcggcaaaggccaaaaaaagcaccaggacttgacttcagctacgatccaagcaatcagatgtgcttttacatgtcaattgcatgcaaaccaccagtgcaacaccccacaagaccacctctatgcattatcttgttttatgccattagacatttgagaaacctgaaattcaaagacggcagccactcagacaaggtcagggagctggtagcagcagatccagggtccagccccgacagccgagctccagctctggcgtttgaccaccctgcgaatcctattataccacttgacctaaaattcatgtgcaaatatagaaattacttcacgctcaggacttggaggattattatcaaaggcccctgcgggtaggtgattgggagtcatggctgggaagagctgaactcctcatgttctcatggctgatccgagagccctgggtttggaagcagaacacccacctgtttagagctgtgattctgtcacttcctaggggtgtgatggtgggaattaaccaagtttcttcaccagtaatatttgcacaataacaccgtcctcattctgctgtctatagtatttaaaactcctatattaaataacccttccaatactgctgcaaattaaaaacctggaccaaggggaccccaactaactactgcagccacccctgctgggggcaagccagagcccactaaaacaggacatttggctacatttacagggcggtttaaatgatttgaagcaacagatgtgtatattgacttggaaggttttgcaggaaactgtgtttcagtacttaaatagcatactgtaagggctgaccttgatccaaggggtcacaaatgtcacctcgttgggaggtgtcttttccaggatctacgttataattatgatctccttggaagcaccaggggagaaattccagatggttttgcaaggataaagtgagagcaaatgaacatccaggttatgtatggatgttcatggaggattaagtgagagaatggtgtggaaagtaccaggtaaaccaggaggcctgaagcacacgtgtaatatgtttattatttgacttaaatgaaagcatggatatttttaaaggttaaagaaaaaggttcaccattttaaactcatgtaaaatcattatataaaattattattgcttttaactgagttcttgaatcatttcttcttaattcaaacaagtcattattctgtgaccagtaggagtttttgagatcagtctgtttgctactaaatttgtctgcacttgggacttcactcaagaggaatgccagctttcttgtgtggaaccagaggcagtcggggcctgagccagcagcactacctgatcgaggaacaggtgcactgagaaaacagagaagccactcaagactgttaactttttgtttgaaagctgcatcaaagtctgggtagccttcccagaaatactattcagtacatgagcacagcagcctgggacctgcagggctccgcaggtgaccctggctaactccactggaagggccccgcctccagcaacatcttcctcagtttccaccttctgtcctttgctgatttagtcccacaagaacttgagtctgaagacagctttgttttcactgctgtgataacaaaaacacaattatgaaataatgtaaacgctcatgcaaaaacacacagaaaagccaaacacaacagtggcccagccaagctctgcgagcttagtcctgtgtgctgtgaatgccctgggcccctctggatgccaagtgccatggactcaggccttaaaggaattttcaagcaacactttaaatatacgcatttcaaaaagtgacttatacacaaaattcaagtgcgatggtgtactttttgttatttttactaactagaatatagggctcgtgtacattttacaaatttgttttgctttagccttttgttatcccatcaaatcgctgtcagggtcaccaggccagtccttttcctcctgcctgctgtgggtgtgatatgcattctgtaaaacaggtgtctggcatggtttttgctctcattttgttgcttttatgttctttgatatggttaaacctatcttttatttacaaggtggctgacatggcttggttctgtgttcctgctcaaatctcgtgtcaaattgtaatccctagagttggaggagggtcctggtgggaagtgactgaaccatggggtgaatttccccctcgctgttctcgtgatagagctctcaggaaatgcggttgtttgaaagtacgcagcaccttccccgttgctctctccctctctccctcttc

SEQ ID NO: 463564 - DNA, 1052 bp, Homo sapiens
ccccatgaaggccttgcctgcttccccttcactgtccgccatgattgaaggttttcggaggcctctgcagtcatgcttcctgtacagcctgcggaactgtgccacgggtcggagacagcacggaaggagagacaagccttacagagacaacgtccagcgccggacaggacgtgggaggaaggagcgcagacgcggtgctggtgggagaaggagacggtactagcacggtggaaaacctgtggaagttacccagcgacgttgacatacgtgctctacgattccgcccaatcatggggagcacagcccacagaaaggcctgcacactccctgaaagatgctcacagggatgtcacggctctgctcttcctcacgacggaaaagggaaacggccgcaatacccgtctatggtaaaaaagatcgataacttggaaacggaacctgtggcatattccttggagtatctccaggttgagaattcatgatccgcttggaatgggtttagatctcggaatgagctgtcatcccggcccagccaggtagctcaggaagcccagccatttaaagatgatgctagacagaactccagatattcttggagcagcatcggcatcggcacgaaaagccccacggcccacagaactccttgggaggcagccacgcttttctccaatcctgtttagtgtctgcaagaccttcctccaaggaacctgctgccaactcgcctggcacagacatcctgacatgacaccactgctcattccccactggcacaggaccggccatctcctccaagcctgagctgcctgtacagcatcccaagctctgggcgcacctggggcagccgtggcaggaacgccgtgggatctgctgagtcctacgaggctgcagtgggaccgagtgggaaccatggcccatgcagaactgcttctcccttgaagaagaaacacaggctattggctcagctgtaaaaggcaaacacaggctattggctcagctgtaaaaggagatcacggcatccgcttggatggggagttggtgccagctttcctgct

SEQ ID NO: 463565 - DNA, 1607 bp, Homo sapiens
atttctcatgatggggcagtactggtgaccttccccagcagggagagggtggatggacagctgctgcctcagctccctggcatttctcatgatggagtagtactggtgaccttccccagcagggagagggtggatggacagccactgcctcagcttcccggcagggagagggcggatggatggccactgcctcagctccccggcatttctcatgatggggcagtactggtgaccttcccagacagggagagggtggatggacagccgctgccccaactccctctccccggcagggagagggcagatggatggtcgctgcctcagctcccgggcagggagagggcggatggatggctgctaccccctgggagaattgtccgcagccctgggagtgccaagtggttcccaaggagccatttctccacttgtgtggatgtcgctgcctccgaagggtggagccgaggggagcacaggaggtgctgtctcctccccaggagttgccaagggcggcggtcaagctgaggtccaggacataacgtacctggaagtgcttcctgtggatgatgttgagcccccacccacagccctccaagggtctgtaacagtgcgtgatgccaggtatgagtcagagcacgggtccccaaccccacgcataccggtcggtggccagttaggaacggggccctgtagtgggagctccaccttctgccggatcaacagcagcatcagattctcgtaggaaggcgaaccctattgtgaactgcgcaggaggctccaatgcctgatggtctgtccctgtctcccatcaccctcagatgggatcctctggttgaaggaaaacaagctcagggctgccactgattctacatgatgccaaccagcagccccgggcatgatggagacagagatggcagcctctaggcgctggtgacctcctccccctcccttcctgatgtagtgcgggaagatgggtccaggatgggatttccagccccggccacacacagagacactctcctgacttttggtgcaagctcctctgcgaactgttgaaccagtgctgcatcacggggtgggtaggactcaagagtgacgccctctgccttcacccaacacacaatgggaacctgtggcatattccttggagtatctccaggttgagaattcatgatccgcttggaatgggtttagatctcggaatgagctgtcatcccggcccagccaggtagctcaggaagctgcaagaccttcctccaaggaacctgctgccaactcgcctggcacagacatcctgacatgacaccactgctcattccccactggcacaggaccggccatctcctccaagcctgagctgcctgtacagcatcccaagctctgggcgcacctggggcagccgtggcaggaacgccgtgggatctgctgagtcctacgaggctgcagtgggaccgagtgggaaccatggcccatgcagaactgcttctcccttgaagaagaaacacaggctattggctcagctgtaaaaggcaaacacaggctattggctcagctgtaaaaggagatcacggcatccgcttggatggggagttggtgccagctttcctgct

SEQ ID NO: 463566 - DNA, 2003 bp, Homo sapiens
  misc_feature (4)..(4): n is a, c, g, or t
  misc_feature (9)..(11): n is a, c, g, or t
tttnaaagnnnaggaactgagacaggaatctgggtcgacctgtgggtgagaggagccgtcgagttgggtgaaatggttcccgctgccccccagctctgcctgatttggagttgtcttcctattggaccccagctcttgggttcaaagtcgacgatcatttgtacgaatgccatggtatatttaagtgagtggttacagctgtttcagtttcttcctcgccagtgtttggggatcgaagagggatatggaatgggagggccgggaagggatgggagcccaaagcccggcagtgaccacagaaggatgaattgcagtgaatcctttattttgctgacctctttgcacagatcatttgtgtgttggttctggtttaatattccaggtgactcatgcttgggcagattccctcatccctggtgccagcttcctctgaaatatgctgagcatcggcctcacagaagtcaggccaagttcattcacacccagactgaggcccttatcatctgggctttaagaactctgtttcttgttgccattattcatcctgggaggcatccggctgcacctcggctccttgcttcctccgcctccccatctcttttaagcaggttagaaacaaatcaaaagactcatccttcagaaatctagacacgagggaaacagtgcaaagctagtctaacctggccttaggatttgttctgctcagagcaccaccaggcctacttcatctgtctgctatgttcttcattctgtgcaatatcaaaacggagaaatatccatcacatgcagctaaacaagaactgccctcaagataagcaagattaaaacaattacaactcacccagctcacggacgctgagtaactgacccctgttgcaccagccgtaactacagctttgattggatgggagactgactccagtaactttctcctgataagagaccaccggccatggactggttctggctggtttgcagaaagtacattcatccgccttcatgtcctgaaaagaccttttgagcaggcagaaactgtgcgtgtgttccccgagcaattccggacaaggccatctgcaacttgcacagctcagcaccaggaggatgagcacatgaggcctgaaaaaatcttgggaagagtgatagcgatggtgtttcctctccagggatgacaccctaaagaccgggccctgtgcagggacgatacaaggtaagaaagcagaggctccagcagggagcttgcctggggccatgctgcattctcaggcaaggcagctcttccagggccgggagacccctgctagctacttgccagtcaactgttgtctccctttgggaacatcacctctgctgctgggctggacttcctcccagcaccagatggtgtcactgaccacctgaaacacagtcgatactgctacagacacatcatgcagtctttttcctttctgatgagaattgcacaaaatcgaattgaccacctggaacaaatgcagctgataccattaaaaacacaccatacagatcttttagtttttaatgggaattgcatgaaatcagattgactggaatgcttgtgtctgtggaacccaagcatgtggcatgctatatagatggtgaattcatctgtgcgtgaggccgcacgtttgacgcatctccaccaacatagggattgcttcccggcatgcatgactaatagtgagttgtaaaaaggaaacttcacttaactatcaataatgaaagggattttcaatcaaccatgctagaggaaagatggtattctcttctgttctctgtagaaaaggcaataaaaatcagtgccacataacaaggttatcagaggatgtagcatagaggtatcacatagttaattaatgaaaatgttctcttattttctgggtatcccaaggctttaaaaaatgtataacttgttacaagtttttgttgtaaatacacattcaatttcatgtgtgatttttgtataaggagttttgcattcattttgt

SEQ ID NO: 463567 - DNA, 1324 bp, Homo sapiens
  misc_feature (4)..(4): n is a, c, g, or t
  misc_feature (9)..(11): n is a, c, g, or t
tttnaaagnnnaggaactgagacaggaatctgggtcgacctgtgggtgagaggagccgtcgagttgggtgaaatggttcccgctgccccccagctctgcctgatttggagttgtcttcctattggaccccagctcttgggttcaaagtcgacgatcatttgtacgaatgccatggtatatttaagtgagtggttacagctgtttcagtttcttcctcgccagtgtttggggatcgaagagggatatggaatgggagggccgggaagggatgggagcccaaagcccggcagtgaccacagaaggatgaattgcagtgaatcctttattttgctgacctctttgcacagatcatttgtgtgttggttctggtttaatattccaggtgactcatgcttgggcagattccctcatccctggtgccagcttcctctgaaatatgctgagcatcggcctcacagaagtcaggccaagttcattcacacccagactgaggcccttatcatctgggctttaagaactctgtttcttgttgccattattcatcctgggaggcatccggctgcacctcggctccttgcttcctccgcctccccatctcttttaagcaggttagaaacaaatcaaaagactcatccttcagaaatctagacacgagggaaacagtgcaaagctagtctaacctggccttaggatttgttctgctcagagcaccaccaggcctacttcatctgtctgctatgttcttcattctgtgcaatatcaaaacggagaaatatccatcacatgcagctaaacaagaactgccctcaagataagcaagattaaaacaattacaactcacccagctcacggacgctgagtaactgacccctgttgcaccagccgtaactacagctttgattggatgggagactgactccagtaactttctcctgataagagaccaccggccatggactggttctggctggtttgcagaaagtacattcatccgccttcatgtcctgaaaagaccttttgagcaggcagaaactgtgcgtgtgttccccgagcaattccggacaaggccatctgcaacttgcacagctcagcaccaggaggatgagcacatgaggcctgaaaaaatcttgggaagagtgatagcgatggtgtttcctctccagggatgacaccctaaagaccgggccctgtgcagggacgatacaagagggacagactgacatcaccatggtttctcctggagtttctctattcaaataaatcaacccacatgaagaatgcacgttaagtttagctaaaaagtaactttctctatcgagcatgt

SEQ ID NO: 463568 - DNA, 1174 bp, Homo sapiens
ggaaaaaaccaacaattaaacgatgcaaaataacctctccaaacacgcccacactggggactggcagtggggggtggcagggtctattaacatttcaatgtcaacactcaagaacaacaaggaggaggggaaactcctacatctggggactgctccagaaaccctgcctgatcctgcccctctcactgacagtctcctcgctgctccctacatcttcctctccgccggagctgtccagaagggggattttggacccaaaggaatcgggatgaaaggggatcagagtgagaggcgctggcaatggactaggaagctcggctgccgctgctactgctcccccctgggctccggcgagagcctttccctgtcaagcaagaggggtgaggatcatatttttattttggaaactaaaaagtgctcccagggtcggtgattattaaggggaaatccctgaatatactctccagccaagaaggcagggctgccggggctgtacaagaagaggcagcagcctcctacagcaccactacaggcactgcgaggacataacaccagagagctgctcctctgccctccgaaacgacaactttcctaccatcttggaggcagagcaaaggggggccagggggaaaagtgcacccgctcccgataaagtacaaatttttacttctcatctctggaaaaaagtccacaccggccgtctacacccgcgcctgggggagaaagcagggaagaaacggggggtgcatgagaaacgttttcatttgctccagggggaaaaatgtttctgcatcttctgatggaaagaaatctttacaagacacaggttttccggtggttattgttttttattttctgtttttaatttttttcatgttagtgacagtgatattttaatatttttttaagccagtaataatttttctccattacagggctaagttctgtggctggtggtcagtttgtaaatttatacttaaagagacttaatagtaacttcatttatttgtctggttatgttattgtatatataaatatttatgttttcatatattgcatataaaaatttgtgttacatgttactctcagaacagattgctgtaagacaattgtaaaaaaacatgtctttcgtctgtttctcaaagcaatgtaaataaaacctatggactgtcca

SEQ ID NO: 463569 - DNA, 2156 bp, Homo sapiens
ggaaaaaaccaacaattaaacgatgcaaaataacctctccaaacacgcccacactggggactggcagtggggggtggcagggtctattaacatttcaatgtcaacactcaagaacaacaaggaggaggggaaactcctacatctggggactgctccagaaaccctgcctgatcctgcccctctcactgacagtctcctcgctgctccctacatcttcctctccgccggagctgtccagaagggggattttggacccaaaggaatcgggatgaaaggggatcagagtgagaggcgctggcaatggactaggaagctcggctgccgctgctactgctcccccctgggctccggcgagagcctttccctgtcaagcaagagggggctaagttctgtggctggtggtcagtttgtaaatttatacttaaagagacttaatagtaacttcatttatttgtctggttatgttattgtatatataaatatttatgttttcatatattgcatataaaaatttgtgttacatgttactctcagaacagattgctgtaagacaattgtaaaaaaacatgtctttcgtctgtttctcaaagcaatgtaaataaaacctatggactgtccagaaaggcatgatacagtgtgtcattttccacagtgcagataaaggcagctatcactggggatttaaaaacggcccctgtttctggaaattctgttatgctgcccatacagaaaggatacagtaaaactggaaagagattttaaagacagccttagatttttcttgaggtaaaatagcttattaagaattatatccgggcatttaatttttttatttatttagattctttaaactctagctagatctttggtgcattacacatgttgctatctgctttttgtgtcacagaattgagaaatgtggctatttttgttagttatgttagttcagaacttccaatgtgctgccagcctgtatgatagactttttgtatattgcagtggatgtcatgaatttacttttttaaatgagcaaagcttactagataaatgggatcagagttaaacaatgctgttagcacagaggtgagagggacaaagggtacccatttacatcgattccaatagaacgcttattggaggataaattgcagagacatttttctatttttgtgaagaaagagaaaaataatagaaaaagaaccgactatctttgtatgttctactggggatgatgatttaaatcttgtattaaaagttatttttctaacacatgttgactaacctggcaggaatgaatttgttatattagtgccctgaatcagtagaatatttaatttctttgtaaaatttattacacaacatttagaaataacttccaaatttagaaattgtcctgatttaaaagtgagttcatgtaatgcatatatcggatatttattagtttctagctgaaccttatctttatcatataactttgaatatagtacttacctaaatattctggattttctttttttttttttttttttttttgagacggagtcttgctctttcgcccaggctggagtgcagtggcccgatctcagctcactgcaagctccgcctcctgggttcacgccattctcctgcctcagcctcccgagtagctgggactacaggcgcccgccaccacgcccggctaattttttctatttttagtagagacggggtttcactgtgttagctaggatggtctggatctcctgacctcgtgatccgcccgcctcggcctcccaaagtgctgggattacaggtgtgagccaccgcgcccggcctattctggattttcttctgtggttttcttcctctttgtttggtggaaaaagttaagtaaaattaactgattctcatcatcttggaaacctcaattgtgaagctatgttctatttacaatattttttttaaacatttagacatcaaacacattagttatcacaaggaaaatcccttaactagacctctggcgaaattgaaaaacatgttttctaacaacttatttttctttatatatgacatgactttatagatatgttttgaatttttcaagaaattaaaatgtgatcagattccatggcttatgtctgtgatcccagcactttggaaggcctaggtgagag

SEQ ID NO: 463570 - DNA, 2711 bp, Homo sapiens
ggaaaaaaccaacaattaaacgatgcaaaataacctctccaaacacgcccacactggggactggcagtggggggtggcagggtctattaacatttcaatgtcaacactcaagaacaacaaggaggaggggaaactcctacatctggggactgctccagaaaccctgcctgatcctgcccctctcactgacagtctcctcgctgctccctacatcttcctctccgccggagctgtccagaagggggattttggacccaaaggaatcgggatgaaaggggatcagagtgagaggcgctggcaatggactaggaagctcggctgccgctgctactgctcccccctgggctccggcgagagcctttccctgtcaagcaagaggggtgaggatcatatttttattttggaaactaaaaagtgctcccagggtcggtgattattaaggggaaatccctgaatatactctccagccaagaaggcagggctgccggggctgtacaagaagaggcagcagcctcctacagcaccactacaggcactgcgaggacataacaccagagagctgctcctctgccctccgaaacgacaactttcctaccatcttggaggcagagcaaaggggggccagggggaaaagtgcacccgctcccgataaagtacaaatttttacttctcatctctggaaaaaagtccacaccggccgtctacacccgcgcctgggggagaaagcagggaagaaacggggggtgcatgagaaacgttttcatttgctccagggggaaaaatgtttctgcatcttctgatggaaagaaatctttacaagacacaggttttccggtggttattgttttttattttctgtttttaatttttttcatgttagtgacagtgatattttaatatttttttaagccagtaataatttttctccattacagggctaagttctgtggctggtggtcagtttgtaaatttatacttaaagagacttaatagtaacttcatttatttgtctggttatgttattgtatatataaatatttatgttttcatatattgcatataaaaatttgtgttacatgttactctcagaacagattgctgtaagacaattgtaaaaaaacatgtctttcgtctgtttctcaaagcaatgtaaataaaacctatggactgtccagaaaggcatgatacagtgtgtcattttccacagtgcagataaaggcagctatcactggggatttaaaaacggcccctgtttctggaaattctgttatgctgcccatacagaaaggatacagtaaaactggaaagagattttaaagacagccttagatttttcttgaggtaaaatagcttattaagaattatatccgggcatttaatttttttatttatttagattctttaaactctagctagatctttggtgcattacacatgttgctatctgctttttgtgtcacagaattgagaaatgtggctatttttgttagttatgttagttcagaacttccaatgtgctgccagcctgtatgatagactttttgtatattgcagtggatgtcatgaatttacttttttaaatgagcaaagcttactagataaatgggatcagagttaaacaatgctgttagcacagaggtgagagggacaaagggtacccatttacatcgattccaatagaacgcttattggaggataaattgcagagacatttttctatttttgtgaagaaagagaaaaataatagaaaaagaaccgactatctttgtatgttctactggggatgatgatttaaatcttgtattaaaagttatttttctaacacatgttgactaacctggcaggaatgaatttgttatattagtgccctgaatcagtagaatatttaatttctttgtaaaatttattacacaacatttagaaataacttccaaatttagaaattgtcctgatttaaaagtgagttcatgtaatgcatatatcggatatttattagtttctagctgaaccttatctttatcatataactttgaatatagtacttacctaaatattctggattttctttttttttttttttttttttttgagacggagtcttgctctttcgcccaggctggagtgcagtggcccgatctcagctcactgcaagctccgcctcctgggttcacgccattctcctgcctcagcctcccgagtagctgggactacaggcgcccgccaccacgcccggctaattttttctatttttagtagagacggggtttcactgtgttagctaggatggtctggatctcctgacctcgtgatccgcccgcctcggcctcccaaagtgctgggattacaggtgtgagccaccgcgcccggcctattctggattttcttctgtggttttcttcctctttgtttggtggaaaaagttaagtaaaattaactgattctcatcatcttggaaacctcaattgtgaagctatgttctatttacaatattttttttaaacatttagacatcaaacacattagttatcacaaggaaaatcccttaactagacctctggcgaaattgaaaaacatgttttctaacaacttatttttctttatatatgacatgactttatagatatgttttgaatttttcaagaaattaaaatgtgatcagattccatggcttatgtctgtgatcccagcactttggaaggcctaggtgagag

SEQ ID NO: 463571 - DNA, 1227 bp, Homo sapiens
aggccgctccgctcgccccactccggctccggctggacccctgcccgcccgccgtcgccgcccgcgggcgccccggaggccctcaggcccccggcctccaccacccgggcgccggccccactcaccctttcattctccgcccggggcctggcgtgggccggcgaatccccggcctcacgtaagcgcgctcgccgcccgcccagcctgcgcggcccagcccgccgccctacgggagcccggggatgtgggccgggcctggggccgcctctgcttacctttcagctgcttttttttttctccttcccccctgttccctcggctgggctgacagatcagagtgagaggcgctggcaatggactaggaagctcggctgccgctgctactgctcccccctgggctccggcgagagcctttccctgtcaagcaagaggggtgaggatcatatttttattttggaaactaaaaagtgctcccagggtcggtgattattaaggggaaatccctgaatatactctccagccaagaaggcagggctgccggggctgtacaagaagaggcagcagcctcctacagcaccactacaggcactgcgaggacataacaccagagagctgctcctctgccctccgaaacgacaactttcctaccatcttggaggcagagcaaaggggggccagggggaaaagtgcacccgctcccgataaagtacaaatttttacttctcatctctggaaaaaagtccacaccggccgtctacacccgcgcctgggggagaaagcagggaagaaacggggggtgcatgagaaacgttttcatttgctccagggggaaaaatgtttctgcatcttctgatggaaagaaatctttacaagacacaggttttccggtggttattgttttttattttctgtttttaatttttttcatgttagtgacagtgatattttaatatttttttaagccagtaataatttttctccattacagggctaagttctgtggctggtggtcagtttgtaaatttatacttaaagagacttaatagtaacttcatttatttgtctggttatgttattgtatatataaatatttatgttttcatatattgcatataaaaatttgtgttacatgttactctcagaacagattgctgtaagacaattgtaaaaaaacatgtctttcgtctgtttctcaaagcaatgtaaataaaacctatggactgtcca

SEQ ID NO: 463572 - DNA, 4592 bp, Homo sapiens
gacaactccccattgaagaatgttcctttcttctggagaaaggagggcacctttcacgtgggagtttttgtctcctgttttccgggaaagaaggaagatcagagtgccctcgttgcatctgctgttttcaagttgccttagcttgagcctgctcatcagaattagccacatgtccctgagccaactacaatggagcctggaatatgcaatcttccccagcatctgggagaggaaagtgaacatggagcattgtcttggctgtggtggccaacaaacattgggacagaacttgattgtaggggcaccagtgggaggcgagtgttatgatccgatggcttcacttgtgatctattcttcatgataatataggctaaacctgagccctgggctccaggacaggcagtgatcccaagctgctgaggtgcctttcggacccagctggtggcagccgttgcctgcaaggatctaggtggtggggagcccaggcttccacccgaggccaccaagggcggtcccagcctggccctgccccctaccctgtgcctccacccctgcccttcctatgctccaaggcaggcagggaggcgggaggccaggtagctcaggaacccaaacctgtcgggcaggttttgagagctgtggagagagggacagaggctggagaaggatgtatggcctgccctgggcttgtctgttccctcctgagcctgagccccttaccttcctgaccccatgaagcacacactggctctgctggctcccctgctgggcctgggcctggggctggccctgagtcagctggctgcaggggccacagactgcaagttccttggcccggcagagcacctgacattcaccccagcagccagggcccggtggctggcccctcgagttcgtgcgccaggactcctggactccctctatggcaccgtgcgccgcttcctctcggtggtgcagctcaatcctttcccttcagagttggtaaaggccctactgaatgagctggcctccgtgaaggtgaatgaggcagaagccagggctgggcagtgggggtcgggtcacccctcatgccctgctgcctgcccaggtggtgcggtacgaggcgggctacgtggtatgcgctgtgatcgcgggcctctacctgctgctggtgcccactgccgggctttgcttctgctgctgccgctgccaccggcgctgcgggggacgagtgaagacagagcacaaggcgctggcctgtgagcgcgcggccctcatggtcttcctgctgctgaccaccctcttgctgctgattggtgtggtctgtgcctttgtcaccaaccagcgcacgcatgaacagatgggccccagcatcgaggccatgcctgagaccctgctcagcctctggggcctggtctctgatgtcccccaagtgttggtgtgagcattgggagcgcgatccacactcagctcaggagctccgtgtaccccttgctggcggccgtgggcagtttgggccaggtcctgcaggtctccgtgcaccacctgcaaaccttgaatgctacagtggtagagctgcaggccgggcagcaggacctggagccagccatccgggaacaccgggaccgcctccttgagctgctgcaggaggccaggtgccctctgtggaccatgtcctgcaccagctaaaaggtgtccccgaggccaacttctccagcatggtccaggaggagaacagcaccttcaacgcccttccagccctggctgccatgcagacatccagcgtggtgcaagagctgaagaaggcagtggcccagcagccggaaggggtgaggacactggctgaagggttcccgggcttggaggcagcttcccgctgggcccaggcactgcaggaggtggaggagagcagccgcccctacctgcaggaggtgcagagatacgagacctacaggtggatcgtgggctgcgtgctgtgctccgtggtcctattcgtggtgctctgcaacctgctgggcctcaatctgggcatctggggcctgtctgccagggacgaccccagccacccagaagccaagggcgaggctggagcccgcttcctcatggccttccaggcggcccccaccaccaataggcagcagcaccagaggtggaatctgtttgccaaccccagactagacgtcctgcctctcgcctaccccagaggtgtgggcctcagcttcctctttgctgcacccctcatcctcctggtgttcgccaccttcctggtgggtggcaacgtgcagacgctggtgtgccagagctgggagaacggcgagctctttgagtttgcagacaccccagggaacctgcccccgtccatgaacctgtcgcaacttcttggcctgaggaagaacatcagcatccaccaagcctatcagcagtgcaaggaaggggcagcgctctggacagtcctgcagctcaacgactcctacgacctggaggagcacctggatatcaaccaggggagcatctctggggtcctggctcagcaactgggcatgactcccaccctgcgcctgctctcccagtataccaacaagctacggcaggagttgcagagcctgaaagtagacacacagagcctggacctgctgagctcagccgcccgccgggacctggaggccctgcagagcagtgggcttcagcgcatccactaccccgacttcctcgttcagatccagaggcccgtggtgaagaccagcatggagcagctggcccaggagctgcaaggactggcccaggcccaagacaattctgtgctggggcagcggctgcaggaggaggcccaaggactcagaaaccttcaccaggagaaggtcgtcccccagcagagccttgtggcaaagctcaacctcagcgtcagggccctggagtcctctgccccgaatctccagctggagacctcagatgtcctagccaatgtcacctacctgaaaggagagctgcctgcctgggcagccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtgggtgagttttccccaactcgcttaattgctccctgccagggattaagggagtggggtggggaggggctggggtctggggtttccagggcctaggagggcaggaaggcttggggacatggtggagtctgggtattgggtgtggcccatccagcagtggggctgacagccctgttctcccctccctccccttcacccgtttccttcttaatccctgacagggtgaggtgaccctgaggctgcctgtcctcccctttgatttagcctgggccacaggacttcggtagctcttgccccagagcccaggctggcatccaggcctggactgtccccagttccggcttacctggccccaccttgcctgctcctttccacccctttctgctcacgacccccatcattcacgctcagaatcacatgggacttctgtgcagctgcagagccagcaagtccctccaggtgtcaccccttacccccatgctggtggcatcctcacaggaagagcctgttctccacctgctggagcctggaccctggggtgggacagaggcctcgtccaaccccactccccttcccgtgtgtcttccccctgccaagcctccccctgccaagcctccccctgcccctctctgagcccctcgccccccacaccgtcctcatctggcctcccccctggcccccacttccctcttatgcccttcctggccctttgcttcctcccttagtcccctcttcaccatatctccactgctaccttgctggccccagagaccaccctgcccaaccaaaccactcagaggttttttttttgcttgttactcatctgttgacctacctgggggaagtagcacccttgcatttcaaaaataaaattgatggcattacaaatggaatagaaaccatttttaaaatattttcagttctctttcaaaattacctattttatcttttatatatttgaacatattaagcatagttattttaaagttcagttagtcccttatatggagcctccatgagtctgtttctagtgcctgttgtttctcttgttttttgttagttttgtcctgtctcctcccatacttggcaatgttttaattgaatcttggccttgtaattcttcactgctttgtttcctgcccaatactctcaattagacttaaatatatatatatacgtacatatatttattaaatatatatatatacgtacatatatttattaaatatatatatatataactttaaaagctgttcaaaa

SEQ ID NO: 463573 - DNA, 3069 bp, Homo sapiens
tacacttgaggacattggggttcagaggcccctgcccccctcatccaccctcagggatccccttcaggcctctccatgaactttgtcataacccaccttcccccatttcaggtgccctctgtggaccatgtcctgcaccagctaaaaggtgtccccgaggccaacttctccagcatggtccaggaggagaacagcaccttcaacgcccttccagccctggctgccatgcagacatccagcgtggtgcaagagctgaagaaggcagtggcccagcagccggaaggggtgaggacactggctgaagggttcccgggcttggaggcagcttcccgctgggcccaggcactgcaggaggtggaggagagcagccgcccctacctgcaggaggtgcagagatacgagacctacaggtggatcgtgggctgcgtgctgtgctccgtggtcctattcgtggtgctctgcaacctgctgggcctcaatctgggcatctggggcctgtctgccagggacgaccccagccacccagaagccaagggcgaggctggagcccgcttcctcatggccttccaggcggcccccaccaccaataggcagcagcaccagaggtggaatctgtttgccaaccccagactagacgtcctgcctctcgcctaccccagaggtgtgggcctcagcttcctctttgctgcacccctcatcctcctggtgttcgccaccttcctggtgggtggcaacgtgcagacgctggtgtgccagagctgggagaacggcgagctctttgagtttgcagacaccccagggaacctgcccccgtccatgaacctgtcgcaacttcttggcctgaggaagaacatcagcatccaccaagcctatcagcagtgcaaggaaggggcagcgctctggacagtcctgcagctcaacgactcctacgacctggaggagcacctggatatcaaccaggggagcatctctggggtcctggctcagcaactgggcatgactcccaccctgcgcctgctctcccagtataccaacaagctacggcaggagttgcagagcctgaaagtagacacacagagcctggacctgctgagctcagccgcccgccgggacctggaggccctgcagagcagtgggcttcagcgcatccactaccccgacttcctcgttcagatccagaggcccgtggtgaagaccagcatggagcagctggcccaggagctgcaaggactggcccaggcccaagacaattctgtgctggggcagcggctgcaggaggaggcccaaggactcagaaaccttcaccaggagaaggtcgtcccccagcagagccttgtggcaaagctcaacctcagcgtcagggccctggagtcctctgccccgaatctccagctggagacctcagatgtcctagccaatgtcacctacctgaaaggagagctgcctgcctgggcagccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtgggtgagttttccccaactcgcttaattgctccctgccagggattaagggagtggggtggggaggggctggggtctggggtttccagggcctaggagggcaggaaggcttggggacatggtggagtctgggtattgggtgtggcccatccagcagtggggctgacagccctgttctcccctccctccccttcacccgtttccttcttaatccctgacagggtgaggtgaccctgaggctgcctgtcctcccctttgatttagcctgggccacaggacttcggtagctcttgccccagagcccaggctggcatccaggcctggactgtccccagttccggcttacctggccccaccttgcctgctcctttccacccctttctgctcacgacccccatcattcacgctcagaatcacatgggacttctgtgcagctgcagagccagcaagtccctccaggtgtcaccccttacccccatgctggtggcatcctcacaggaagagcctgttctccacctgctggagcctggaccctggggtgggacagaggcctcgtccaaccccactccccttcccgtgtgtcttccccctgccaagcctccccctgccaagcctccccctgcccctctctgagcccctcgccccccacaccgtcctcatctggcctcccccctggcccccacttccctcttatgcccttcctggccctttgcttcctcccttagtcccctcttcaccatatctccactgctaccttgctggccccagagaccaccctgcccaaccaaaccactcagaggttttttttttgcttgttactcatctgttgacctacctgggggaagtagcacccttgcatttcaaaaataaaattgatggcattacaaatggaatagaaaccatttttaaaatattttcagttctctttcaaaattacctattttatcttttatatatttgaacatattaagcatagttattttaaagttcagttagtcccttatatggagcctccatgagtctgtttctagtgcctgttgtttctcttgttttttgttagttttgtcctgtctcctcccatacttggcaatgttttaattgaatcttggccttgtaattcttcactgctttgtttcctgcccaatactctcaattagacttaaatatatatatatacgtacatatatttattaaatatatatatatacgtacatatatttattaaatatatatatatataactttaaaagctgttcaaaa

SEQ ID NO: 463574 - DNA, 1711 bp, Homo sapiens
gacaactccccattgaagaatgttcctttcttctggagaaaggagggcacctttcacgtgggagtttttgtctcctgttttccgggaaagaaggaagatcagagtgccctcgttgcatctgctgttttcaagttgccttagcttgagcctgctcatcagaattagccacatgtccctgagccaactacaatggagcctggaatatgcaatcttccccagcatctgggagaggaaagtgaacatggagcattgtcttggctgtggtggccaacaaacattgggacagaacttgattgtaggggcaccagtgggaggcgagtgttatgatccgatggcttcacttgtgatctattcttcatgataatataggctaaacctgagccctgggctccaggacaggcagtgatcccaagctgctgaggtgcctttcggacccagctggtggcagccgttgcctgcaaggatctaggtggtggggagcccaggcttccacccgaggccaccaagggcggtcccagcctggccctgccccctaccctgtgcctccacccctgcccttcctatgctccaaggcaggcagggaggcgggaggccaggtagctcaggaacccaaacctgtcgggcaggttttgagagctgtggagagagggacagaggctggagaaggatgtatggcctgccctgggcttgtctgttccctcctgagcctgagccccttaccttcctgaccccatgaagcacacactggctctgctggctcccctgctgggcctgggcctggggctggccctgagtcagctggctgcaggggccacagactgcaagttccttggcccggcagagcacctgacattcaccccagcagccagggcccggtggctggcccctcgagttcgtgcgccaggactcctggactccctctatggcaccgtgcgccgcttcctctcggtggtgcagctcaatcctttcccttcagagttggtaaaggccctactgaatgagctggcctccgtgaaggtgaatgaggtggtgcggtacgaggcgggctacgtggtatgcgctgtgatcgcgggcctctacctgctgctggtgcccactgccgggctttgcttctgctgctgccgctgccaccggcgctgcgggggacgagtgaagacagagcacaaggcgctggcctgtgagcgcgcggccctcatggtcttcctgctgctgaccaccctcttgctgctgattggtgtggtctgtgcctttgtcaccaaccagcgcacgcatgaacagatgggccccagcatcgaggccatgcctgagaccctgctcagcctctggggcctggtctctgatgtcccccaagagctgcaggccgtggcacagcaattctccctgccccaggagcaagtctcagaggagctggatggtgttggtgtgagcattgggagcgcgatccacactcagctcaggagctccgtgtaccccttgctggcggccgtgggcagtttgggccaggtcctgcaggtctccgtgcaccacctgcaaaccttgaatgctacagtggtagagctgcaggccgggcagcaggacctggagccagccatccgggaacaccgggaccgcctccttgagctgctgcaggaggccaggtgccagggagattgtgcaggggccctgagctgggcccgcaccctggagctgggtgctgacttcagccaggtgc

SEQ ID NO: 463575 - DNA, 1262 bp, Homo sapiens
ccaggcctggtggcacatgcctgtagtcccagctacttgggaggctgaggcaggagaatcccttgaacccaagagcaggctctcttcctgcgggggcggggagcggttgaagaaggatgggaggattgtggtgagggggagccgtggagagacaggcactcacaagccagaacagggcactgacccatcagaatgggcactgactttaagcagcctctttgttcacaccagtgctgccgtccttggctccatcacaagagggagccccattgctagtccccatcctcaaagcctctgcgtgatgttgtctactgttactcttcactaccctgtgggagccaaagccctggacataagaacagaaggcaagcagtggtggctgagaggaagaactgacacctttgtgctatcagagcactttgcagaggagctgttagtggccctgtaggagtctgctggccatacatctgggtgtcaaatcaagagagcatgagaagttggacaggaaaggtccaaggcaaaatggttactaaaggccatccctgatcctgaccctaaaagaagaaaaggccctttgctcttggcatgcttttgcaggagtgtctcagtctgtttgggctgctataacattgactgggtgatctgcctgcctggcctcccaaagtgctggggttacaggtgtgagccgctgcaccaggccttgaggtcaggagttcgagaccagcctggccaacatggtgaaacctgtctttactaaaaatacagaaattagccaggcatggaggcgcatgcctgtaatcccagctactggggaggctgaggcaggagaatcgcttgaacccagaaggtggaggttgcggtgagcccagatagtgccattgcactctagcctggccaacaagagtgaaactctgtctcaaaaaataaataaacaaacaaacaaacaacaacgatgtgtttcttcatggttctggaggctgggaagtctttgatcaagacgccagcagatgtggtgtctatggagagcctgtgttctggttagtgagcaataccttctctccgtgttctcacgtggtagaaggggagaggcagccctctggggcctctttcatgagggcactaattccattcatgagggctcccctctcatgacctaatcacttcccaatgggcccacctgctaataccatccatcgccttgaggattaggtttttaatatatgaattctgggggacaaaaacattttgatcatagccagaag

SEQ ID NO: 463576 - DNA, 1582 bp, Homo sapiens
  misc_feature (1)..(1): n is a, c, g, or t
  misc_feature (10)..(10): n is a, c, g, or t
  misc_feature (12)..(12): n is a, c, g, or t
  misc_feature (15)..(15): n is a, c, g, or t
  misc_feature (18)..(18): n is a, c, g, or t
ntctagatgntngcnttnaggggtccactcgggggcatgcaagtgggttgtggctttgagtggcaggtgggcgggaagaaacaactaagaaagacacacgagaggtcctcaggcttgatctgtcacagctagaagaacagcttccttaacccatcaggcgccaatgggaggtgcctctgggctgcaagaggctggcagagggggacttccagacccagaaagtctgggcacagaagcctattactgccagacgctgaggagttgccgtgggaaccaagggcctttcgggccagatcagagcctttctcagacaattctttgggtaactggcaagctcctggccttcagtgtaactgtgcctctgcttggaatacccttccacactgatggctcctcaccaccaaagctcgagggttatctctcagacaccctaggggagcagtcgggctctggactacatttcccggaggattctgcaggccaataccacgtctcgcgagatttcggcttcctcttagccaggtggcagattctttcgctgtgcccaattagctgctgccgcgccttggagtccggagtaacttggccaggctggccccgagcggaactggagaaagctgagggggttgggcatgttccaggatctgtctatcgacttctctcaggaggaatgggagggcctggacactgctcagaaggacttatagagagatgtaatgatggagaactatagcagcctggtctcactaggtctctctatcccaaagcctgatgtgatttccttactggagcaagggaaagagtcctgcatggtttcaagggacgtaccaggaggatggtgcccagatttgtatcaggcactggagaacctcccacctggtccatgcccggctcccggtgagcaccgagacccaaccttgtgcacagccagtcttgtcatcaacaaacagggtagtaaattataaaaaataaaataaaggaaatgtagctgggcgtggtggcatgcgcctgtaatcccagctactccggaggctgatgcaggagaatcgcttgaacccaggaggtgaaggttgcagtgaggcgagatcgcgccactgcgctccagcgtggatggcaagagcgaaactccttctcgaaataataaataaaataaaggaaatagggccgggcatggtggctcacgcctgtaattccagcacttttggtggccgaggcgggcagatcacttgaggtcagaagttcgagaccagtctggccaacatggtgaaaccccttctctactaaaaataaacaattagccaggcatggtggcgggagcctgtaatcccagctatttgtgaggcggagacacaagaatcgcttgaatcccggagacagaggttgcagcctgtgcatccctcatctacaaaatgggaataataagaatatctgacaattagacgtgtagaaaatatatgtaaaggcctttgaaaagagcttgtgaaagctcaataattgtccccaataattgctctcaataattgtcagctatcattccataataagcgtaatcataaaaatgtttgactcaaagaaagattcc

SEQ ID NO: 463577 - DNA, 436 bp, Homo sapiens
agaagctgaaaatgctctcaaatggaaaattcgggtctgtgaaatggtgggggcttacaaatcggtgcagcttggactaacaggctccggcggccactttgttttctggacatgctttggactgtgagccgagcctctatgaatcatcacttcagcctctgattggtcctgggccaaactttcacttcagcccctgattggtcttgggccaaaatttcacttcagcctctgattggtcccaggctaaggtcccgggccaagcgaagtcgtgctatctccaagacagctcacagaccagtgagcacattcttcctcttcccagttcacaaaacccccagattcagcctcctagttggcaaccctctttcgggtcccctctctgctggggagagctttcttcttttgcttattaaacttctgttccaaactcattctt

SEQ ID NO: 463578 - DNA, 559 bp, Homo sapiens
caatagtgatgtaatacattgccactatttcacaatcactcctattgagcaataattcaattcaaagatgcattaatgagatgtcaggtaataccaaagagtagctgattaatcaagtaagtttcctattcagatcaatgaaatcagttactgagagtaaggcctgacaataggacatgtttgttatttcaataatgactgcaaactagaagaagagatattgtttgtaaaatctttagacgctgaccgtaccagagcatctatttggctgtgaggcagagggtaagtggatatagggaggcatgtgtgtgattggaactttgtgtgtccccttgagagaaaaaaacctttagggagttagagcgggtccttggtaaaactcctttaaacagagaaacagccagaaaaatcaggctgcaggcacagagaaggaaaactagcaaagggggttgtcctaaagacattcctcagctgcactgataagggaccgaggcccaacatagaaatgcctttgtcctttgtgtgaccagcgggcttccaggaaatagtcgcttttttg

SEQ ID NO: 463579 - DNA, 1121 bp, Homo sapiens
  misc_feature (1)..(1): n is a, c, g, or t
  misc_feature (10)..(10): n is a, c, g, or t
  misc_feature (12)..(12): n is a, c, g, or t
  misc_feature (15)..(15): n is a, c, g, or t
  misc_feature (18)..(18): n is a, c, g, or t
ntctagatgntngcnttnaggggtccactcgggggcatgcaagtgggttgtggctttgagtggcaggtgggcgggaagaaacaactaagaaagacacacgagaggtcctcaggcttgatctgtcacagctagaagaacagcttccttaacccatcaggcgccaatgggaggtgcctctgggctgcaagaggctggcagagggggacttccagacccagaaagtctgggcacagaagcctattactgccagacgctgaggagttgccgtgggaaccaagggcctttcgggccagatcagagcctttctcagacaattctttgggtaactggcaagctcctggccttcagtgtaactgtgcctctgcttggaatacccttccacactgatggctcctcaccaccaaagctcgagggttatctctcagacaccctaggggagcagtcgggctctggactacatttcccggaggattctgcaggccaataccacgtctcgcgagatttcggcttcctcttagccaggtggcagattctttcgctgtgcccaattagctgctgccgcgccttggagtccggagtaacttggccaggctggccccgagcggaactggagaaagctgaggctctaaccatggaatactgggaatgtccctttctgtgaaggaggttgtcagccacaacaggaatattcatgaacatgaaggggttgggcatgttccaggatctgtctatcgacttctctcaggaggaatgggagggcctggacactgctcagaaggacttatagagagatgtaatgatggagaactatagcagcctggtctcactaggtctctctatcccaaagcctgatgtgatttccttactggagcaagggaaagagtcctgcatggtttcaagggacgtaccaggaggatggtgcccagttttcctttaatgcagccatttcatgcatcaatggatattcattcagcactctttttttttttttggatacagagtctcactctgtagcccgggctggagtgcagtggtgtgatcttgtctcactggaagccaataagaaacgcttggggatgacctccctacaagcacaggaaaaccattcctgcgcatttctg

SEQ ID NO: 463580 - DNA, 983 bp, Homo sapiens
  misc_feature (1)..(1): n is a, c, g, or t
  misc_feature (10)..(10): n is a, c, g, or t
  misc_feature (12)..(12): n is a, c, g, or t
  misc_feature (15)..(15): n is a, c, g, or t
  misc_feature (18)..(18): n is a, c, g, or t
ntctagatgntngcnttnaggggtccactcgggggcatgcaagtgggttgtggctttgagtggcaggtgggcgggaagaaacaactaagaaagacacacgagaggtcctcaggcttgatctgtcacagctagaagaacagcttccttaacccatcaggcgccaatgggaggtgcctctgggctgcaagaggctggcagagggggacttccagacccagaaagtctgggcacagaagcctattactgccagacgctgaggagttgccgtgggaaccaagggcctttcgggccagatcagagcctttctcagacaattctttgggtaactggcaagctcctggccttcagtgtaactgtgcctctgcttggaatacccttccacactgatggctcctcaccaccaaagctcgagggttatctctcagacaccctaggggagcagtcgggctctggactacatttcccggaggattctgcaggccaataccacgtctcgcgagatttcggcttcctcttagccaggtggcagattctttcgctgtgcccaattagctgctgccgcgccttggagtccggagtaacttggccaggctggccccgagcggaactggagaaagctgagggtctctctatcccaaagcctgatgtgatttccttactggagcaagggaaagagtcctgcatggtttcaagggacgtaccaggaggatggtgcccagatatatatatatggaaaagagaaggtccaagaatatcaaagacattgaagaagaggaaagatttgtcctgccaaatatcagaacttttataaagctacagcaattaagacagtgtggtcctcactgataaactgactaatgaaacagaatagagagctcccaagcaaatctctacaaatttaatcttcgatacgtgatgtaggtgacatggcagatcagtaaggaaagaaaggacttttcaataaatagaatagaaaaataatg

SEQ ID NO: 463581 - DNA, 801 bp, Homo sapiens
gtggcagattctttcgctgtgcccaattagctgctgccgcgccttggagtccggagtaacttggccaggctggccccgagcggaactggagaaagctgagggtgaggaatccggctccggtccttttgtgtgtggagggctgaggagaggagtttgcgtgtgtgattgccatggttgccgtgggtcttcgtggtctgtgactgtggctgcgtggtgctgactctgggtgatcaagtgggcgcttgtgactgtgcgcgctcggagtggatgtgtgtgtcctggacgagccgcgttgtgtgtgcggatgtggacaaccggtgactgtgtggttggggctgcgtgtcccagggtggatgtgtgactttgcgtgtgtgtgcagtactgtgtgtgcgtgagttgcaggtctgtggctgtgcaggtgcaacttgtgtggccccgtggtctgtgtgagagaggagagtgtgactggctgtgaggcagagggtaagtggatatagggaggcatgtgtgtgattggaactttgtgtgtccccttgagagaaaaaaacctttagggagttagagcgggtccttggtaaaactcctttaaacagagaaacagccagaaaaatcaggctgcaggcacagagaaggaaaactagcaaagggggttgtcctaaagacattcctcagctgcactgataagggaccgaggcccaacatagaaatgcctttgtcctttgtgtgaccagcgggcttccaggaaatagtcgcttttttgtgggcatgtatacagtgggctctgttagattttgaagggaa

SEQ ID NO: 463582 - DNA, 1027 bp, Homo sapiens
  misc_feature (1)..(1): n is a, c, g, or t
  misc_feature (10)..(10): n is a, c, g, or t
  misc_feature (12)..(12): n is a, c, g, or t
  misc_feature (15)..(15): n is a, c, g, or t
  misc_feature (18)..(18): n is a, c, g, or t
ntctagatgntngcnttnaggggtccactcgggggcatgcaagtgggttgtggctttgagtggcaggtgggcgggaagaaacaactaagaaagacacacgagaggtcctcaggcttgatctgtcacagctagaagaacagcttccttaacccatcaggcgccaatgggaggtgcctctgggctgcaagaggctggcagagggggacttccagacccagaaagtctgggcacagaagcctattactgccagacgctgaggagttgccgtgggaaccaagggcctttcgggccagatcagagcctttctcagacaattctttgggtaactggcaagctcctggccttcagtgtaactgtgcctctgcttggaatacccttccacactgatggctcctcaccaccaaagctcgagggttatctctcagacaccctaggggagcagtcgggctctggactacatttcccggaggattctgcaggccaataccacgtctcgcgagatttcggcttcctcttagccaggtggcagattctttcgctgtgcccaattagctgctgccgcgccttggagtccggagtaacttggccaggctggccccgagcggaactggagaaagctgagggggtctgtgaaatggtgggggcttacaaatcggtgcagcttggactaacaggctccggcggccactttgttttctggacatgctttggactgtgagccgagcctctatgaatcatcacttcagcctctgattggtcctgggccaaactttcacttcagcccctgattggtcttgggccaaaatttcacttcagcctctgattggtcccaggctaaggtcccgggccaagcgaagtcgtgctatctccaagacagctcacagaccagtgagcacattcttcctcttcccagttcacaaaacccccagattcagcctcctagttggcaaccctctttcgggtcccctctctgctggggagagctttcttcttttgcttattaaacttctgttccaaactcattctt

SEQ ID NO: 463583 - DNA, 1239 bp, Homo sapiens
  misc_feature (1)..(1): n is a, c, g, or t
  misc_feature (10)..(10): n is a, c, g, or t
  misc_feature (12)..(12): n is a, c, g, or t
  misc_feature (15)..(15): n is a, c, g, or t
  misc_feature (18)..(18): n is a, c, g, or t
ntctagatgntngcnttnaggggtccactcgggggcatgcaagtgggttgtggctttgagtggcaggtgggcgggaagaaacaactaagaaagacacacgagaggtcctcaggcttgatctgtcacagctagaagaacagcttccttaacccatcaggcgccaatgggaggtgcctctgggctgcaagaggctggcagagggggacttccagacccagaaagtctgggcacagaagcctattactgccagacgctgaggagttgccgtgggaaccaagggcctttcgggccagatcagagcctttctcagacaattctttgggtaactggcaagctcctggccttcagtgtaactgtgcctctgcttggaatacccttccacactgatggctcctcaccaccaaagctcgagggttatctctcagacaccctaggggagcagtcgggctctggactacatttcccggaggattctgcaggccaataccacgtctcgcgagatttcggcttcctcttagccaggtggcagattctttcgctgtgcccaattagctgctgccgcgccttggagtccggagtaacttggccaggctggccccgagcggaactggagaaagctgaggtttcactcttgttgcccaggctggagtgcaatggcatgaactctgctcactgcaacttctgcctcccaggttcaagtgattctcctgcttcagcctcccaagtagctgggattagaggctctaaccatggaatactgggaatgtccctttctgtgaaggaggttgtcagccacaacaggaatattcatgaacatgaaggggttgggcatgttccaggatctgtctatcgacttctctcaggaggaatgggagggcctggacactgctcagaaggacttatagagagatgtaatgatggagaactatagcagcctggtctcactaggtctctctatcccaaagcctgatgtgatttccttactggagcaagggaaagagtcctgcatggtttcaagggacgtaccaggaggatggtgcccagttttcctttaatgcagccatttcatgcatcaatggatattcattcagcactctttttttttttttggatacagagtctcactctgtagcccgggctggagtgcagtggtgtgatcttgtctcactggaagccaataagaaacgcttggggatgacctccctacaagcacaggaaaaccattcctgcgcatttctg

SEQ ID NO: 463584 - DNA, 915 bp, Homo sapiens
tagtttcctgagctcgaactctactttttgcaacaagcagaatgtacacatgttaaacaagggcacacaagcaggtaacttggagattgtgaacggtgccgaaaaacacactcgagccaactccaagttccagcgaggctaaattggaagaggacagtgatgtgacttcttggtcagaagaaaaacatgaagagaaaatgctctttaccagttatcctgaggacagaaagttaaaaaagaacaagaagaattcccatgaaggagtttcctggtttgttcctgtggaaaatgtggagtctagataaaaagaaggaaaacatgctcaagactcatgaccctggcatctcccggttggaaccagtaaccaagaccaagccgtggagggagccactgtgggagcggaactggcaggggcagcacctggacagtcggggctacctggcaggcccaggcagagaggatggcagaaacccactgaagctgtttgaatcgcttcagtttcacagacctgacttcatctcccacattggggagcggataaagcgtctgaagttaatagtccaggagagaaagctgcagagcatgttaaagagcgagcgggatgcgctattcgacattgacagggaacggcagggccaccagaatcgcatgcgcccactacccaagagaggtacgccctgcccgttcactttccttcttcctggctgtccagaagaacaagcctatcagcaagaaggaaatgattcagaggtccaaacgcaatcccatttcttggaattgatcccatagggtgagaaagaacagtgttctccagaacatattaagttaaacttttttaaaaaattaaattttcgaagtatgtcaacactgtttccatttgtggtctttaaaagggtatataaatttcactagtat

SEQ ID NO: 463585 - DNA, 1134 bp, Homo sapiens
  misc_feature (2)..(4): n is a, c, g, or t
  misc_feature (6)..(6): n is a, c, g, or t
  misc_feature (8)..(8): n is a, c, g, or t
tnnntngnagaaacaggaggagtcatgtgattcctttggctaaacacctatgaatggaaataacttgtgttattgtgtcctttctaatcagagccaattaagtgtgaggtataaattatctctccctccccaccttaaaagctacatgttgcgatgtatcccaagaagtgcagctccttcaatctcaccatggcctctgccagaatgcagatcctgggagtcgtcctgacactgctgggctgggtgaatggcctggtctcctgcgtcctgcccatgtggaaagtgaccactttcatcggcaacagcatcgtggtggccagccagatgcagtgcaaggtgtacgactcactgctggcgctgccacaggacctgcaggctgcacgtgccgtctgtgtcatcaccctccttgtggccctgttcggcttgctggtctaccttgctggggccaagtgtaccacctgtgtggaggagaaggattccaaggcccgcctggtgctcacctctgggattgtctttgtcacctcaggggtcctgacactaatccccgtttgctggacggcgcatgccatcatctgggacttctataaccccctggtggctgaggcccaaaagtgggagctgggggcctccctctacttgggctgggcggcctcaggccttttgttgctgggtggcaggctgctgtgctgcacttgcccctccggggggtcacggggccccagccattacatggcccgctactggacatctgcccctgccatctctcgggggacctctgagtaccctaccaagaattacgtctgacatggaagtgaatgggggctccgctggcactagagccatccagaagtggcagtgcccaacagctttgggatgggttcatatcttttgtttctgcctccttctatttttcttttgactgagggtatttaaaattcatttaaaaactgaaccaagaagatgactcagactcccacttaggttctgctgtttctcacccttggatgatggagccaaagaggggatgctttgagattctggatcttgacatgcccattttagaagccagtcaagctgtggaactaatgtggaggctgcttgctgtgctggcctttgcaacaagacagactgtcc

SEQ ID NO: 463586 - DNA, 912 bp, Homo sapiens
tggaccttcaatgctgtgttagaaggaactaacattgtaagctcaatgaggacagaaacagatcttccttgttccttgttttgtcctcagcagctagcacaaagcttgcagaatgaagaaatacctgctgaaattgatggcttttgcaagagaaaggtggcagttattaagtgcaaggaaactacctttggtagaaagccaatcccctgggaacagcatcttcttaatggagaattctgcaaacattttcaattcacacattcatacaacaaatacttattaagtatggcccttatgatctcaggccactttcccaaaataaccgccaagaacatgttttccactttttcttctccatctagaaagatctattttaaaggacaggattatgaatttgagcactgcttttcacacacagtcacgaatccaggcatttggtccaggcaatgatgggaaaagaacgggtaatgattttaacagagcctgctgcaaacgcccactctttcttccataagcaactaatcttaggtctcagcaatgcaatattccagcatcattgctgatgttatgaaaatattggatcagtgaataccaaatctgtaaccctgatactcccatgtctcaaaagttctcattcttctccttcctgctgccacatgacaaaggatgtgtttgactcccctttcatcatgattgcaagtttcctgaggcttcccaagccatgctgaacttatgcctcagccatggaaatgggccactcctagttcaagcttcttgcagaatatgattgtcttggctatatggactcttttttggttccatatgaactttaaagtatttttttctagttgtgcgaagaaagccagtggtagcttgatggaaatagcattgaatctttaaattactttgggc

SEQ ID NO: 463587 - DNA, 1009 bp, Homo sapiens
  misc_feature (935)..(935): n is a, c, g, or t
  misc_feature (962)..(962): n is a, c, g, or t
  misc_feature (987)..(987): n is a, c, g, or t
tggaccttcaatgctgtgttagaaggaactaacattgtaagctcaatgaggacagaaacagatcttccttgttccttgttttgtcctcagcagctagcacaaagcttgcagaatgaagaaatacctgctgaaattgatggcttttgcaagagaaaggtggcagttattaagtgcaaggaaactacctttggtagaaagccaatcccctgggaacagcatcttcttaatggagaattctgcaaacattttcaattcacacattcatacaacaaatacttattaagtatggcccttatgatctcaggccactttcccaaaataaccgccaagaacatgttttccactttttcttctccatctagaaagatctattttaaaggacaggattatgaatttgagcactgcttttcacacacagtcacgaatccaggcatttggtccaggcaatgatgggaaaagaacgggtaatgattttaacagagcctgctgcaaacgcccactctttcttccataagcaactaatcttaggtctcagcaatgcaatattccagcatcattgctgatgttatgaaaatattggatcagtgaataccaaatctgtaaccctgatactcccatgtctcaaaagttctcattcttctccttcctgctgccacatgacaaaggatgtgtttgactcccctttcatcatgattgcaagtttcctgaggcttcccaagccatgctgaacttatgcctcagccatggaaatgggccactcctagttcaagcttcttgcagaatatatggagtctcacactgcactccagcctggcaacagagcaagcccccatctctaaaataaaataaattgctctgtaagttgacaccactaaaaacatcattagtagttgtaataattaaggataaaggaggaaaactgtgcagagcccagncacagtggcctggttccatgggattanttcctaatggacatttttggttttnccctcttctttggccccctttt

SEQ ID NO: 463588 - DNA, 1171 bp, Homo sapiens
ctcactacctgtgtgtgtattaacacgccggcctcctcgctacctatcaactatggcctgagtatgatagacttatccatggtttaaacagaatatattgttttcaactttgaaaataagaatatggaaatccagatgcagaaatgtgagaagaaaagagagtaaacagagtggaaggtcaggtgaccttgcctgtcatgaatatgaaggtcaaggtgtgtgaattgtgaaatttccaagagaacctcactgaagcaaagaatgaagaaagaattgcatttggccctgggagggtgcaggggtgaatggtgcaggagctaaatctttatcatacccagaaatcaacagccactatttgaaatcatctaaattcgtgctgctaaccttcagtgtacacacgaatcacctggggatcttactaaaagctagtttctgattcactaaatctgtgtgtggtggaagttgagggcagagaagctcccgagggtgtcaagctgactctgaacccgactttgagggttaaggtcccaaatggcatcgccagcaccagggacagacactaaaattgtagaaatcgtctcaagaaatgaacagcctctaagtcagatgttgaatgtgaaagaaatcagggtgtcaagtgaaccatgcaggagggactgtcacacctgcaacacctggtgcagtgctggacacgggggacacttcgcatctctctacttagtgacagcatctgacggaaggagggaggaagggaccctcacacattccaagcgcactgtgacccggcaccttggcttctttacatgtgcattccctgcccctttcatccataaaccagcctcaagggagtggccccacaccctacactccgtccagactccaggagcacacgacacacgggacacactacaccaaacaatgcaggtttcttgtggacagaatttctcccctctgtccctgagcacccgaggactcaagcaatggctatgggatgtgcgggcctcgtgtgaggactcagtgagaaagcgccatctgtgaggaaggtgggcctcgtgtgaggactcagtgagaaagcgccatctatgaggaaggcgggcctcgtgtgaggactcagtgagaaagcgccatctatgaggaaggggggccttgtgtgaggactcagtgagaaagc

SEQ ID NO: 463589 - DNA, 1627 bp, Homo sapiens
tataatccagtatgattaactatggtttgtctctcctggcgtcccgcgcctgccagttgcggccggtacagtccgagccaccgccaccgcccccgggcgccgcaagagggcagcctcctgacgggggacagttgggagcctcgcgacccgtgtgtggcgatccctgccccgctccccagcaggcctgcggccgccagagggcgacgccgcccagcttgcggccactcacgtctctgcactgctgggtgtccgcggccaggacgctggcgaccgtcttggtgacggcgactttggcaggcttggagcaggcgccgagagcccaacgacctcagccccgccccccgcgttccaggcttccaatggtagcggccccagaagggcggtggcctcctgaggggcggctcgcgccagcgcgtagagcgcccgcagagctgggaaaatcggtccgagaggcctgatctgagaggaccacagttgaaacttcatctttctctgaaaccatcacgccttagccaatcctaacgaaaacgtataagctttgttgagttggagggaatcattgctgtgagaagctgacagtggtggatgacaagcttgaatttccagaggaaatagcatgtctgtgaaactcacccatgccatctggaaaggaaaaagttaagttgcatttctgcaatacattctctcccttccctgagctgctcctggaatataaagaaagcaaggaaatatttactgggccttcagctttctgtactacttcggaacagcactagcatctatctcagggtttaaaatatggaagttcttgccttccttgaatcttttctcccagaaataacatattggctctcttccctgtgacatgcctcatctgacattggctggctttcatataaaacctttgttttagcctactatcaattcaacttttacattgacaaaacgtaatttttggttgtcaatgtaaaagttgacatttttacattcaactttaatttaaatgctgaatttaaatttaaatgctgaaaatttatttaaacacttaaaatgatattagaagaggtattttatgtttttaaacagagatatatttcatttttatatgcagtcaacagatcacatgtgtatgtctcttatgtgttcctgtgtgggaatagcttgaattactacataagttctctgagaatattaagttcatttaggggaacaggacatatctatatgaaaaacagaaataatactacaaacaaaagagagatcacgagataacatgtaattaattctcagtgaatgacatgtcatgaaatcatcagaagagatgaggatatgggaaaagctttatgaaagtagtcagaaccataaggaagattcggttttgttaaacagaaagacctttttccattgtggtattaagtttaatatgattttcattgtattaaaatactaatgcagtaagttgaaaatataattgcattcttttcatttaatctattgtaaaatatataatcaaaatgatatacttgtaaaataattacatatataataaaatcaatatacctgtaaaagaatcacaatttaagatttatttattatttaagtttaataatgtatattatttctaaaa

SEQ ID NO: 463590 - DNA, 986 bp, Homo sapiens
cccaaggagatgtgatgagtacatgtaatgaggaaaattaattccacactcataactccaccgtgtgacaaatcttgccggtttccatttccaggcttttggcctgacttggtcacatggatgcagatttttcagagttggatattttactgttcttgttcacctactactttccttactgcttgttttttaaataaaattataaaatgcaacaacagagttgtgttcccccgagaaattattttctattacacacagtgcaactgtgaacatctttctgcacccccttggccgagtgctgcacgcagctgtggggctgccgtggtccggagaaaggctgaggatggcgtgcaagggactgggactgggaccgcactggagcctgacggaatccctggccttgttttcacttaatcacctctttaaagaccctctctccaaacatagtcccatcccagggtgctggaggcctaagagaggggccttaggaggaaccaaccctggccacatcttgatctcagacttctggcctccagcacagtgaaaaattaaagttctgctgcttgagccacccagtctgtgacagttacggcagccggagcagatgatgacacctgtccagttggtgcacgtgccccagggcccctcagaacacaactttcccctggagggcgaagcgagcagatttctggagcttgaaatggcaatcgtcattagggtaacccgcttccccagagcatgtgcccggcttgtcctggaaatgacaagaatggagacgtggctgagcacagacaccaaggcctgaggacgctgagacttggggatctatatcatcctccacggatctctccaaagccagtttctgtcctatataatattcacctcattgggatatttccccatcatttcaatgggatgttatagtgagataaacatgccagacaaaattgaattctgtgggtttatttattgatttatttattttt

SEQ ID NO: 463591 - DNA, 1562 bp, Homo sapiens
gagaaaactaaacccaaacaacacccgagacaaggaacagacgtcattcttcctttgcctgctggttgacagcctgccaccgtttaaagatgcggtacaccgagggtccttcatggatgatgagacctgaggcagcagggagaggagaaacagaggccaaatgagaggaagtgggtcacggccaggagaccacagtctctctgaatctatgcaagggtctctctctgttgcccaggctggagtgcagtggtgcgatcatggctcactacagcctcgacctcctggttcaagtgattctcccgcctcagcctcccaagtagctgggacttcaggcacacaccaccatgcctggctaatttctgcattttttatagatacagggttttgccatgttgcagactgatctcaactcctgaactcaagcgatcctcttgcctcagcctcccaaaccgctgggattacaggcatgaaccactgagcccagctgcctttcacacttctactgtgcattagaatcacccaaagagcttgttaagacagattcccaggctgcaatcttggaggcctactggcttagtagctctgggctgaggcctgagaatatgcattcctaagaaacctcaggtgaggctgatgctgcctgtgtgtggactgctaggctaggacatggtttttattcctcatagaaggttctaaattttgatcacaaaacttattataagtaattttaaaaagtaatctacttccagatgtcatagacatggaaatgggaagaaacggaagaaataaatacttcctctcctagacccaaagacctttgtgccccacaactaagagttaacttaccacaaccagccacttggctgtggagattggtggccgtcacaggaggccccgggtgggtgggaaggagttaacacggaatctagaaaaccagataagctacatgcaagtaacagaacgtggatgggcatcatctcgccagtttctacagctgctgcttctcatgtcagttttgtggcccagcccaatattgctggggatgccccacggtcacaagtgtcagcctttgcaagccctggcatctcagtgtggaggtgacatcaaaatcctgggatgtcagacctggaaggaacctggagccagttggatggatacagctgtggatggggttgaagcagctccatgggcagcaagcaggcagtgtcctgcacagcatcctcctgggttcctggcagggcgtatctgcagagctgcagttggctttcgtgaagcttctccttggagtccctcctactttcatgagctgtccctcagcacaccgctccaaaaggaaagaggtaagcccgacttgccatcccagaggctgtggttcctgtcctacattgccctgagtgaatctaatgccaaatgtgctctctggaagtccccatgagtcagaatgtctagttgagcctaaaaataaagatatccctggcaggcattgcaggctctacccgattctccctccagagagcccttaaaaagcagatatttttgcaccaaattgtgcagtgtgatgc

SEQ ID NO: 463592 - DNA, 1402 bp, Homo sapiens
taaagttttgctcgagaggggaaactgagggggcagggggcggcccggaaagcgggtccagacgatccggctcgaaatcccctccccccacaacagcgtcgcccgccagagccgccgcccggtacctctcgatgactgaggccaccagctgcggcaactccttcatctcgaaggcggacccggggtcgtgtccgcccccgttgccggggtccccggcgccggagccgctgccgccgcctcttcgccgccgctcgtcgccatcttccgtcgtactactgcggctccctccgggggcttgccaccggcccagcgccgcctcccaggagggggcggaaactgcgcgccgccgtcatgggtcaaaaacgcgacgcgcggagcggcctttgctctcaccggggtcgagccgcggcgagggaacggatcggagacgctgcgcctgctcagaaggtagcgcagcggggaaaggcgggagagcgttaacttctgagcctgcgcggtgggagttgctcaagcaggtggtagcgacttggcttccgggcagcgggtaaaggtgagtctggggcatgggttcagtgggcaagtctagggcagcagagttgactacgcctcggcgtatagaatggccctggcctgggacagctaaggacgacaagaggaggccgaagcctaaaacgctttcacctgcttcttcccctgcctagatccccccaatagtaatactaaagagcgccatagtttacaaagatttctccctctcacaacaccttttaatcactgatccgtattcccttagcactcaaatctcttctgtttggattgccctcattaacaatctgaccagctcgtacaatgcatccctctttgcaatttgccacgtatgcttacgtgttccccttttttctactggcaaggaaagaatgtaagcttttattcacaggagatgtctgagacttttgccggtaaaatgatctggctacaaggtctaagagggaaaagcagtttgctcgaggaaaggtattcgtgcattaaggacagtcctgtgagtgagatattggtggacggcttcaagctctagcctgtggcctacagctggcctaaataagactgggaaggaactgtgaagacggtttcaaattcctaaagccctgaaattctccccctaagtttaggaagagcttttgttcttggtgtgtaacactgataaatgaattggtacctagtgattaatctgcacttttattaagatatgacctactttaccttttttgagacaggatcttgctctgtcgcccaatagcccaggctggagtgcagtggcagattgcagtgagctgagatcgcaccactgcactccagcctgggtgacagagcaagactctgtctcaaaaaaaaaaaaaaaaaa

SEQ ID NO: 463593 - DNA, 830 bp, Homo sapiens
taaagttttgctcgagaggggaaactgagggggcagggggcggcccggaaagcgggtccagacgatccggctcgaaatcccctccccccacaacagcgtcgcccgccagagccgccgcccggtacctctcgatgactgaggccaccagctgcggcaactccttcatctcgaaggcggacccggggtcgtgtccgcccccgttgccggggtccccggcgccggagccgctgccgccgcctcttcgccgccgctcgtcgccatcttccgtcgtactactgcggctccctccgggggcttgccaccggcccagcgccgcctcccaggagggggcggaaactgcgcgccgccgtcatgggtcaaaaacgcgacgcgcggagcggcctttgctctcaccggggtcgagccgcggcgagggaacggatcggagacgctgcgcctgctcagaaggtagcgcagcggggaaaggcgggagagcgttaacttctgagcctgcgcggtgggagttgctcaagcaggtggtagcgacttggcttccgggcagcgggtaaaggaaatgcctcaggccagaagaagcagtggcagcctctcacctgcagtgggatctgtctcaactcccattccgtctccagagccaaagtttggagggaacgtgagctcgggtcaggacacaccaggacagcctcatccaccacaccacaggctccagacaggtgctgcagccacggagttgaaaccctaacctacagaaaagtcatcgttaacaggaagctcgtgaaagatttttacatttccctctcagcccaacagcaatattgctgccagcatcccac

SEQ ID NO: 463594 - DNA, 852 bp, Homo sapiens
cctataactgtaataggttccttgcccgatgcatacaacaagtcaatacactaaaacactgagttgcagcacagaaagagattcaaagaaagggcaattattcagtctagaagatatcacagtcaactcttgctcatcagcacatgtaggaaagaagaccatccaaacatcattctcctgtgctttgagctacacattatgttctggtgacaaccaatcaatcaacagacatttggtgcctgcgcccagccttttccatgtctggggagaacactcacctcaaaggagcagccctttcctacagtggttacaatgtaaacattacacaacacataaccatggctactcaaaagcctggtacattctcccaggagccccacagtatgcccacctgagagcaacccagtatgggggctccgacagttcccattgaagatatggaatgaaacaccaccaaggtacaggactcgtattgctcatttcattgacaatgataatcaagtgggaaaatgttcccgagttcaaagctaccaccttctgctctgcagccctgatatgtaacaatcagagcctccttttcctcatctgtaaagtggggatcatcatggcattttcctcattgagctgctgcgaggatttaacaaggaatggaggaccccgccagtaatatagctgttattttaaaacaaactcagaagcctccttgctcctctctgaaggcatccttggaccagttgtgcagttgcatgtataatttctgcaccatgagcccacactccctgcctagctcagatctcacagctctcacctgcatcctgccatcgatcctctcctgtatggactccctgccaa

SEQ ID NO: 463595 - DNA, 1613 bp, Homo sapiens
accatctagttgcaggaaaacaagttcagggctcccactgattatgcattatggttcatgtataaggcctgcaaattaaactgacaaaagattcacaggagaaaaaaaattataaattttgctgatggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaagtatactctctacttattaaaaaaaaaaaaaagtcctttccacgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgttactcagcctgaggttgcagactggtctgaaggtgtacaggtgccctctgtgctattcagctattccctactgaagactggagcgctcagcctgccacggaagactggtctgcagctcccactgctcaggccactgaatgggtaggagcaaccactgactggtcttaagctgttcttgcataggctcttaagcaacatggaaaaatggttgatggaaaataaacatcagtttctaaaaaaaaaaaaagttaactgtaaaacaacctcaggcaggtccttcaggagggattccagaagaaggcagtgttatcataggagatgacagctctatgcgcgtattgcccctggagaccgtccagtgggacaagatgtagaggtggaagacagtgatattgatgatcccgaccctgtgtacacctaggctaatgtgtatttgtgtcctggtttttgacaagaaaaaattaaaaagtaaataaatttttaaaaattttaataggaaaaaagctt

SEQ ID NO: 463596 - DNA, 1495 bp, Homo sapiens
tgctgtcttcgtttgcttgatgttacaacgacaaaatctcagaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaagtcctttccacgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgttactcagcctgaggttgcagactggtctgaaggtgtacaggtgccctctgtgctattcagctattccctactgaagactggagcgctcagcctgccacggaagactggtctgcagctcccactgctcaggccactgaatgggtaggagcaaccactgactggtcttaagctgttcttgcataggctcttaagcaacatggaaaaatggttgatggaaaataaacatcagtttctaaaaaaaaaaaaagttaactgtaaaacaacctcaggcaggtccttcaggagggattccagaagaaggcagtgttatcataggagatgacagctctatgcgcgtattgcccctggagaccgtccagtgggacaagatgtagaggtggaagacagtgatattgatgatcccgaccctgtgtacacctaggctaatgtgtatttgtgtcctggtttttgacaagaaaaaattaaaaagtaaataaatttttaaaaattttaataggaaaaaagctt

SEQ ID NO: 463597 - DNA, 726 bp, Homo sapiens
cttcgcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggtgtccatgatccctccccactgaccttttctaagaaaattcttgtgcccgcattggtattaaatcctcgcattcagtcaaaccatctatagggatcctctcac

SEQ ID NO: 463598 - DNA, 265 bp, Homo sapiens
ttttcttttagtgatagggtatataaaaatacttaaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggtgtccatgatccctccccactgaccttttctaagaaaattcttgtgcccgcattggtattaaatcctcgcattcagtc

SEQ ID NO: 463599 - DNA, 265 bp, Homo sapiens
tctgccattatgaaacccccaccaaaacaccttgaaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggtgtccatgatccctccccactgaccttttctaagaaaattcttgtgcccgcattggtattaaatcctcgcattcagtc

SEQ ID NO: 463600 - DNA, 261 bp, Homo sapiens
agccggatctgttgtgaagactaaccactttaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggtgtccatgatccctccccactgaccttttctaagaaaattcttgtgcccgcattggtattaaatcctcgcattcagtc

SEQ ID NO: 463601 - DNA, 477 bp, Homo sapiens
  misc_feature (11)..(11): n is a, c, g, or t
  misc_feature (33)..(33): n is a, c, g, or t
atgaaaagatntgatgtgtagcaaatacttacngatttgaatagcaggaatggtgtctcactatattgcccaggctggtcatctacttctaggctcaagcgatcttcctgcctcagcctccaaagtgttgggattacaggcatgagccaccacacccagctgaagggcagacactattatttaaagctgaatccccattgtctacaactatgcctggcaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggtgtccatgatccctccccactgaccttttctaagaaaattcttgtgcccgcattggtattaaatcctcgcattcagtcaaaaaaaaaaatcggtctcattggcctca

SEQ ID NO: 463602 - DNA, 236 bp, Homo sapiens
  misc_feature (23)..(24): n is a, c, g, or t
gtcctgtgggtaacaacccctgnngcctggaatgggaaaacgtcaaagtcaaccaaattctgaagacgctgtcagaggtagaagaaagtatcagcacactgatcagccagcctaactgaagatgatgtatgaaggagttggagttgttgaaaccaaggtgtccatgatccctccccactgaccttttctaagaaaattcttgtgcccgcattggtattaaatcctcgcattcagtc

SEQ ID NO: 463603 - DNA, 2187 bp, Homo sapiens
gggcacatgttctcaggacctcctgaggctgcagcatgggccacggtccttaaccttggcaaagtaaacgtcttaatcaattgagacctgtctcagatgctttttggtttacactatcaatgagtgggtttttaggttgtcttcaattttccattgcaaataatgctgctgtgaacatccttgaacatgcatccctgtttacatgtacaaatatatcttagaaaacaggaatactgtatcatgggttatgtgctttttctttctttctttcttttttttattgtagacactgtcaaatagactttagagtactaataaatgtttaacaaccagtcttccaaaaagaggaagtggggctgatttgtagcatttgccaatttccatggtgtgaattcttccaccatggccgatttcaaactactaatgagacatgaatgcacaatcagctctgttagctggtatgaagtggctccagcatagttctcagaatctctcaaactcagaatgcatataaatattggcaaatagccctctaaagtagcccaaccaatgtatactttcacaagcagtgtatgagaatatctacagtcatgctccgcgtaacgatgtttcagtcaatgacagatgacatgtgtgacaatggtcccataagattataatggagctgaaaaattcccatcactagtgtcatagcacattatttatgtgtttgtggtgatgctggtataaataaactactgcactgccagtcatataaaaatataacacaattatgtgcaatacataatacttgataataagtgtgttactggtttatgtacttactatactgtgctttttatcttttaagtatactctctacttattaaaaaaaaaaaaaagtcctttccacgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgttactcagcctgaggttgcagactggtctgaaggtgtacaggtgccctctgtgctattcagctattccctactgaagactggagcgctcagcctgccacggaagactggtctgcagctcccactgctcaggccactgaatgggtaggagcaaccactgactggtcttaagctgttcttgcataggctcttaagcaacatggaaaaatggttgatggaaaataaacatcagtttctaaaaaaaaaaaaagttaactgtaaaacaacctcaggcaggtccttcaggagggattccagaagaaggcagtgttatcataggagatgacagctctatgcgcgtattgcccctggagaccgtccagtgggacaagatgtagaggtggaagacagtgatattgatgatcccgaccctgtgtacacctaggctaatgtgtatttgtgtcctggtttttgacaagaaaaaattaaaaagtaaataaatttttaaaaattttaataggaaaaaagctt

SEQ ID NO: 463604 - DNA, 647 bp, Homo sapiens
cttcgcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacactgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggtgtccatgatccctccccactgaccttttctaagaaaattcttgtgcccgcattggtattaaatcctcgcattcagtc

SEQ ID NO: 463605 - DNA, 448 bp, Homo sapiens
  misc_feature (11)..(11): n is a, c, g, or t
  misc_feature (33)..(33): n is a, c, g, or t
atgaaaagatntgatgtgtagcaaatacttacngatttgaatagcaggaatggtgtctcactatattgcccaggctggtcatctacttctaggctcaagcgatcttcctgcctcagcctccaaagtgttgggattacaggcatgagccaccacacccagctgaagggcagacactattatttaaagctgaatccccattgtctacaactatgcctggcaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggtgtccatgatccctccccactgaccttttctaagaaaattcttgtgcccgcattggtattaaatcctcgcattcagtc

SEQ ID NO: 463606 - DNA, 730 bp, Homo sapiens
cttcgcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggtgtccatgatccctccccactgaccttttctaagaaaattcttgtgcccgcattggtattaaatcctcgcattcagtcaaaaaaaaaaatcggtctcattggcctca

SEQ ID NO: 463607 - DNA, 216 bp, Homo sapiens
actatattgcccaggctggtcatctacttctaggctcaagcgatcttcctgcctcagcctccaaagtgttgggattacaggcatgagccaccacacccagctgaagggcagacactattatttaaagctgaatccccattgtctacaactatgcctggcaggtataagacactgaattagttttttatgcctaattcactgacttacagttctgtg

SEQ ID NO: 463608 - DNA, 701 bp, Homo sapiens
cttcgcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggtgtccatgatccctccccactgaccttttctaagaaaattcttgtgcccgcattggtattaaatcctcgcattcagtc

SEQ ID NO: 463609 - DNA, 735 bp, Homo sapiens
cttcgcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggtgtccatgatccctccccactgaccttttctaagaaaattcttgtgcccgcattggtattaaatcctcgcattcagtcaaaaaaaaggggggggatggcctcgttggcctca

SEQ ID NO: 463610 - DNA, 1906 bp, Homo sapiens
cttcgcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgttactcagcctgaggttgcagactggtctgaaggtgtacaggtgccctctgtgctattcagctattccctactgaagactggagcgctcagcctgccacggaagactggtctgcagctcccactgctcaggccactgaatgggtaggagcaaccactgactggtcttaagctgttcttgcataggctcttaagcaacatggaaaaatggttgatggaaaataaacatcagtttctaaaaaaaaaaaaagttaactgtaaaacaacctcaggcaggtccttcaggagggattccagaagaaggcagtgttatcataggagatgacagctctatgcgcgtattgcccctggagaccgtccagtgggacaagatgtagaggtggaagacagtgatattgatgatcccgaccctgtgtacacctaggctaatgtgtatttgtgtcctggtttttgacaagaaaaaattaaaaagtaaataaatttttaaaaattttaataggaaaaaagctt

SEQ ID NO: 463611 - DNA, 1043 bp, Homo sapiens
cttcgcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggtgtccatgatccctccccactgaccttttctaagaaaattcttgtgcccgcattggtattaaatcctcgcattcagtcttcctgcctctacttgctcagatttctttttttctagctttcatttagtcttacatttgttccagtgcagaggttctcacccttcagtgtgcataaatgttataaggggtacttgtaaaagcattcacttttttgttgttattattaaattcggagtgttgctctgttgcccaggctggagtgcagtggtgcagtcatggctcactgcagcctcaagctcctggactcaagcgagcctcccacctcagctactcaggaggctgagatgggaggattacttgagcccaggagttcaagaccatcctgggcatgatggtgagacctcatctcaatttaaagaaa

SEQ ID NO: 463612 - DNA, 1609 bp, Homo sapiens
cttcgcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgttactcagcctgaggttgcagactggtctgaaggtgtacaggtgccctctgtgctattcagctattccctactgaagactggagcgctcagcctgccacggaagactggtctgcagctcccactgctcaggccactgaatgggtaggagcaaccactgactggtcttaagctgttcttgcataggctcttaagcaacatggaaaaatggttgatggaaaataaacatcagtttctaaaaaaaaaaaaagttaactgtaaaacaacctcaggcaggtccttcaggagggattccagaagaaggcagtgttatcataggagatgacagctctatgcgcgtattgcccctggagaccgtccagtgggacaagatgtagaggtggaagacagtgatattgatgatcccgaccctgtgtacacctaggctaatgtgtatttgtgtcctggtttttgacaagaaaaaattaaaaagtaaataaatttttaaaaattttaataggaaaaaagctt

SEQ ID NO: 463613 - DNA, 1435 bp, Homo sapiens
  misc_feature (1)..(2): n is a, c, g, or t
  misc_feature (5)..(5): n is a, c, g, or t
  misc_feature (8)..(8): n is a, c, g, or t
  misc_feature (10)..(12): n is a, c, g, or t
  misc_feature (14)..(15): n is a, c, g, or t
  misc_feature (17)..(17): n is a, c, g, or t
nntcntcnannntnntntgcaatatgaagaaaaggcatacgctgagagtgaagattggcgggggaggtcctggatgtctgaggactggtataaaatagtcatccaggagagacaccaggcagtaatttcttcactctacagacctgtgggaggtcaatgtatcctggtatcaggatcaagaaaaatgacctatcatgaagaccttctttccaacaaagattgtggaggagagatgaatggagaaggagctgggaagggcctggtcatcaaaggtcctcctctcctcccccagcatctgggaaggagtgagatgtggctgcaggattggggaatagctaagtcagaaatgagcagcagtgcaactgtggcaatcttggaggggggtctcagccatgaaagagaaccagggggtgccttgccagctggaggctgcagaatcttagcttgggtgttttgccttctccgtggaactgacagatgacaggaatgacgtggagtattctcatcaagcctcctttctccattcatacttcctgtctcttcattgaggaataaaacatcctggtttaagctcagaacataggaatgaaaatagggaagaaaatatgtgaacaatgcacagtgttctctccaaaatggcaagaacgtcatctcctagaaaagcactcagaagtccttggcctttgggaaaaaagagcttgcggaagatgacattggttcattgtccttaaaaggcagaacaggcctcccactattgaaaacagctcattcccttccacacctggtcctcagatcatgcttgggtgcccaggctcctgtgcttaatctttcttaactggatcatcagtgcttgggaaatgggcaggataacaatttaaagagataattgactgcacaaatcagctcatcccttcaagggataaattttctcacactttctggttctgtaataggtcagggctgttggagacagagctggctttttccctgatgtccagggtcctgaaatgaagtatggctgggccacttgactgggagtgcagttacagaagccaatgctggtgctgcagagagcgcaatgcccaaagtgggtgcatctctgatggtgtaaaggatgaagaacaagctctgaggaaggttagcaggaagctcgattcaagtcaccagcagaaaacagagttgccttcatgtctttactctcaaggttctgcagcttgccatagcggaaacctgaatcttgttaaatggagatgggcaatacaggcaatggatccttcaggtctccttcttccaagcaaatgtagccctgggaacactttcattgaaaagaaagaagagacaaagtgactggtgactggtgatacaaaatcagaatagggatattggtattttatcttccaatatgtcttctggacttcttggtgatactactaat

SEQ ID NO: 463614 - DNA, 686 bp, Homo sapiens
aaaacagctcattcccttccacacctggtcctcagatcatgcttgggtgcccaggctcctgtgcttaatctttcttaactggatcatcagtgcttgggaaatgggcaggataacaatttaaagagataattgactgcacaaatcagctcatcccttcaagggataaattttctcacactttctggttctgtaataggtcagggctgttggagacagagctggctttttccctgatgtccagggtcctgaaatgaagtatggctgggccacttgactgggagtgcagttacagaagccaatgctggtgctgcagagagcgcaatgcccaaagtgggtgcatctctgatggtgtaaaggatgaagaacaagctctgaggaaggttaggtaagttcctggctttcagtctgtcccctccacctgccaagtgagcaagtctgttcctcttgccaagtgagctgctgtttttctcgttggttaaatgggatgttggataaatcatctctactagtctgacagttttttatatttaaagattttataaattatacaaaggttctgtagatgaaaagcaacaccagattccaggaattgcttaaaggtgaggtaggccaaagcgatagaagcaggagttctttgtaaaggaagggagcagcacacttcatgggcaggtcaagaggtcacctgg

SEQ ID NO: 463615 - DNA, 1410 bp, Homo sapiens
  misc_feature (1)..(2): n is a, c, g, or t
  misc_feature (5)..(5): n is a, c, g, or t
  misc_feature (8)..(8): n is a, c, g, or t
  misc_feature (10)..(12): n is a, c, g, or t
  misc_feature (14)..(15): n is a, c, g, or t
  misc_feature (17)..(17): n is a, c, g, or t
nntcntcnannntnntntgcaatatgaagaaaaggcatacgctgagagtgaagattggcgggggaggtcctggatgtctgaggactggtataaaatagtcatccaggagagacaccaggcagtaatttcttcactctacagacctgtgggaggtcaatgtatcctggtatcaggatcaagaaaaatgacctatcatgaagaccttctttccaacaaagattgtggaggagagatgaatggagaaggagctgggaagggcctggtcatcaaaggtcctcctctcctcccccagcatctgggaaggagtgagatgtggctgcaggattggggaatagctaagtcagaaatgagcagcagtgcaactgtggcaatcttggaggggggtctcagccatgaaagagaaccagggggtgccttgccagctggaggctgcagaatcttagcttgggtgttttgccttctccgtggaactgacagatgacaggaatgacgtggagtattctcatcaagcctcctttctccattcatacttcctgtctcttcattgaggaataaaacatcctggtttaagctcagaacataggaatgaaaatagggaagaaaatatgtgaacaatgcacagtgttctctccaaaatggcaagaacgtcatctcctagaaaagcactcagaagtccttggcctttgggaaaaaagagcttgcggaagatgacattggttcattgtccttaaaaggcagaacaggcctcccactattgaaaacagctcattcccttccacacctggtcctcagatcatgcttgggtgcccaggctcctgtgcttaatctttcttaactggatcatcagtgcttgggaaatgggcaggataacaatttaaagagataattgactgcacaaatcagctcatcccttcaagggataaattttctcacactttctggttctgtaataggtcagggctgttggagacagagctggctttttccctgatgtccagggtcctgaaatgaagtatggctgggccacttgactgggagtgcagttacagaagccaatgctggtgctgcagagagcgcaatgcccaaagtgggtgcatctctgatggtgtaaaggatgaagaacaagctctgaggaaggttagcaggaagctcgattcaagtcaccagcagaaaacagagttgccttcatgtctttactctcaaggttctgcagcttgccatagcggaaacctgaatcttgttaaatggagatgggcaatacaggcaatggatccttcaggtctccttcttccaagcaaatgtagccctgggaacactttcattgaaaagaaagaagagacaaagtgactggtgactggtgatacaaaatcagaataggatacacgtcgcgagggatcctcaggcgccgcc

SEQ ID NO: 463616 - DNA, 593 bp, Homo sapiens
aatctctctatactcttctatataatggggctagcctggaagagatacttgcacaaccatgttcagagcagcatcatccacaataaccaaaaggtggaagcaacccaagtgtccgtggatggatggacggatcaacaaaatgctgtctatgcatacagtggaataagtgcagtgaatagaagacacttctctgcaccccaaaagctccatgctgattgtgagaaggaaatgctggatggaggggttcctggaactactgtgagggtttcttttgatttctcctgcttagaaatggtgagagaactttggatgtggaacgtggaggaggaggaacacgaagtggggatctccacttggggtggtcagcactgcgggtgcccagcaaagtcactgcctggtccacatcccggaggggtctctgcgcctcagtcggcatcgcagctgatggtgaaacttttggtgtggcagaagagtgtccacaaacttcggaagatcgctgctcagagtgaggaatggagttgtgttttgaataaaatatccacgcatccttttgtgagcaaggagcatgatggtacttagacctaccatttctc

SEQ ID NO: 463617 - DNA, 696 bp, Homo sapiens
aggtgatagaatccaccctgcctctgacagcatccaatctggagcaaaggcttatttcaaccctcccccaagctcccaatacaagcccaaattctggaacaggtcctttccaacacctccttcagagaagctccctggctccaggcagtgcttgctcccctcactgcagcaggaagcctaacttgcgaactgcaggtgtgttccaggtggtcactggatgcaaggcattgacagatggatcccatcgatacccccactgcaaaaccatagtgcagtgaatagaagacacttctctgcaccccaaaagctccatgctgattgtgagaaggaaatgctggatggaggggttcctggaactactgtgagggtttcttttgatttctcctgcttagaaatggtgagagaactttggatgtggaacgtggaggaggaggaacacgaagtggggatctccacttggggtggtcagcactgcgggtgcccagcaaagtcactgcctggtccacatcccggaggggtctctgcgcctcagtcggcatcgcagctgatggtgaaacttttggtgtggcagaagagtgtccacaaacttcggaagatcgctgctcagagtgaggaatggagttgtgttttgaataaaatatccacgcatccttttgtgagcaaggagcatgatggtacttagacctaccatttctc

SEQ ID NO: 463618 - DNA, 476 bp, Homo sapiens
aggtgatagaatccaccctgcctctgacagcatccaatctggagcaaaggcttatttcaaccctcccccaagctcccaatacaagcccaaattctggaacaggtcctttccaacacctccttcagagaagctccctggctccaggcagtgcttgctcccctcactgcagcaggaagcctaacttgcgaactgcaggtgtgttccaggtggtcactggatgcaaggcattgacagatggatcccatcgatacccccactgcaaaaccatagtgcagtgaatagaagacacttctctgcaccccaaaagctccatgctgattgtgagaaggaaatgctggatggaggggttcctggaactactgtgagggatgatactccaaattgatacttaatatacagaaatgactatcatggacataacccacaacatgtgaaatgtatggctcattctactgacattatacaggaaagttaat

SEQ ID NO: 463619 - DNA, 875 bp, Homo sapiens
ccagtggtttgcaaccttggctacatattagaacaacctgggaagctttcaaaactcccgatgccacagtggggcacccctggccagggctacagacagaaggcctacttggctggactggtcctggtgatccaaaatagcctggagaggtctggttcctttagttctaatggaccatgtccagccaaggaggtgtctaacaaggaagaaacacatcaaggcttcagggtctatggggagaaagcccagcacgtagaaaaattacagaacatcagcagcaggactctggaagcactggtaacagtttgtcacttgatctggatgaacaccagcgtgttccgttttggaaatcctttcagctgtacttaccctaagttttcaaaagcctcttggtttccagctttggtcaacagcgctcagaatgaaaggaaggtggtggtgctggctttcaagtctcctccaaatgcaactgacccaggtctgcctgtcctccattagcttttgctcgttggagagggataacacaccgctaagaaaaagacttgttctgagagtgaggactgcccccggattttgtaaccagttgcaaccacctgaaagcagctctggggaagaggtcattgaagagtctttccaggtggaaagcgaagtaaatgaactctggggtggtgtctcccaactctcacttccagctctcctgtgtttgtagactctgtgttcctaaacaagggaaaatacagccacaacctccaaaggacaagtgcttattcattcctttaatttatctttattgaggatgttccatgtacagtggaagaaaaattgaaagtgaataaaggaagctgaagatgtttaaagatatagttgagaaatct

SEQ ID NO: 463620 - DNA, 2432 bp, Homo sapiens
gtcacccaagcgactgggagccgcgtcctgctctgggactgagccgttggagctgccccgctgaccgcactaggctgaccgcaaccggctgaccacacacagtcctcactcccctggccctggtgggcggcaggcaccatggcgcagacagtgccgccctgcgagctgccctgcaaagagtacgacgtggcccgtaacacgggcgcctacacgtcctccggcctggccaccgccagcttccgcacctccaagtacctgctggaggagtggttccagaactgctatgctcgctaccaccaggccttcgccgaccgcgaccagtcggagcggcagcggcacgagagccagcagctggccacagagacccaggcgctggcgcagcgcacgcagcaagactccacgcgcacagtgggcgagcgactgcaggacacgcacagctggaagtcggagctgcagcgtgagatggaggcgctggctgcggagaccaacttggctccttgggccccaggaagccaacgggcttgggagccgcggccccttggaacgccacagaaggtgcccttctccatcaccactgacaaccgcatgccgtgagcgccggagcaccaactctggcgacatgtgaactgctgaaggaagccgagctcatccggaacattcaggagctgctgaagagaaccatcatgcaagcagtgagccagatccgactgaaccgggagcacaaggagacctgcgagatggactggtcagacaagatggaggcctacaacatcgacgagacctgcgggcgccaccacagccagagcaccgaggtgcaggctcatccgtactccaccaccttccaagagaggccagcagagggagcctgaccaccgcccactagagggcggcaaactcctgggagcaaaaagagggcgcgggcgctgggtactagggaaggggggctgcgggggccggaggtgctgcagagggggcctccggggcagcggtgctgggaacggggtcgcgggggcacgaggggactaagtgcccggggtgggtagggtgtggggggactcagagaagttgtggccagggggcactcgggggcagggagcctgagggactgggctttgtggggcagcatggggtgcatcggagtccatgcacgtcctccaggagcatggggcgcggacagggcatgggggcgcagcagggctcccagccttcggcagagcctccccgaccctctcctggctgtcccccgccccgcagcgcctccaccccggagacccgggccaagttcacgcaggacaatctgtgccgtgcccagcgcgagcgcctggcctcggccaacctgcgggtgctggtggactgcatccttcgcgacacctccgaggacctgcggctccagtgcgacgccgtgaacctggccttcgggcgccgctgtgaggagctggaggacgcgcggtacaagctgcatcaccacctgcacaaggctgttgagtgaggtggaggagctgaacatgtccctcacagcactgcgagagaagcttctagaagcggagcagtccctgcgcaacctcgaggacatccacatgagcctggagaaggacattgccgccatgaccaacagtctcttcatcgaccgccagaagtgcatggcccatcgtactcgctaccccaccatcctgcagctggctggctaccagtgagcagcggcacggtgcttccccccagtcccccaaataaacagcgcgttagctttcaaaaaaaaacaaaaacaacaaaaacaacacaaacaaataaaaaaaagacaaaacaaaaaaagaaaaaaaaggcgggcggcgcgcgcgcccaaaaagaataaccccctcgcagaggggggccacgacaagcgttctaagcgcgggctgccgccccgacggcttttcatcgtagcagcagaagcgggcggcgccccatgtaggcagaggagcgcgtcgtatatccatataggcccacagcgagcgccaccggccgcgcgcggcgcgcgcttatcagaaaacgaccccgctcggacagacgagagcgtgggagaacacaccgcgcgcccgaccaccgacgaggggagagaccacctctggcggggagagacggggcgacccccacctctctactctctgcggggggggggcggggcgacacccatactcagtgggggggagcccaccacaccaccccccacacaccgcaacacacatacttatacaagacgcggccccccgacaagcgggcggccaacaaatctattacacacacctctctcccaacgcagcgggtgcataaatacgcggggtggcgtgcacacacacccacgaccgcgccgcgcagaaacaaagccagtcccgcgtcgcccgcccgcccgccacagaagaaacaacttcctgcgccgcccaaacacccaggcaatc

SEQ ID NO: 463621 - DNA, 413 bp, Homo sapiens
ccctgagactcagagccagcaggggctgccccaggtcacagtggagcgcaggactgggtgggggaggttccggcgcagcctgaggttgagtggccagagcccagtgccacatctgatctgcagcctcccagcctgggccgcagctcctggtcactgctgagcacgagggctgcccgggacaggcccacccagaactccctcctgaggcaggcattggggcccagcctgcagcacagagggtccccagcagggccctccctgggcacacatcaaggccctgccccaccccgccccagactgaaccgggagcacaaggagacctgcgagatggactggtcagacaagatggaggcctacaacatcgacgagacctgcgggcgccaccacagccagagcaccgaggtgcaggctca

SEQ ID NO: 463622 - DNA, 2587 bp, Homo sapiens
gtcacccaagcgactgggagccgcgtcctgctctgggactgagccgttggagctgccccgctgaccgcactaggctgaccgcaaccggctgaccacacacagtcctcactcccctggccctggtgggcggcaggcaccatggcgcagacagtgccgccctgcgagctgccctgcaaagagtacgacgtggcccgtaacacgggcgcctacacgtcctccggcctggccaccgccagcttccgcacctccaagtacctgctggaggagtggttccagaactgctatgctcgctaccaccaggccttcgccgaccgcgaccagtcggagcggcagcggcacgagagccagcagctggccacagagacccaggcgctggcgcagcgcacgcagcaagactccacgcgcacagtgggcgagcgactgcaggacacgcacagctggaagtcggagctgcagcgtgagatggaggcgctggctgcggagaccaacttggctccttgggccccaggaagccaacgggcttgggagccgcggccccttggaacgccacagaaggtgcccttctccatcaccactgacaaccgcatgccgtgagcgccggagcaccaactctggcgacatgtgaactgctgaaggaagccgagctcatccggaacattcaggagctgctgaagagaaccatcatgcaagcagtgagccagatccgactgaaccgggagcacaaggagacctgcgagatggactggtcagacaagatggaggcctacaacatcgacgagacctgcgggcgccaccacagccagagcaccgaggtgcaggctcatccgtactccaccaccttccaagagaggccagcagagggagcctgaccaccgcccactagagggcggcaaactcctgggagcaaaaagagggcgcgggcgctgggtactagggaaggggggctgcgggggccggaggtgctgcagagggggcctccggggcagcggtgctgggaacggggtcgcgggggcacgaggggactaagtgcccggggtgggtagggtgtggggggactcagagaagttgtggccagggggcactcgggggcagggagcctgagggactgggctttgtggggcagcatggggtgcatcggagtccatgcacgtcctccaggagcatggggcgcggacagggcatgggggcgcagcagggctcccagccttcggcagagcctccccgaccctctcctggctgtcccccgccccgcagcgcctccaccccggagacccgggccaagttcacgcaggacaatctgtgccgtgcccagcgcgagcgcctggcctcggccaacctgcgggtgctggtggactgcatccttcgcgacacctccgaggacctgcggctccagtgcgacgccgtgaacctggccttcgggcgccgctgtgaggagctggaggacgcgcggtacaagctgcatcaccacctgcacaagacactgcgggaaatcacagatcaggaacacaacgtggcggcactgaagcaggccatcaaggacaaagaggcacctctgcacgtagcccagacccggctgtacctgcgctcgcaccggcccaacatggagctgtgccgtgacgcagcccagttcaggctgttgagtgaggtggaggagctgaacatgtccctcacagcactgcgagagaagcttctagaagcggagcagtccctgcgcaacctcgaggacatccacatgagcctggagaaggacattgccgccatgaccaacagtctcttcatcgaccgccagaagtgcatggcccatcgtactcgctaccccaccatcctgcagctggctggctaccagtgagcagcggcacggtgcttccccccagtcccccaaataaacagcgcgttagctttcaaaaaaaaacaaaaacaacaaaaacaacacaaacaaataaaaaaaagacaaaacaaaaaaagaaaaaaaaggcgggcggcgcgcgcgcccaaaaagaataaccccctcgcagaggggggccacgacaagcgttctaagcgcgggctgccgccccgacggcttttcatcgtagcagcagaagcgggcggcgccccatgtaggcagaggagcgcgtcgtatatccatataggcccacagcgagcgccaccggccgcgcgcggcgcgcgcttatcagaaaacgaccccgctcggacagacgagagcgtgggagaacacaccgcgcgcccgaccaccgacgaggggagagaccacctctggcggggagagacggggcgacccccacctctctactctctgcggggggggggcggggcgacacccatactcagtgggggggagcccaccacaccaccccccacacaccgcaacacacatacttatacaagacgcggccccccgacaagcgggcggccaacaaatctattacacacacctctctcccaacgcagcgggtgcataaatacgcggggtggcgtgcacacacacccacgaccgcgccgcgcagaaacaaagccagtcccgcgtcgcccgcccgcccgccacagaagaaacaacttcctgcgccgcccaaacacccaggcaatc

SEQ ID NO: 463623 - DNA, 414 bp, Homo sapiens
ctgctttcctgatggggttctttcatggagtcttcccaggacctcctgccagctcccattgggagttttgggtcccctacaccccggtaggtgcatacttctgccctccctagccccggctcacacccccccaacacccccaggctgttgagtgaggtggaggagctgaacatgtccctcacagcactgcgagagaagcttctagaagcggagcagtccctgcgcaacctcgaggacatccacatgagcctggagaaggacattgccgccatgaccaacagtctcttcatcgaccgccagaagtgcatggcccatcgtactcgctaccccaccatcctgcagctggctggctaccagtgagcagcggcacggtgcttccccccagtcccccaaataaacagcgcgttagctttc

SEQ ID NO: 463624 - DNA, 1123 bp, Homo sapiens
cccgcagcggacgctccccacgaggtagagccccgtttccacacctggagcagctgcacctggaggtggggctcatctccagacctggagcagctgcctgccccagggcagaagccactgcccgcagctagggagcattgaggaggtctccccaggtccgcgcgggttttctccaggtcctccagtttcctcccacatcccaagtatacacctcagcctcacggcatgtctacatgggcctagtccgagtgagtgtgggtgtcccatggaggcctgtcctatccagggcgggtgcccaccttggcactgagcctccaggatgggccctggtcacctgccactctgaactggagaaagcaagttggaaaatgaatgaatacatgaatataaattatcaaataaaaattataaagcctacggtaatcacacaaacgcatgacaacaaacgccgcgtgtgagggtgctcaaggagccgccatactcacggtcgcttgtctttcagctgtctccccaaagtgtctaaaaccaagctgtgctccgaccaccttgggcacatgttgtcaggacctcctgaggccatgtcacggcatttgtgactgtgtgaatggcagccttgtgagtgaacttagtcaggaagccctgctttctgttaatggcaggattcccccttccccccaaaaaatcatttatattcactcttattggagtgtaaaactcccttcacaaatcgtggaaagtaaatgtcagaaacattgcttttcaaaagactttcaggaaaggaatgtgtggagcagctgtgcagaaataacaaaatgttcgtttttcttccagaccagcttatctgcagtgaattcctggcactgatacaaaggattattaaaccatgcagaaaacatggctcgagttcccagtatatgttcccttgcatactagcatacaccgttcacaccagtggctttttccaaccacaactagctttggccagcatcatctcgtgcctttcctcctggacgcctgttgtgactctccgcaaccatcctgcctgtctagaaaggagcacaggtgaagctgcctgactcatcagctacacaaacttgttctgacttaggttttgttgtttttt

SEQ ID NO: 463625 - DNA, 7809 bp, Homo sapiens
ccaggattgttacaacattgaagatatggtttacaggcttctagggcatgtcttcccttcaactcacactgaaaatgaactaaaagagaaaaagtttccaccggatgatgaatttgtggaggcagcttcaaaattgactgatgaaattataaaagaaatttctgaacatgagattcgactttccatggcagaggataatgcagaaagtatgcagttagaacctattgaaaatttggtcgactccatatgtaataatattttgaaaacatctgaattccaagctgaagtacaaaaagatgcagacaaaaaaggatgctcattcctcagtaaattagctggttttattatgaaagaaatcatgtatcatcatttacagccatttttacatggtgaagaatcatctttcagtgacttatctgattatgaccatgtctctgaacttgctaaatctggtaaagaaaagacacagccttctctctattcagctacatttttggaagacataatcattgaccttgttcacaaattttgttctctcctcattattactgaagattctaagaaaaatgaaatggcagagctagatattatgggcttggctctaaaacttgcaaattctctgataagggaatttaagaaaagtgatattaaagttttaccaaatgctgaaaaaatgttttcttttccaccaattgataaagagacagttgataaaatatccaattttgtatatgaacagttcatagaaaaatgcacatctcatgatattcaaaaaggtgatgaaagtaacattgctatagggatgattgctgctctaacccagaaggcaatatctgcattcaggattcaaccacttttttcaggagactggtcttccaccttcttttcatttctaaatccagataatatcacccaaagggttcaacacctaccacaaaacacctttacacaaataagcagatgtgcaaaagagaaccaactttctttaccagatcaatcatataaagatacttcttccaccccagattgcaaaaacatgatgagcactttggaaataaatagaggtacaatgaatagaaagaaaagttttaaaaccaaggacacatcagtgaaaaaaggtgacatccaaaatccagtacttagctctataaatgcaattatgaaaagcggcatgattaacctaacatcagggttggctacaggtgtgacaaataaaaaggaagtggatgaaaataaagtgggaatttgtactcaaaaacatagtgagaatgtatcaaaagttacttcaactaccactgtgaaaagtaaagatactcaggagccaaatttgagtgaaacatttaataataatgaaattgagaagaaaagaaatttaattccaacagataaaaaagggaaagatgatgagatatacacacatttttcattaataattgatgatacagaatatgagaaggaagtacttggatcagattctgaaataggctataaaaagaagattgacaatgcaagggaaagctcatttaaaaaagatgacaagctctttcagttatcctccttgaagtccaagagaaatctagggactacaacagatactttggaaataagaattcgaacatcaagcaatgaggggagaagagactctccaacacaaacgtgtagggatgaggaacaccactcagattatgaacatgttcaaaatgtcattgaaaatatttttgaagatgttttagaactatcttcttctccagaaccagcatattattcgaaactcagttatgaccaaagccccccaggtgataatgtattaaatgtaattcaagagattagcagggattcggcacagtctgttacaacaaaaaaagtatcctcctcaactaacaaaaatatctctgccaaagaaaaagaagaggaagagagagaaaaagagaaagtaagagaggagattaaaagtgaacccagtaaaccagatgatcctcaaaaccaacgagaaagtaaacctggaatttttcccgctaagtttttagaagatgttattactgagatggttaaacaattgatcttttcttctataccagaaacacaaatacaagatagatgtcaaaatgttagtgataagcaaaatcaagccaaactctatgacactgctatgaaactcatcaattcactgttaaaggagttctcagatgctcaaattaaggttttcaggccagataagggaaatcagttccctgggggtaaagtgtcttcagttcctaaagtacctccaaggtataaagagccaactacagatgaagcaccatccagcattaagataaaatctgcagataaaatgccacctatgcataaaatgatgagaaaaccttcttcagataagataccatcaattgacaaaacattggtcaataaagttgttcactcctctgtttgtaatattttaaatgactatggatctcaagactctatttggaagaatataaacagtaatggagaaaatttagcaagaagactaactagtgcagtgataaatgaaattttccaacgtcaggttaacttgatattttgtgatgaggtttcagtttcagcatgtttgcctctggaatctaaggatgttgttaaaaaggtccaaaagttggcccaaacagccagcaaagaatgtcaaacttcatcaccatatacaataatattacctcataaatttttggagaatgtgatttctgctcttttctccaaaattttctcaacaatatccagcacaaaaacaaaagaacctgaggacaatttgtccacagaactgaatttccttcaaatgaagttagtaagtgcagttgcaacagagatctcccaagataaatatatgactatacagtatgtagaaaccttacaatctgatgatgatgaaattattcaattagtggttcagtctgtttataataatctcttgccacagtttggatcacaagagattatacaaaattgtgtaaccagtggatgcaaaatcctttcagaaaacatagttgacttggttctacgagaagtggctagcaatcagctgcagagctatttttgtggagagctaactccacatcagtgtgtggaagttgaaaacatcgttgaaaagatccttaaagatgttttccaaactactgatgtgcccctacctaaaccttcacatgctgataagctgtcttataacataatagaagaaattgctgtgaaatttttatcaaagcttttatctatatttccaaaagtacataaagaaagaacaaaatctctagagactgatatgcaaaaaataacttcaaaagtactaaattcagtccaagaatttatctccaaaagctttttaatggtgaatgcaatttcgaattctgaatttcaacctcaagtagaggaagaagtatcaaattcagaattagttctggaagctgtcaaaattatggaaaaagtgatcaaaattattgatgaacttaagtctaaggaaaagtcttcatccagaaaaggtttgacattagatgccaaacttttagaagaggtgttggccttgttcttggctaaactaataaggttgccaagttcctcaagcaaagatgaaaaaaacttatcaaagactgagttaaataaaattgcatctcaactgtcaaaattggtaacagctgaaatttccagaagtagcattagtctaatagcttctgatcctgaagagcactgtttaaatccagaaaatacagaaaggatttatcaggttgtcgattccgtttatagtaacatactgcaacaatcaggaaccaacaaagaattttattatgatataaaagatacaaatacagcctttcctaaaaaagtggctagtttaattattgatggagtttcaagttttccattagatacaattaactcaacaatttcaaatgctgatctctctggagagctagacgttaatagaattgttcaaaaggcccaagaacatgcttttaatgtgattcctgaattagagcaagaaaagttagatcaaaatttatctgaagaggaatctccaattaaaatagttccacatgttggaaaaaaaccagtcaaaatagatccaaaaattatttcagaacacttagcagttatttctataaaaactcaacctcttgagaaacttaagcaggagtgtttgaaaagaactggacatagcatagcagaactgagaagagcatcaataagtgggagaaattactccttaggatcacctgatttagaaaagagaaagacagaaagacgtacctcattggataagactggaagactggatgtaaaacccctagagaatataagaaagcctgatattacaaaggtggagctcttaaaagatgttcaaagtaaaaatgatcttattgttcgattagtagctcatgatattgatcaagtgtatttggaaaattacataaaagaggaacgagattctgatgaagatgaagttgttttaacacagacttttgcaaaagaagaaggcatcaaagtatttgaagatcaagtgaaagaagtcaagaagccaatacaaagcaaactttctcctaagtcaacactaagcacgagcagcctgaaaaaatttttgtcactaagtaaatgttgtcagaccacagccagtgcaaatattgaaagtactgaagcaatctcaaatcaggtaatagaatccaaggagacacatgttaaaagagctgttgctgagcttgacatggccacaccaaagacgatgcctgaaacagcctcttcatcttgggaggaaaagccccagtgtaagaaagaagaaaagaatcttgttactgaaccaacacattacttcatacacagaattatgagttcatcttcatacaaccaagaagatctcatttcatctactggtgaggctgaagattgtcactcagacccaagtgctaaaatattagaagaaagttctcaggaacaaaagccagagcatggaaacagtgttaagtttatcaccatctttgaaagatccaaggatgttcttggcagtgcaaatccctcaaaggaagtcatttcagaaactcccaagcccgatgtctccaaacaaggatctaaaatgctgacaaaaatgtcttcagctttgtcaaaggtgttttctcaatgtaacaccaatatttccagatcttcctcaccagctcaccaggatgaacactgaagcttttgtacctgatataagtatgcttacttcttttagaaaataaaatggtttttaaagcatagtatagcgtcttataagatgattcctatactactgaaaataaaagcaaaaggaagtgtagaagggaccaggcaaagaagggtttaacaaatgctttgaataagcattttgatgtaagaaatgttaataattagtattacctgtgtgccatgagagtaagtgactaaacacataattattaaactagacaactcacagtacccaccagaaaatgcacattgattgctcctgctaaattttagaggatgttgttaccaggacagttattaaattgagatgaaaaccaagctgaaaatgaaactatgtcacggataagtttattgttaaaggcatatttagatactcgaataaaaggatttataacagataaatttttcccacctgaaagtaaagttaatttagtttatgtctcccaggcaaaatgatccaactgtagacaaagcaccatttgaaagtaaatgataactatatataattccatatatgcataaaatggcccctgtgataaaaaaaatccttgcaagtaacgtacctcttatggataaaatatcaatcaagaaatcattggtcaataaagttattaaataattttcagaaatattatacacgaatatagagatcaagatccatttgtaaaaacaaaagtaatgggaaaaatttaataatatggctagctagtgcagtgataaaagaaatttttcaaaattagctgaacttgctactttgtgataaagttccaatgtcagcatgtttgcctctggaatccaaggatgttttataaagagattcaacagatggaccaagaagctgggaaggaatgtcaaatatcatcacccaaaaagggtgactcatgaatttttagagaatgtgtattctgttttatctaaaattttcttgacaattgccactaataaagcagaaacttctgaaaaagttttgttttaaaacaacaaacttcctttaatgaagttgatctgtgcagtaatgacagggaagaaaaaagtgattacctagtcaaatttttacatataaataataaaattatttaactggcaatttagtctacttataataatctcttaaaaacagattaatcccaaagatcatacaaaattgccgaacttgtggatgcagaccttttaaaaaatgatggttggtgagaaatagctggaaattcatctctgaattattttcaaaagagctgactctacatcagtttgcattagttgacagtgttgttgaaagcattcttacagatgtcatccaaaccaatgatgtttcccaaacttagatattacgtgcttataagctgtctttcaacgtaacatttcactgtaaaaatttaaagcactgtgattcacatacttatcaactgaaaaatgtaatatataaacataagatactctgaattaagagggtttttaatggtgaaggaaatttcctgttttctctgactcaagtagaggaagcaacatcaagttcagaattagtccttgaagttgacaacattttagtaaggaatggttaatgttattgagaaatttaagtcctaggaaaaaccatccagaaatacttctgtgttagacatcatgtatgtgaaacatcatctttattttcaacaaaactagtagggtaaatgtgctaaaagtatcaaacactgaattgaaaaaatgtgtattattacctgataaaacctgtagtggctaaaatctctaaaagtaacattagtcttctagctaatgactaatgctaaagcagaagaaagtttttaagattcataaaatttaaattattccttaggttgttgattctttctatgttttactaaaatggactggaaaacattttgtgtgaaaggctagaaagtagacattttaggtttgtagattctctgtcaaatctactccattatgctattgtagcacaaaaccaaccatatacaacacataaacaaataaatagatgtggatgtgattcaataaaaatttctttataaacactgaaatttgaatttcatttaatgttacatgtcataacatagaatttttcttttgatttttttcaataatttgaaaatataaaaattattcttaggtttattaaagacaagtgacaggacagatttagcccatgctgatttctgtactataataatttggaactcatgaataagcttatttttatatgaaggtactgattattgacttaaaataatactagtaaaggttcaaattctgttgcgggaagtcagggaccctgaatggagggacaagctggagctgcggcagaggaacataaattgtgaagatttcattttaatatggacatttatcaattcccaaataatacttttataatttcttacacctgtctttaatctcttaatcctgttatcttcataagctgaggatgtatgtcacctcaggaccactgtgataattgtgttaactgtacaaattgattgtaaaatgtgtgtgtttgaacaatatgaagtcagtgcacctagaaaaagaactaaataacagtgatttttagggaacaagggaagacaaccataa

SEQ ID NO: 463626 - DNA, 7134 bp, Homo sapiens
ccaggattgttacaacattgaagatatggtttacaggcttctagggcatgtcttcccttcaactcacactgaaaatgaactaaaagagaaaaagtttccaccggatgatgaatttgtggaggcagcttcaaaattgactgatgaaattataaaagaaatttctgaacatgagattcgactttccatggcagaggataatgcagaaagtatgcagttagaacctattgaaaatttggtcgactccatatgtaataatattttgaaaacatctgaattccaagctgaagtacaaaaagatgcagacaaaaaaggatgctcattcctcagtaaattagctggttttattatgaaagaaatcatgtatcatcatttacagccatttttacatggtgaagaatcatctttcagtgacttatctgattatgaccatgtctctgaacttgctaaatctggtaaagaaaagacacagccttctctctattcagctacatttttggaagacataatcattgaccttgttcacaaattttgttctctcctcattattactgaagattctaagaaaaatgaaatggcagagctagatattatgggcttggctctaaaacttgcaaattctctgataagggaatttaagaaaagtgatattaaagttttaccaaatgctgaaaaaatgttttcttttccaccaattgataaagagacagttgataaaatatccaattttgtatatgaacagttcatagaaaaatgcacatctcatgatattcaaaaaggtgatgaaagtaacattgctatagggatgattgctgctctaacccagaaggcaatatctgcattcaggattcaaccacttttttcaggagactggtcttccaccttcttttcatttctaaatccagataatatcacccaaagggttcaacacctaccacaaaacacctttacacaaataagcagatgtgcaaaagagaaccaactttctttaccagatcaatcatataaagatacttcttccaccccagattgcaaaaacatgatgagcactttggaaataaatagaggtacaatgaatagaaagaaaagttttaaaaccaaggacacatcagtgaaaaaaggtgacatccaaaatccagtacttagctctataaatgcaattatgaaaagcggcatgattaacctaacatcagggttggctacaggtgtgacaaataaaaaggaagtggatgaaaataaagtgggaatttgtactcaaaaacatagtgagaatgtatcaaaagttacttcaactaccactgtgaaaagtaaagatactcaggagccaaatttgagtgaaacatttaataataatgaaattgagaagaaaagaaatttaattccaacagataaaaaagggaaagatgatgagatatacacacatttttcattaataattgatgatacagaatatgagaaggaagtacttggatcagattctgaaataggctataaaaagaagattgacaatgcaagggaaagctcatttaaaaaagatgacaagctctttcagttatcctccttgaagtccaagagaaatctagggactacaacagatactttggaaataagaattcgaacatcaagcaatgaggggagaagagactctccaacacaaacgtgtagggatgaggaacaccactcagattatgaacatgttcaaaatgtcattgaaaatatttttgaagatgttttagaactatcttcttctccagaaccagcatattattcgaaactcagttatgaccaaagccccccaggtgataatgtattaaatgtaattcaagagattagcagggattcggcacagtctgttacaacaaaaaaagtatcctcctcaactaacaaaaatatctctgccaaagaaaaagaagaggaagagagagaaaaagagaaagtaagagaggagattaaaagtgaacccagtaaaccagatgatcctcaaaaccaacgagaaagtaaacctggaatttttcccgctaagtttttagaagatgttattactgagatggttaaacaattgatcttttcttctataccagaaacacaaatacaagatagatgtcaaaatgttagtgataagcaaaatcaagccaaactctatgacactgctatgaaactcatcaattcactgttaaaggagttctcagatgctcaaattaaggttttcaggccagataagggaaatcagttccctgggggtaaagtgtcttcagttcctaaagtacctccaaggtataaagagccaactacagatgaagcaccatccagcattaagataaaatctgcagataaaatgccacctatgcataaaatgatgagaaaaccttcttcagataagataccatcaattgacaaaacattggtcaataaagttgttcactcctctgtttgtaatattttaaatgactatggatctcaagactctatttggaagaatataaacagtaatggagaaaatttagcaagaagactaactagtgcagtgataaatgaaattttccaacgtcaggttaacttgatattttgtgatgaggtttcagtttcagcatgtttgcctctggaatctaaggatgttgttaaaaaggtccaaaagttggcccaaacagccagcaaagaatgtcaaacttcatcaccatatacaataatattacctcataaatttttggagaatgtgatttctgctcttttctccaaaattttctcaacaatatccagcacaaaaacaaaagaacctgaggacaatttgtccacagaactgaatttccttcaaatgaagttagtaagtgcagttgcaacagagatctcccaagataaatatatgactatacagtatgtagaaaccttacaatctgatgatgatgaaattattcaattagtggttcagtctgtttataataatctcttgccacagtttggatcacaagagattatacaaaattgtgtaaccagtggatgcaaaatcctttcagaaaacatagttgacttggttctacgagaagtggctagcaatcagctgcagagctatttttgtggagagctaactccacatcagtgtgtggaagttgaaaacatcgttgaaaagatccttaaagatgttttccaaactactgatgtgcccctacctaaaccttcacatgctgataagctgtcttataacataatagaagaaattgctgtgaaatttttatcaaagcttttatctatatttccaaaagtacataaagaaagaacaaaatctctagagactgatatgcaaaaaataacttcaaaagtactaaattcagtccaagaatttatctccaaaagctttttaatggtgaatgcaatttcgaattctgaatttcaacctcaagtagaggaagaagtatcaaattcagaattagttctggaagctgtcaaaattatggaaaaagtgatcaaaattattgatgaacttaagtctaaggaaaagtcttcatccagaaaaggtttgacattagatgccaaacttttagaagaggtgttggccttgttcttggctaaactaataaggttgccaagttcctcaagcaaagatgaaaaaaacttatcaaagactgagttaaataaaattgcatctcaactgtcaaaattggtaacagctgaaatttccagaagtagcattagtctaatagcttctgatcctgaagagcactgtttaaatccagaaaatacagaaaggatttatcaggttgtcgattccgtttatagtaacatactgcaacaatcaggaaccaacaaagaattttattatgatataaaagatacaaatacagcctttcctaaaaaagtggctagtttaattattgatggagtttcaagttttccattagatacaattaactcaacaatttcaaatgctgatctctctggagagctagacgttaatagaattgttcaaaaggcccaagaacatgcttttaatgtgattcctgaattagagcaagaaaagttagatcaaaatttatctgaagaggaatctccaattaaaatagttccacatgttggaaaaaaaccagtcaaaatagatccaaaaattatttcagaacacttagcagttatttctataaaaactcaacctcttgagaaacttaagcaggagtgtttgaaaagaactggacatagcatagcagaactgagaagagcatcaataagtgggagaaattactccttaggatcacctgatttagaaaagagaaagacagaaagttctcaggaacaaaagccagagcatggaaacagtgttaagtttatcaccatctttgaaagatccaaggatgttcttggcagtgcaaatccctcaaaggaagtcatttcagaaactcccaagcccgatgtctccaaacaaggatctaaaatgctgacaaaaatgtcttcagctttgtcaaaggtgttttctcaatgtaacaccaatatttccagatcttcctcaccagctcaccaggatgaacactgaagcttttgtacctgatataagtatgcttacttcttttagaaaataaaatggtttttaaagcatagtatagcgtcttataagatgattcctatactactgaaaataaaagcaaaaggaagtgtagaagggaccaggcaaagaagggtttaacaaatgctttgaataagcattttgatgtaagaaatgttaataattagtattacctgtgtgccatgagagtaagtgactaaacacataattattaaactagacaactcacagtacccaccagaaaatgcacattgattgctcctgctaaattttagaggatgttgttaccaggacagttattaaattgagatgaaaaccaagctgaaaatgaaactatgtcacggataagtttattgttaaaggcatatttagatactcgaataaaaggatttataacagataaatttttcccacctgaaagtaaagttaatttagtttatgtctcccaggcaaaatgatccaactgtagacaaagcaccatttgaaagtaaatgataactatatataattccatatatgcataaaatggcccctgtgataaaaaaaatccttgcaagtaacgtacctcttatggataaaatatcaatcaagaaatcattggtcaataaagttattaaataattttcagaaatattatacacgaatatagagatcaagatccatttgtaaaaacaaaagtaatgggaaaaatttaataatatggctagctagtgcagtgataaaagaaatttttcaaaattagctgaacttgctactttgtgataaagttccaatgtcagcatgtttgcctctggaatccaaggatgttttataaagagattcaacagatggaccaagaagctgggaaggaatgtcaaatatcatcacccaaaaagggtgactcatgaatttttagagaatgtgtattctgttttatctaaaattttcttgacaattgccactaataaagcagaaacttctgaaaaagttttgttttaaaacaacaaacttcctttaatgaagttgatctgtgcagtaatgacagggaagaaaaaagtgattacctagtcaaatttttacatataaataataaaattatttaactggcaatttagtctacttataataatctcttaaaaacagattaatcccaaagatcatacaaaattgccgaacttgtggatgcagaccttttaaaaaatgatggttggtgagaaatagctggaaattcatctctgaattattttcaaaagagctgactctacatcagtttgcattagttgacagtgttgttgaaagcattcttacagatgtcatccaaaccaatgatgtttcccaaacttagatattacgtgcttataagctgtctttcaacgtaacatttcactgtaaaaatttaaagcactgtgattcacatacttatcaactgaaaaatgtaatatataaacataagatactctgaattaagagggtttttaatggtgaaggaaatttcctgttttctctgactcaagtagaggaagcaacatcaagttcagaattagtccttgaagttgacaacattttagtaaggaatggttaatgttattgagaaatttaagtcctaggaaaaaccatccagaaatacttctgtgttagacatcatgtatgtgaaacatcatctttattttcaacaaaactagtagggtaaatgtgctaaaagtatcaaacactgaattgaaaaaatgtgtattattacctgataaaacctgtagtggctaaaatctctaaaagtaacattagtcttctagctaatgactaatgctaaagcagaagaaagtttttaagattcataaaatttaaattattccttaggttgttgattctttctatgttttactaaaatggactggaaaacattttgtgtgaaaggctagaaagtagacattttaggtttgtagattctctgtcaaatctactccattatgctattgtagcacaaaaccaaccatatacaacacataaacaaataaatagatgtggatgtgattcaataaaaatttctttataaacactgaaatttgaatttcatttaatgttacatgtcataacatagaatttttcttttgatttttttcaataatttgaaaatataaaaattattcttaggtttattaaagacaagtgacaggacagatttagcccatgctgatttctgtactataataatttggaactcatgaataagcttatttttatatgaaggtactgattattgacttaaaataatactagtaaaggttcaaattctgttgcgggaagtcagggaccctgaatggagggacaagctggagctgcggcagaggaacataaattgtgaagatttcattttaatatggacatttatcaattcccaaataatacttttataatttcttacacctgtctttaatctcttaatcctgttatcttcataagctgaggatgtatgtcacctcaggaccactgtgataattgtgttaactgtacaaattgattgtaaaatgtgtgtgtttgaacaatatgaagtcagtgcacctagaaaaagaactaaataacagtgatttttagggaacaagggaagacaaccataa

SEQ ID NO: 463627 - DNA, 990 bp, Homo sapiens
tgatatatccaccttctccctgtcattgaaaattgttatgattttgttgccagccttcacacagatggcatttctcagtgccagccacctggaggaaagagtcccctggtcccggggctgggcatttccgctggttgcactgtcgaggggggagaggcagtggctggtcacttcgagcctgtgggcttgcggcccctactccctgttttcccccagccctgcccctacccaggtgaatgttcttgtccaggtaggcgcgaaggcccgacccttgcggagggaaagcctctgcagcgcctcctcgccacctgggcccgagactcccggtgctggcgtggcaggggtgcccccgccgggacgggacagctgggacccgcgcagccgagccggggcagccacgtggcggcggggcggggaccgggcgggccgggcgctgggagctggctgtcccaggagcagagcagtctccctgtccagatcaccaggatccctgcttgctggagaatgacccagatgtcccaggtgcaggagctcttccatgaggcagcccagcagtgtgcagcacctcccaggacctcttgctcctgctctggtgacataagatgcctgcctcgcctttgccttccaccatgattgaaagtttcctgaggcctccctggaagcagaagctgctatgcttcccgtacagcctgtggaaccataagccaattaaacctcttttctttataaattacccagtctcaagtatttctttatagcaatgcacttggaattccttctccaactgtgagaaacttgactcttattcaatatattttgttatttgcttataattcacagaaagcagatttagaattggtaattcatactcctacaaatacccaaattttctatctggcatttaatattaattgcagttatttttgttttcgaatgtgatacatagtcaaagtactgtgttcataagttactctggttagttctttttcc

SEQ ID NO: 463628 - DNA, 3720 bp, Homo sapiens
caatacagacttcaaaaaaccagagcttttgctggggatatgtgctccttccaaaggcaattgattgtgtgcaatattctgagaattaattcctccaaaggtggatattgagggagaaacagaaaaatccaagacaatcccctgtggaagaaaattctccaacccaaatctcaaccgaactcacagcgctgaacagcgcatcaattaagacctgtcaaatataatcacactatctaatagttttaaatatgcaaaataaagagcaccaaagtcaatgtaattcagaaataacaacaacaaaaccagagcaccccgatgcaattaggccacaaggaattccaaagtagtgtattaggtatagaaaatatatatgtaattagaaatgtttacagagattagagagattttttaaaaaaagatttggcctctaagacagttaacaattccagtaaagaagaaaagagaaattcaatgtttgatatacatacataaaaataaatttcaggaaaatgaaaagtccatgtgatgacagaatccaaattatataaaagatagaaatctcaatatttgtttttacacattttaaggaaaaaacaaccccgaaagcataaaatgcagaaaataatgttaataattcttgagttttcaagtccctctcactgactttggcacttagagaacagccagcacaggctcaggatcacctaatggtcatttctgccaaggagaccaaactcatgaaaatggagcagaaagctatgcgcacaagatggatggatgctcctctcccagagaccagcaggttcagaacgcagctccgccctcgcggtgcccccgacccgcccaggtctgtgctgagaagaacattgctccgccttcactgtatctccaaagtctgtgctgaggagaacgcagctccgccctcgcaaaggccccccagcgccggcgcaggcgcggagaggcgcacccgaacccgaatcctaaccctaacgcctaaggcactccagctgcaggtccacgcccgctcccccaagcggggaaggcgcttcgcgctgccgccggctggggactgggcaccgccctcccgcggctccggagccggctgccaccagggggcgcgcccgcggtgtccgggagcctggcggcgcgtctgcagctgccagtgcacctgctcctgctctcaccgctgtctctgccaggaacccgacgcccagccggaccctgccctccagcggggctgcggctccacggcctgcgacagcagccccaccccgcattcggcgcgctcccgggggcagaggtcgcgtccctccctggcggctgcggagccgtccgaggacaggggccataaactctccagagcgggaagccgcacgctggtggcccggccccgcgcacagacctggcggcagctggcacctgacccgctgcatgggtctccagggagctcgctgcccacccggcgctgcagcctcggctccctcgtacgcgctctggtaggtgctagggacgaccctatgggccagcttgccatgccaagtccccaggccgcacccaccgtggctccgtgggctaggggactggctcctcctgtggatatcaggcctcaagaggatggcagtcaccaggtagacatctggcctcagatagacaccaaggtcccagatgtacagcaggccccaaccgaaccccagactcatgtggacatcaggccacaggtggacaatcaggccccaggcacacatcaggccttaagtggacacccaggccccaggctgatatccagctcccaggtgatcaccaagccccaggtctctggtgaacatcaggtgcaggtgtccaagcaggccctgggtggacataactgtgtacagatgcctctggccatttggcagaagccccccgcccaggtaccacaggacaggagtcaccaggtagacatcaggccccagatggagctaccaggccaggcctcaccagtgatcccaccagggccacatctgcacattgtccttgtccagctggagcctctggagctcattgagacacaggcacatgctgaggtcacctgcagtgcagaaatacagcgatttccagtgccagctgttgagccagtgccagcaccaggggcagattcccctccagggacagcgctggagctagaggaagctccagagccctcctgccgctgccctgggactgcccaggaccagcccagtgaggagctgcctgacttcatggcacctcctgtagagccaccggcctcagccctggagctgaaagtgtggctggagctagaggtggcagagaggggtggccagcacagctccagccagcagctcccacactgctcccagtcctgggcacacagagcagcagccctgctgctgaagggcctgctgctactgctgctggggctgtttgcctgcctgcaggaggcggacagggggtgagggggccagggggcatctccaaaggaagcttttaaactcagcagctgcaccccagaatctgtatgcctgcacctgcccaaggatttattcatagcttacctaagaatttcaaatttctaccataacactgaataaagtttgactttttgaaacttccatggcttctttcactccctaatattgtagatggtgtttttgaggcgatgttgaaaacctctgatagttgtgtgttttgttgtggttctttctgtgattaaattaccatatgatcaagtgatattgaaaacccttcaggctaggcaacaagagcaaaactctgtctaatatctatacatacattttgtatatatacatatatacatgtgtgtatatatatacataatatatttatacatatacatatatgtatatgtatattatatatgcatatacatatacatatacatatacatatacatatacatatacatatatatgtatatgtacatatatatctgtctaatatatatacacatatacatatatatgtatatgtgtatatatacatatacatatatatgtatatgtatatatgtatatatatgtgtatatgtgtatatatacatatacatatatgtgtgtatgtgtatatatatatacacatatatgtatacatatatgtatatatgtgtatatgtgtatatatacatatacatatacatatatgtgtatgtgtatatatacatatacatatacatatatgtgtatgtgtatatatacatatacatatatgtgtatatgtgtatatatacatatacatatatgtgtatatgtgtatatatacatatacatatatgtgtatatgtgtatatatacatatacatatacatatacatatatgtgcgtatgtgtatatatacatatacatatatgtgcgtatgtgtatatatacatatacatatatgtgcgtatgtgtatatatacatatacatatatgtgtgtatgtgtatatatactatacatatatgtgtatatgtgtatgtatagatacacatatacacatatattagaggttgtactgctgaaaacaagagctattaataaaaaaatttcaggaaacgtagtgtgattatttttaatagaagtggatattttaatacaggtctcttgttttttcttgtggaaataaatgacaagatggaatttctgggtgtttggtatctgaatatttaagtatagcaggtattgtcagtttttcaaaggcattttaccatcttacttgtccatc

SEQ ID NO: 463629 - DNA, 7234 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (8)..(8): n is a, c, g, or t
  misc_feature (10)..(10): n is a, c, g, or t
  misc_feature (14)..(15): n is a, c, g, or t
  misc_feature (17)..(17): n is a, c, g, or t
naanantntnatanntnggctctcgccaatggcaaatgtaattgatgatggctggtgccagaatggcagcacagctgttgggtctcagtgcccttttttaccttctgaacaagggaataatgaagagactatttcgtctgttgatgaactgaaaattcccaaagactgtgatcgttatgatgatctttgttcatatatgtcatggaagacacgaaaagatacacagtggcctgaaaacaatttagctgataaagatcaagtttcagttgcaacttcatttgacataactgatgaaaacatagctactaaaagaagtgaccattttgatgctgctcgttcatatgggcagtattggacacaggaagattcatctaagcaggcagaaacatatttaaccaagcttaagtcatctgcttctttgagtgaaaaatcttacaaccaggctgttggtcttggcaaaacacagtcagctttatttcagtgtgatataggcaatgaaccatttcttccctttgggaagataaagtctgttccttctcttgaccttgcagagaaggtaggatcttcagatgttatttatcatgtgaaagtattaacttcagaatctttggttttacaagatttaaagcagccaacctttgaagaagttgcagattactcaaactttaatttggagggcctgcaggggaaggttgagtctgacgtcattactctggatggcctaaatgaaaatgctgttgtatgcagtgaaagagttgctgaactacaaagaaagccaacaagagagtcggaatatcactcttcagatctcagaatgttgaggatgtctcctgacactgtgccaaaggctcctaaacatttaaaagcaggagacacttctaaaggaggcatagctaaagttactcaatccaacttgaagtcaggcatcactaccactcctgttgattcagacattggatctcatttatccttgtcccttgaggacctgtctcagttggctgtaagttctctagaaactactactggtcaacacactgatactctcaaccaaaagacattagcagatactcatctaactgaagagactctgaaagtcacagctattcctgaaccagctgaccagaagactgcaacaccaacagtactctctagttcccactcacatagggggaagcccagcattttctaccagcagggcttgccagacagtcatctaactgaagaggctttgaaagtttcagctgctcctggactagctgaccagacaactggcatgtcaactctaacctctacttcctactcacatagagagaagcctggtactttttaccaacaagagttaccagagagtaacttaaccgaagagcctttggaagtttcagctgctcctggcccagtggagcagaagacgggaatacctacagtatcctctacatcccactcacatgtagaggacctcctctttttctatcgacagaccttgccagatggtcatctaactgatcaggctctgaaagtctcagctgtgtctggaccagctgaccagaagactgggacagcaacagtactctctactccccactcacatagagagaagcctggtattttttaccaacaagagttcgcagacagtcatcaaactgaagagactcttactaaagtttcagccactcctggaccagctgaccagaagactgagataccagcagtacagtctagttcttactcacaaagagaaaagcctagtattttgtacccacaggacttagcagacagtcatctacctgaagagggtctgaaagtttcagctgttgctggaccagctgaccagaagactggcctaccaacagtaccctctagtgcatactcacacagagagaagctccttgttttctaccaacaggccttgctggacagccatctacccgaagaggctctgaaagtttcagctgtttctggaccagctgacggaaagactgggacaccagctgtaacctctacttcctctgcgtcctcttcacttggagaaaagcccagtgctttctatcagcagaccttacccaatagtcatctaactgaagaggctctgaaagtatcaattgttcctggaccaggtgatcagaagactgggataccctcagcaccatctagtttctactcacacagagagaagcccattattttttcccagcagaccctgccagactttcttttccctgaagaagctctgaaggtttcagctgtttctgtattggctgcccagaagactgggacaccaacagtgtcctctaattctcactcacatagcgagaaatctagtgttttctaccagcaagagttgccagacagtgatctacctagagaatctctgaaaatgtctgctattcctggactgactgaccagaagactgtcccaacaccaacagtaccttcaggttccttctcacatagagagaagcccagtattttctatcaacaggagtggccagatagttatgcaactgaaaaggctctgaaagtttcaactggccctggaccagctgaccagaagactgagataccagcagtacagtctagttcttacccacagagggagaagcctagtgttttgtacccacaggtgttatcagacagtcatctacctgaagagagtctgaaagtttcagccttccctggaccagctgaccagatgactgacacaccagcagtaccgtctactttctactcacaaagagagaagcctggtattttctaccaacagaccttgccagagagtcatctgcctaaagaggctctgaaaatttcagtagctcctggactagcagaccagaagactggcacaccaactgtaacctcaacttcctactcacaacatagagaaaagcccagcattttccaccagcaggccttgccaggtactcatatacctgaagaggctcagaaagtttcagctgttactggaccaggtaaccagaagacttggataccaagagtactttctaccttctactcacaaagagagaaacctggtattttctatcaacagaccttgccaggtagtcacatacctgaagaggcacagaaagtttcacctgttcttggaccagctgaccagaagactgggacaccaactccaacctctgcttcttactcacacacagagaagcctggtattttctaccaacaggtcttgccagataatcatccaactgaagaggctctgaaaatttcagttgcctctgaaccagttgaccagacaactggcacaccagctgtaacctctacttcctactcacaatatagagagaagcccagcattttctaccaacagtcgttgccaagtagtcatctaactgaagaggctaagaatgtttcagcggttcctggaccagctgaccagaagactgtgataccaattttaccctctactttctactcacacacagagaagcctggtgttttctaccaacaggtcttgccacatagtcatccaactgaagaggctctgaaaatttcagttgcctctgaaccagttgaccagacaactggcacaccaactgtaacctctacttcttactcacaacatacagagaagccgagtattttctaccaacagtcgttgccaggtagtcatctaactgaagaggctaagaacgtttcagcggttcctggaccaggtgaccggaagactgggataccaactttaccctctactttctactcacacacagagaagcctggtagtttctaccaacaggtcttgccacatagtcatctacctgaagaggctttggaagtttcagttgctcctggaccagttgaccagacgattggcacaccaactgtaacctccccttccagctcatttggagagaagcccattgttatctacaaacaggcctttccagagggtcatctacctgaagagtctctgaaagtttcagttgctcctggaccagttggccagacaactggcgcaccaactataacctctccttcctactcacaacatagagcaaagtctggcagtttctaccaactggcattgctaggtagtcaaatacctgaagaggctctcagagtttcttctgctcctggaccagctgaccagacaactggcataccaaccataacctctacttcctactcatttggagagaagccgattgttaactacaaacaggcctttccagatggtcatctacctgaagaggctctgaaagtttccattgtttctggacctactgaaaaaaagactgacataccagcaggacctttaggttccagtgcacttggagagaagcccattactttctaccggcaggctctgctagacagtcctctaaataaagaggttgtgaaagtttcagctgctcctggaccagctgaccagaagactgagacattaccagtacattctactagctactcaaatagggggaagcctgtcattttctaccagcagaccctatcagacagtcatttacctgaagaagctctgaaagttccacctgttcctggaccagatgcccagaagactgagacaccatcagtatcctctagtttatactcatatagagagaagcccattgtcttctaccaacaggccctgccagacagtgagctaactcaagaagctctgaaagtttcagctgttcctcaaccagctgaccagaagactgggttatctactgtaacttcctctttctattcacatacagagaagcctaatatttcttaccagcaagagttgccagatagtcatctaactgaagaggctctgaaagtttcaaatgttcctggaccagctgaccagaagactggggtatcaacagtaacctctacttcctactcacacagagagaagcccattgtttcctaccagcgagagttgccgcattttactgaagcaggtttgaaaattttaagagttcctggaccagctgaccagaagactggaataaacatcctgccctctaattcctacccacagagagagcactctgtcatttcttatgagcaggagttgccagatcttactgaagtaactttgaaagcaataggggttcctgggcctgctgaccagaagactgggatacaaatagcatcctctagttcctactcaaatagagagaaggccagtatttttcatcagcaggagttgccagatgttactgaagaagctttaaatgtttttgttgttcctggacaaggtgaccggaagactgagataccaacagtacctttaagttactactcacgtagagagaagcccagtgttatctctcaacaggagttgccagacagtcatctcacagaagaggctctgaaagtttcacctgtttctataccagcagagcagaagactgggataccaataggactgtctagttcctactcacattcacataaagagaaactcaagatttcaactgtgcatataccagatgaccagaaaactgagtttccagcagctacccttagttcctactcacaaatagagaagcccaagatttcaactgtgattggaccaaatgaccagaagactccatcccagacagcttttcatagttcctattctcaaacagtaaagcccaatattttatttcaacagcagttgccagatagagatcaaagtaaaggtattctaaagatttcagctgtccctgaactaactgatgtgaatactggaaaaccagtatctctctctagttcttattttcacagagagaaatcgaatattttcagtccacaggaattgccaggtagtcatgtaactgaagatgtgctgaaggtttcaacaattcctggaccagctggccagaaaacagtattaccaacagctcttcctagttccttttcacatcgagagaaaccagatattttctatcaaaaggatttgccagatagacatctaactgaagatgctctaaagatctcaagtgctcttgggcaagctgatcaaattaccggattacaaacagttccctctggtacttactcacatggtgagaatcacaagcttgtttcagaacatgtccaaaggctaatagataatttgaattcttctgactccagtgttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatggtaagaagaaagtttcaggcttataaacgttatagtttaataatgtgtttaaagttagatatttatgttttgaggaagcttagccaatgaaaaatacaagcaagatcaagaaaaaaaatgaagttagatatttggagttctaaatgtattttccaatagaattgttagaatgactatatttcttctaacaatccataaaaagcctatttaaccaataatgtagttaagttacagtattaatagtaccagcctgagtttac

SEQ ID NO: 463630 - DNA, 968 bp, Homo sapiens
aactgccctcctggatttcagacttgtctggggatctttcctgacaagtattgttttgagtcacagatgatgtggaaggtgaaaactctggagcatccagatagtggcccaaaataccaaatgctgaaaacccagaatacccaagtaacagcctatgagtgtccccacaccaaatgccaggaaaccctggagtatccaggggctgaccagtgcagaaaatcctggagcctcagtggggtggccaacaatgagccccaaaggcctggcatgcgaaagttatgtggagctgatagagtcgactgtgtgtaccccgcttgcatcacagctcaggaacccggaaaagcagacactctgggttttatatcctggggtaatgagacgcacagggctaacgtgcttaagaacattccattctatgagaaactggaatacagcacagctctgagatactcaggccctatcagtttcctacagcaagtaaggagttgccattcaaaagaggcacaaatgatggctgcttcaggaaacatttgtctccaaaatctaagtctggtgcacccagtgacaattttacattgccacagactccagtcagcatgcctagaaatagtggacacctggatttacatagaacaagcaggctctaaaggtcttaaagaaatgccttggacatgtatagttgaatagattccaaggctaccgttgcaaagggctccattcaaagttgtcaaatttgttcatgcttttgactaaggtgaccaaaaaaaaaaaaaaaaaaaaaaaaaaaaaaaagactcagggggacagtgcagctacgtaagaatccagtggctttcccgagcttatttgtcttgcatttttggtgacatggattgttgttcatatcggcttcctctggcaggtccacctggaaagcattatatttagcaagaataaaggaggctgtgaatgatgtcactgcggactgc

SEQ ID NO: 463631 - DNA, 432 bp, Homo sapiens
acgggtttgcagaccactgaaataaaataaaggggcgttgagggagagaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463632 - DNA, 434 bp, Homo sapiens
aagatcagtaatggaggtcgacttcacacaaacaaaaaaaccttggagggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463633 - DNA, 436 bp, Homo sapiens
  misc_feature (50)..(50): n is a, c, g, or t
ctgcgccctccgtgatacccccccacacaatcgaacaagcggaaaccttnggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463634 - DNA, 450 bp, Homo sapiens
aagggacactcttttcttagcaccgaagaaacaggttctgttgttaaacttaattcctgagccttgaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463635 - DNA, 447 bp, Homo sapiens
ggactccagcgttagagaagaattgcgctggtcaggtgggggacagggccgggggttctggcgaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463636 - DNA, 449 bp, Homo sapiens
agggtgtcccttgctccacacgcggcaccggtctttggaaactacattctgagcttcagaggacgaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463637 - DNA, 456 bp, Homo sapiens
  misc_feature (38)..(38): n is a, c, g, or t
acacgccccccaacgccgagccaaccgtcggaatggcngaacaccttgtgcgaaactaattctgagctttagaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463638 - DNA, 445 bp, Homo sapiens
  misc_feature (60)..(60): n is a, c, g, or t
gcaagttgcaactttaacacacaaaaaaagggtgtattgttaaccttaattctgagctgngaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463639 - DNA, 436 bp, Homo sapiens
ttatctattagcacttactacgcgcccccgcccgttctcttctaggtaaccgaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463640 - DNA, 435 bp, Homo sapiens
tttttttttttatacctcccccaccccccccacaacccgtcccggctttagaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463641 - DNA, 434 bp, Homo sapiens
aggaactatcgaattgcgtgcgcctatcagatgagcttggctttctggggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463642 - DNA, 440 bp, Homo sapiens
  misc_feature (12)..(12): n is a, c, g, or t
cccccccccttngggggttatgtgtaatctcctattttgtctgcacataaatagagaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463643 - DNA, 431 bp, Homo sapiens
cgaacctcttagcattccctgcccaccccacagcagcccctcaagggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463644 - DNA, 545 bp, Homo sapiens
gtgcatatgagataaaattaacattcaatttttgactgatgaatgcttaatagttacaataatttttttcggcaaaagatctgttagtgaataaaggctttaaaaatagaacaaagtaaatatgagatatactcatgtttctcttttcttttcaggaaacgaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463645 - DNA, 427 bp, Homo sapiens
tttacagacctgtttgtatccatcagaaaggaacgcttcggggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463646 - DNA, 419 bp, Homo sapiens
tcgtagggactcttatagagaccaaggtcctcgggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463647 - DNA, 417 bp, Homo sapiens
cgcatactgctgagcaagcaacggcggtttgggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463648 - DNA, 425 bp, Homo sapiens
ttactttttttgatcgtatcttcaccaccaccgccttcaggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463649 - DNA, 942 bp, Homo sapiens
agcacctggttagcgcttaatgaatggtagctgtaattgtgtcaattttcattacccaggaatatgaggggggtcggaatgaggcaggcgaaaggcacggacgtgggagggcacggctacccaacggggacacctacgaagggagctacgaattcggtaaaagacatggccaggggatctacaaatttaaaaatggtgctcgatatatcggagaatatgttagaaataaaaagcacggtcaaggcacttttatatatccagatggatccagatatgaaggagagtgggcaaatgacctgcggcacggccatggcgtatactactacatcaataatgacacctacactggagagtggtttgctcatcaaaggcatgggcaaggcacctatttatacgcggagacgggcagtaagtatgttggcacctgggtgaacggacagcaggagggcacggccgagctcattcacctgaaccacaggtaccagggcaagttcttgaacaaaaatcctgttggccctggaaagtatgtatttgatgttgggtgtgaacaacatggtgaatatcgtttaacagatatggtcctgcaagtgaaaactgaatctgtaactggtgttgccacagtttgtccagtgactgttagcttgtccgttgtgcagcatgctcctctgaacgtgccgttgctaaaaggaaccactggctaggggcaggtccctagaaaaccagaaaatgaaatggccaaaatgcttgattttgttgctaagtaagaggccctacctcctctgagcacgaattcttcatggaccgcagggtgctctagtctgggtggaaggcagcttcctggttactggtgattgagcaagtttttacatttgtgtagtgataaaaataaagcccatcttattaagtgctttgcagctttagactctactggaaaaagttcct

SEQ ID NO: 463650 - DNA, 456 bp, Homo sapiens
  misc_feature (443)..(444): n is a, c, g, or t
ttactttttttgatcgtatcttcaccaccaccgccttcaggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaaaaaacaaaaaaatggccnncctggcctcagc

SEQ ID NO: 463651 - DNA, 461 bp, Homo sapiens
acgggtttgcagaccactgaaataaaataaaggggcgttgagggagagaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaaaagaggcagctggcctcgttgggcctcat

SEQ ID NO: 463652 - DNA, 439 bp, Homo sapiens
gtgcatatgagataaaattaacattcaatttttgactgatgaatgcttaatagttacaataatttttttcggcaaaagatctgttagtgaataaaggctttaaaaatagaacaaagtaaatatgagatatactcatgtttctcttttcttttcaggaaacgaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccacttaagaattggtggaaaatattggagggaaatgtg

SEQ ID NO: 463653 - DNA, 1267 bp, Homo sapiens
agcacctggttagcgcttaatgaatggtagctgtaattgtgtcaattttcattacccaggaatatgaggggggtcggaatgaggcaggcgaaaggcacggacgtgggagggcacggctacccaacggggacacctacgaagggagctacgaattcggtaaaagacatggccaggggatctacaaatttaaaaatggtgctcgatatatcggagaatatgttagaaataaaaagcacggtcaaggcacttttatatatccagatggatccagatatgaaggagagtgggcaaatgacctgcggcacggccatggcgtatactactacatcaataatgacacctacactggagagtggtttgctcatcaaaggcatgggcaaggcacctatttatacgcggagacgggcagtaagtatgttggcacctgggtgaacggacagcaggagggcacggccgagctcattcacctgaaccacaggtaccagggcaagttcttgaacaaaaatcctgttggccctggaaagtatgtatttgatgttgggtgtgaacaacatggtgaatatcgtttaacagatatggaaagaggagaagaggaagaggaggaagaattagtaactgttgttccaaaatggaaagctacccaaatcactgaattggccctgtggacaccaactctccccaaaaagccgacctctacggatggacctggccaagacgctccaggagctgagagtgcaggagaacccggggaggaggcccaggctctgctggagggcttcgagggtgagatggacatgaggcctggagatgaagatgcagacgtcctccgggaagagagccgggagtatgaccaggaggagttccgctatgacatggatgagggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463654 - DNA, 1152 bp, Homo sapiens
gaccatgtcggacctgggctcggaggagttggaggaggagggagagaatgatattggggggatctacaaatttaaaaatggtgctcgatatatcggagaatatgttagaaataaaaagcacggtcaaggcacttttatatatccagatggatccagatatgaaggagagtgggcaaatgacctgcggcacggccatggcgtatactactacatcaataatgacacctacactggagagtggtttgctcatcaaaggcatgggcaaggcacctatttatacgcggagacgggcagtaagtatgttggcacctgggtgaacggacagcaggagggcacggccgagctcattcacctgaaccacaggtaccagggcaagttcttgaacaaaaatcctgttggccctggaaagtatgtatttgatgttgggtgtgaacaacatggtgaatatcgtttaacagatatggaaagaggagaagaggaagaggaggaagaattagtaactgttgttccaaaatggaaagctacccaaatcactgaattggccctgtggacaccaactctccccaaaaagccgacctctacggatggacctggccaagacgctccaggagctgagagtgcaggagaacccggggaggaggcccaggctctgctggagggcttcgagggtgagatggacatgaggcctggagatgaagatgcagacgtcctccgggaagagagccgggagtatgaccaggaggagttccgctatgacatggatgagggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463655 - DNA, 421 bp, Homo sapiens
tgtatagtaattttataacgcagctcgcccctcagggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463656 - DNA, 419 bp, Homo sapiens
gtaccatcttctagttttgaaaaatcggctttgggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463657 - DNA, 412 bp, Homo sapiens
  misc_feature (20)..(20): n is a, c, g, or t
gtctttggtaattccccccngattcttgaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463658 - DNA, 429 bp, Homo sapiens
agatgaaaggactaataaaacaagcgacagaagaaaggtcaagggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463659 - DNA, 437 bp, Homo sapiens
cgctcgcggagcactatgattccacacgggggcacacccacgcggcttttcggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463660 - DNA, 426 bp, Homo sapiens
  misc_feature (23)..(23): n is a, c, g, or t
  misc_feature (38)..(38): n is a, c, g, or t
gcgctgccttctctagaaagcanaaggaggccgcctcnagggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 463661 - DNA, 1298 bp, Homo sapiens
  misc_feature (1285)..(1286): n is a, c, g, or t
agcacctggttagcgcttaatgaatggtagctgtaattgtgtcaattttcattacccaggaatatgaggggggtcggaatgaggcaggcgaaaggcacggacgtgggagggcacggctacccaacggggacacctacgaagggagctacgaattcggtaaaagacatggccaggggatctacaaatttaaaaatggtgctcgatatatcggagaatatgttagaaataaaaagcacggtcaaggcacttttatatatccagatggatccagatatgaaggagagtgggcaaatgacctgcggcacggccatggcgtatactactacatcaataatgacacctacactggagagtggtttgctcatcaaaggcatgggcaaggcacctatttatacgcggagacgggcagtaagtatgttggcacctgggtgaacggacagcaggagggcacggccgagctcattcacctgaaccacaggtaccagggcaagttcttgaacaaaaatcctgttggccctggaaagtatgtatttgatgttgggtgtgaacaacatggtgaatatcgtttaacagatatggaaagaggagaagaggaagaggaggaagaattagtaactgttgttccaaaatggaaagctacccaaatcactgaattggccctgtggacaccaactctccccaaaaagccgacctctacggatggacctggccaagacgctccaggagctgagagtgcaggagaacccggggaggaggcccaggctctgctggagggcttcgagggtgagatggacatgaggcctggagatgaagatgcagacgtcctccgggaagagagccgggagtatgaccaggaggagttccgctatgacatggatgagggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaaaaaacaaaaaaatggccnncctggcctcagc

SEQ ID NO: 463662 - DNA, 566 bp, Homo sapiens
  misc_feature (515)..(515): n is a, c, g, or t
agcacctggttagcgcttaatgaatggtagctgtaattgtgtcaattttcattacccaggaatatgaggggggtcggaatgaggcaggcgaaaggcacggacgtgggagggcacggctacccaacggggacacctacgaagggagctacgaattcggtaaaagacatggccaggggatctacaaatttaaaaatggtgctcgatatatcggagaatatgttagaaataaaaagcacggtcaaggcacttttatatatccagatggatccagatatgaaggagagtgggcaaatgacctgcggcacggccatggcgtatactactacatcaataatgacacctacactggagagtggtttgctcatcaaaggcatgggcaaggcacctatttatacgcggagacgggcagtaagtatgttggcacctgggtgaacggacagcaggagggcacggccgagctcattcacctgaaccacaggtaccagggcaagttcttgaacaaaaatcctgttggncctggaaagtatgtatttgatgttggtaccgtcgacgtaagatcctctaga

SEQ ID NO: 463663 - DNA, 1712 bp, Homo sapiens
  misc_feature (1661)..(1661): n is a, c, g, or t
  misc_feature (1679)..(1679): n is a, c, g, or t
agcacctggttagcgcttaatgaatggtagctgtaattgtgtcaattttcattacccaggaatatgaggggggtcggaatgaggcaggcgaaaggcacggacgtgggagggcacggctacccaacggggacacctacgaagggagctacgaattcggtaaaagacatggccaggggatctacaaatttaaaaatggtgctcgatatatcggagaatatgttagaaataaaaagcacggtcaaggcacttttatatatccagatggatccagatatgaaggagagtgggcaaatgacctgcggcacggccatggcgtatactactacatcaataatgacacctacactggagagtggtttgctcatcaaaggcatgggcaaggcacctatttatacgcggagacgggcagtaagtatgttggcacctgggtgaacggacagcaggagggcacggccgagctcattcacctgaaccacaggtaccagggcaagttcttgaacaaaaatcctgttggccctggaaagtatgtatttgatgttgggtgtgaacaacatggtgaatatcgtttaacagatatggaaagaggagaagaggaagaggaggaagaattagtaactgttgttccaaaatggaaagctacccaaatcactgaattggccctgtggacaccaactctccccaaaaagccgacctctacggatggacctggccaagacgctccaggagctgagagtgcaggagaacccggggaggaggcccaggctctgctggagggcttcgagggtgagatggacatgaggcctggagatgaagatgcagacgtcctccgggaagagagccgggagtatgaccaggaggagttccgctatgacatggatgagggaaacattaattctgaagatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaaaaaaaaaagaaaatggacgtcgtggccctagtgggaggacctttggggccccttccctttatcatggggtaattcattgacctcttttcctcgcctaactacctccggcccttggtcgacgtgaaggctttaggtcacccaacccgggccacgctttgctgcgcataacgcgagtacttcccacgacacatcatcaatcctaatgctccctaaagggtgggaatataaaagggcctaattttgtgtccttctccctggttctccgtcgttgccacccctctcctttaccctcctccgcgactccgcgaaccccccacgttttattgaacgactcactccgccagaaagcaccgcgggaaggactcacgccccccctcggcgtccccgctccttnccatcctcagccgagttnatggatgcttatctccgcccccgggttcttgtt

SEQ ID NO: 463664 - DNA, 832 bp, Homo sapiens
tctaacctcatttattatgcttaaggctttttctcagctgacctgactttgctttaggtcattcttttttatgccagcactgtttgaaagtgcatgtcaagcggctagctccacatttggtcttcgaaagggaaacgcatgcagttaaaacgtaatgtacatgatggaattgggaggatcatagtctcagtttccccccctctttctcccatctaggagacctccgtggactgcagcaaaattaaaaataaagcacagacaacagaattattcttcactgagagagtttaatacgcgtttctaacaccatctatacttgctttgttgttcttgaggtcatcaacacacattctggttattccagagctagaagctcttctggttgctaactcagttataagaagatgaaagacataactagacttacgtatttcagtagtttgctctttaatttttcccttactcttagtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggt

SEQ ID NO: 463665 - DNA, 457 bp, Homo sapiens
cgactcagcaaagtgcatcgtgctgtcaagttcagcattgaaggcaacaggatgcccctataggcctggccctaccagagtgtatacacgagagtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggt

SEQ ID NO: 463666 - DNA, 601 bp, Homo sapiens
tggatcccccgggctgcaggcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggtctggtttttggggggctgtctcttcattt

SEQ ID NO: 463667 - DNA, 455 bp, Homo sapiens
tggggatgtaaggaaaattgagaaaataattcattcaataaagattttattgctgtttgctaagtgctagactccttgttgtgctctgagaatataaaaacaaattaaaaatagtctatgctctcaaaagtgtaagtctttacaaggatgataggcaaagggaggtctttggtaaagccatgggctaagtgtgccaggtctgtgtttggaatggcaagtagactgaaggggttggacagtagtatggggcctgaggtggtagaagataaggttggaaataatagaccggtgaagggctttgaatcaagatgaggaattttcacgtcttgtgattccacaggaagtttttgaggctggatgtgaagccatctggtttgatttgatttagggtgctgatgccaatggcatcatgtaggatggattggagggcagtgggactgaggcagtgatacagc

SEQ ID NO: 463668 - DNA, 2733 bp, Homo sapiens
cgccattttggccccagcggtgcttctaggaagtagaacgccggctcgcatgcctgcccgcccgccagcctgccggatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacaggttttaaccaagaagatctggaagaagaaaaaggtgaaacacaggtaaaagaagcagaagattcagattctgatgataacataaagagaggaaaacatatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggt

SEQ ID NO: 463669 - DNA, 2337 bp, Homo sapiens
cgccattttggccccagcggtgcttctaggaagtagaacgccggctcgcatgcctgcccgcccgccagcctgccgggtacggccttttccgccggggcttccaggtcaaagaattcgcctttgccgctaccgctttcttaccctccgcacccgttaagttctccggtcgggcggcagtctctgaacacttagccgcgccatccggggtcacaccgcctggaaggaggtgacgggggcggcgcggggcgcggacactccccgctgagagtccgcctgccatggactcggaatattacagcggcgaccagtcagatgatggtggtgctaccccagtacaggatgaacgggattcagggtcagacggtgaggatgatgtaaatgagcaacactccggatcagacactggaagtgtagaacgtcattcagagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacaggttttaaccaagaagatctggaagaagaaaaaggtgaaacacaggtaaaagaagcagaagattcagattctgatgataacataaagagaggaaaacatatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggt

SEQ ID NO: 463670 - DNA, 2022 bp, Homo sapiens
acagtatcaatagactttacgttacccaaagagattacgaattgatagggcctctttctatgtagtgtgtctgtagaaataattggacaagaaaaaaatacggttcttccccgtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacaggttttaaccaagaagatctggaagaagaaaaaggtgaaacacaggtaaaagaagcagaagattcagattctgatgataacataaagagaggaaaacatatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggt

SEQ ID NO: 463671 - DNA, 2915 bp, Homo sapiens
cgccattttggccccagcggtgcttctaggaagtagaacgccggctcgcatgcctgcccgcccgccagcctgccgggtacggccttttccgccggggcttccaggtcaaagaattcgcctttgccgctaccgctttcttaccctccgcacccgttaagttctccggtcgggcggcagtctctgaacacttagccgcgccatccggggtcacaccgcctggaaggaggtgacgggggcggcgcggggcgcggacactccccgctgagagtccgcctgccatggactcggaatattacagcggcgaccagtcagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacaggttttaaccaagaagatctggaagaagaaaaaggtgaaacacaggtaaaagaagcagaagattcagattctgatgataacataaagagaggaaaacatatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctgggtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggt

SEQ ID NO: 463672 - DNA, 3020 bp, Homo sapiens
  misc_feature (2971)..(2972): n is a, c, g, or t
  misc_feature (2991)..(2991): n is a, c, g, or t
  misc_feature (2995)..(2995): n is a, c, g, or t
cgccattttggccccagcggtgcttctaggaagtagaacgccggctcgcatgcctgcccgcccgccagcctgccgggtacggccttttccgccggggcttccaggtcaaagaattcgcctttgccgctaccgctttcttaccctccgcacccgttaagttctccggtcgggcggcagtctctgaacacttagccgcgccatccggggtcacaccgcctggaaggaggtgacgggggcggcgcggggcgcggacactccccgctgagagtccgcctgccatggactcggaatattacagcggcgaccagtcagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacaggttttaaccaagaagatctggaagaagaaaaaggtgaaacacaggtaaaagaagcagaagattcagattctgatgataacataaagagaggaaaacatatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggtcnngatgcggcaagcttttttnttcntcctccctatacgtaaatccctttc

SEQ ID NO: 463673 - DNA, 3120 bp, Homo sapiens
cgccattttggccccagcggtgcttctaggaagtagaacgccggctcgcatgcctgcccgcccgccagcctgccgggtacggccttttccgccggggcttccaggtcaaagaattcgcctttgccgctaccgctttcttaccctccgcacccgttaagttctccggtcgggcggcagtctctgaacacttagccgcgccatccggggtcacaccgcctggaaggaggtgacgggggcggcgcggggcgcggacactccccgctgagagtccgcctgccatggactcggaatattacagcggcgaccagtcagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacaggttttaaccaagaagatctggaagaagaaaaaggtgaaacacaggtaaaagaagcagaagattcagattctgatgataacataaagagaggaaaacatatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggctcttgaagtttgtctgattcagagaggactgttttctggtcgcttatctagccaaaccacaaattgagcaatagagaaaggaaaagtattacccaggattaaagtttattgctgatgaatttttcttcagtcttaattcaacattatcagtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggt

SEQ ID NO: 463674 - DNA, 3275 bp, Homo sapiens
cgccattttggccccagcggtgcttctaggaagtagaacgccggctcgcatgcctgcccgcccgccagcctgccgggtacggccttttccgccggggcttccaggtcaaagaattcgcctttgccgctaccgctttcttaccctccgcacccgttaagttctccggtcgggcggcagtctctgaacacttagccgcgccatccggggtcacaccgcctggaaggaggtgacgggggcggcgcggggcgcggacactccccgctgagagtccgcctgccatggactcggaatattacagcggcgaccagtcagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacaggttttaaccaagaagatctggaagaagaaaaaggtgaaacacaggtaaaagaagcagaagattcagattctgatgataacataaagagaggaaaacatatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccagggttttgctgttactgctcagtgtagtcacaccttgaataagaaatggaaaaccttgggatgttgataaagctaatatcctgaggaagaacttcagtgggtcccagctgagtaggagatgggattcaacagtactggtctaatgtgctggagtggcccaggcggaggcccacttgcagagactaatgggagcctcaagagaaaatctaccataagaaaaggaccagtctgatagcaagcccagcttcccaagaagatagaaggttggaggcaagctgctgtccaggtatgtcccaaaccagccaacttgaaggtaagtttgctccctggggagagaagggctctaggtgtgaactaaaagctgtgtccatagacactgtaacactggagttcaaaaaatgttgctgtggaacggcccttctcatccaaacccagacggaatgttctcacctgccaagagtagtgtcttgtattgaggcacagtggtagctttctggatccacaggcaaggccctgtggagtctcagaataatgataaatcctctggatgacctaggggctggtgaggtgagtggagcaccctactgtggtgtgtctgtaggaccactggagcctgatgctgccaaagcatgacctgaccagccctggcaactggtttaggatcatacaac

SEQ ID NO: 463675 - DNA, 791 bp, Homo sapiens
cgccattttggccccagcggtgcttctaggaagtagaacgccggctcgcatgcctgcccgcccgccagcctgccgggtacggccttttccgccggggcttccaggtcaaagaattcgcctttgccgctaccgctttcttaccctccgcacccgttaagttctccggtcgggcggcagtctctgaacacttagccgcgccatccggggtcacaccgcctggaaggaggtgacgggggcggcgcggggcgcggacactccccgctgagagtccgcctgccatggactcggaatattacagcggcgaccagtcagatgatggtggtgctaccccagtacaggatgaacgggattcagggtcagacggtgaggatgatgtaaatgagcaacactccggatcagacactggaagtgtagaacgtcattcagagtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggt

SEQ ID NO: 463676 - DNA, 882 bp, Homo sapiens
cgccattttggccccagcggtgcttctaggaagtagaacgccggctcgcatgcctgcccgcccgccagcctgccgggtacggccttttccgccggggcttccaggtcaaagaattcgcctttgccgctaccgctttcttaccctccgcacccgttaagttctccggtcgggcggcagtctctgaacacttagccgcgccatccggggtcacaccgcctggaaggaggtgacgggggcggcgcggggcgcggacactccccgctgagagtccgcctgccatggactcggaatattacagcggcgaccagtcagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgagacccctcagactcttgcatccagacggggatcctcagatc

SEQ ID NO: 463677 - DNA, 321 bp, Homo sapiens
aatagttatggtctaagtttgatttttagtttgctctttttctgagttattaggttctaatattcctggtatctccttgtttacttttttttcagcactggtggtcagacacccagaagagacctggaaaaggtgctgacaggagaggagaagtaaggttttaatgttaatttttcttcctagactatatagagaatttccgtttgctgctttaagaaaagtagtaaatgaaatgatgttatgctctcatttgtgggaggtgactttcattttaacgtttagtatctacaaagcattgtattgggtactctggggatgtaa

SEQ ID NO: 463678 - DNA, 599 bp, Homo sapiens
tttcactgtagatgtcattcatcttacaccataagttggtttttgttttgtttttaatcagatgatggtggtgctaccccagtacaggatgaacgggattcagggtcagacggtgaggatgatgtaaatgagcaacactccggatcagacactggaagtgtagaacgtcattcagaggtattggctaaccaacatctttgggagggcttttcccttgcgttctgtgagatctgttatattataggagttacagaatctctgtgacagagtttagggtttaatctctgagagtaaaggagcataagttaatagaaaaccgcttgaaaaataaatagggatggtctggttactgttgaaatcacagtgaaatatgttctgattgggtcacatttcaaatgttaggcagttttcaactgtgcatattgattcagaaaatgggcccggcctttgatatttgactaagtttccctattctgcaataatgtcatagtggggcattgagcatttgcaatctgaagaaacaccacttgaaatagaaagttatgggggttatcacctgtcaacatttatgtcagcatttgcccttctgattttgaact

SEQ ID NO: 463679 - DNA, 2969 bp, Homo sapiens
cgccattttggccccagcggtgcttctaggaagtagaacgccggctcgcatgcctgcccgcccgccagcctgccgggtacggccttttccgccggggcttccaggtcaaagaattcgcctttgccgctaccgctttcttaccctccgcacccgttaagttctccggtcgggcggcagtctctgaacacttagccgcgccatccggggtcacaccgcctggaaggaggtgacgggggcggcgcggggcgcggacactccccgctgagagtccgcctgccatggactcggaatattacagcggcgaccagtcagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacaggttttaaccaagaagatctggaagaagaaaaaggtgaaacacaggtaaaagaagcagaagattcagattctgatgataacataaagagaggaaaacatatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggt

SEQ ID NO: 463680 - DNA, 2007 bp, Homo sapiens
acttgttacccacatcacacaattcacctcttagcattttcttttttcaaagccgtacttcctaatgaattgtaagcttctcaaggaaaatgggaatttccagagagaaaccacttctcccctttcttctcttcccacgtcctcttcaggagcctataattgggctctgccagcatactctgactggctaacgaagggtcagatatctgcagtagtaacaaaaggctctttttctacatgtctacacctcctggggagtctttgcttaaacctctactggccctcctccgatccaaaggcaagaatgttcccctctctgtccaagactaaaatgaacaacgggaatttggaaggtctgtttggctttattaacaggctcagaataaaggggaaaggtctctggccttgtcacaggcaaacaagggggtcatctgcacgcgttttatctgagtcacatggagacgggtggttctttacagtgtgccgttccagaaacacaaatagatgagggggtttcttaatcaccgctgttttccaggaacacagggctcaggtaaagttcaacttcaccttcctccggtgtttcatcaggggaacccttctggaagcaaagacgtgtacttcttactgttggctaaatggcttcttaacaaggaaattaaatcgttgtttagaatgaaagagaggaagacgccgggagaggaggcgctgtggatcgcgccagttagtaacgcatcacagctcgcgggcgtcatactacaagtcccagtgagcaacgcccgctttcttgcctactgcgggcgggaaccaggcgcctctgggcctgacgggaaagacagtggtttggctgaatgacggaaaagtcatttgagcaggtcttcatttttcggaagagtatctcaaaagctcttcaaacaaggcacggacacagaatctaggaaatgataaagaatcaatgataacgttattaccacgggggtcagaccaggatccacccgaggaagatgatggtggtgctaccccagtacaggatgaacgggattcagggtcagacggtgaggatgatgtaaatgagcaacactccggatcagacactggaagtgtagaacgtcattcagaggtattggctaaccaacatctttgggagggcttttcccttgcgttctgtgagatctgttatattataggagttacagaatctctgtgacagagtttagggtttaatctctgagagtaaaggagcataagttaatagaaaaccgcttgaaaaataaatagggatggtctggttactgttgaaatcacagtgaaatatgttctgattgggtcacatttcaaatgttaggcagttttcaactgtgcatattgattcagaaaatgggcccggcctttgatatttgactaagtttccctattctgcaataatgtcatagtggggcattgagcatttgcaatctgaagaaacaccacttgaaatagaaagttatgggggttatcacctgtcaacatttatgtcagcatttgcccttctgattttgaactgtaaaagatacatttttacagaatagcctctgatcttaaggtcagtgtatcagataaatgtaaataaatgtgtaaatcacctttcagtgaagtgtgagcgtacaagatgccatggggatatgaagggagggaatggctaaccagctccgtctcttctttatgttattgctgccacaaattacatctttatatattgtgtacccactagcaaagatttatagttttttatgcttttctattttaagtcctgtaaaataataaggggagttacgaaccaaaattgcaataatactgatttttatatttgtctatgtgtttaccttgaaaggaaaaatgtatatttttatacatctttgagttactgtctagtgttgtttacttacaacctgaaggaagggactccttttaacgtttcttgcagggtaggtctagtggtaatgaattccttcagcttttgtttattta

SEQ ID NO: 463681 - DNA, 3661 bp, Homo sapiens
acttgttacccacatcacacaattcacctcttagcattttcttttttcaaagccgtacttcctaatgaattgtaagcttctcaaggaaaatgggaatttccagagagaaaccacttctcccctttcttctcttcccacgtcctcttcaggagcctataattgggctctgccagcatactctgactggctaacgaagggtcagatatctgcagtagtaacaaaaggctctttttctacatgtctacacctcctggggagtctttgcttaaacctctactggccctcctccgatccaaaggcaagaatgttcccctctctgtccaagactaaaatgaacaacgggaatttggaaggtctgtttggctttattaacaggctcagaataaaggggaaaggtctctggccttgtcacaggcaaacaagggggtcatctgcacgcgttttatctgagtcacatggagacgggtggttctttacagtgtgccgttccagaaacacaaatagatgagggggtttcttaatcaccgctgttttccaggaacacagggctcaggtaaagttcaacttcaccttcctccggtgtttcatcaggggaacccttctggaagcaaagacgtgtacttcttactgttggctaaatggcttcttaacaaggaaattaaatcgttgtttagaatgaaagagaggaagacgccgggagaggaggcgctgtggatcgcgccagttagtaacgcatcacagctcgcgggcgtcatactacaagtcccagtgagcaacgcccgctttcttgcctactgcgggcgggaaccaggcgcctctgggcctgacgggaaagacagtggtttggctgaatgacggaaaagtcatttgagcaggtcttcatttttcggaagagtatctcaaaagctcttcaaacaaggcacggacacagaatctaggaaatgataaagaatcaatgataacgttattaccacgggggtcagaccaggatccacccgaggaagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacaggttttaaccaagaagatctggaagaagaaaaaggtgaaacacaggtaaaagaagcagaagattcagattctgatgataacataaagagaggaaaacatatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggt

SEQ ID NO: 463682 - DNA, 2925 bp, Homo sapiens
cgccattttggccccagcggtgcttctaggaagtagaacgccggctcgcatgcctgcccgcccgccagcctgccgggtacggccttttccgccggggcttccaggtcaaagaattcgcctttgccgctaccgctttcttaccctccgcacccgttaagttctccggtcgggcggcagtctctgaacacttagccgcgccatccggggtcacaccgcctggaaggaggtgacgggggcggcgcggggcgcggacactccccgctgagagtccgcctgccatggactcggaatattacagcggcgaccagtcagatgatggtggtgctaccccagtacaggatgaacgggattcaggacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacaggttttaaccaagaagatctggaagaagaaaaaggtgaaacacaggtaaaagaagcagaagattcagattctgatgataacataaagagaggaaaacatatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggt

SEQ ID NO: 463683 - DNA, 1312 bp, Homo sapiens
gtcgtatttgcagtccgtcattgaccgaaacatcgttatgcggcgcatgactgtatttgcacttttaaaagaaggtagcacttcattgagttagaattaagaaatttggtgttcttaattgttgtgaaagtaaatgtgtatttaaaagacaacttgtatttcacttgcttttgtttactgctttagtatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggt

SEQ ID NO: 463684 - DNA, 2998 bp, Homo sapiens
cgccattttggccccagcggtgcttctaggaagtagaacgccggctcgcatgcctgcccgcccgccagcctgccgggtacggccttttccgccggggcttccaggtcaaagaattcgcctttgccgctaccgctttcttaccctccgcacccgttaagttctccggtcgggcggcagtctctgaacacttagccgcgccatccggggtcacaccgcctggaaggaggtgacgggggcggcgcggggcgcggacactccccgctgagagtccgcctgccatggactcggaatattacagcggcgaccagtcagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacaggttttaaccaagaagatctggaagaagaaaaaggtgaaacacaggtaaaagaagcagaagattcagattctgatgataacataaagagaggaaaacatatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggtctggtttttggggggctgtctcttcattt

SEQ ID NO: 463685 - DNA, 671 bp, Homo sapiens
taccagaatgaaattttattgtgtaaagtttatagaagtatgactagtattcctttgtacaaagtacacaacggttttaaatataactgagagaaatgtgagtcctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggt

SEQ ID NO: 463686 - DNA, 1811 bp, Homo sapiens
cgccattttggccccagcggtgcttctaggaagtagaacgccggctcgcatgcctgcccgcccgccagcctgccgggtacggccttttccgccggggcttccaggtcaaagaattcgcctttgccgctaccgctttcttaccctccgcacccgttaagttctccggtcgggcggcagtctctgaacacttagccgcgccatccggggtcacaccgcctggaaggaggtgacgggggcggcgcggggcgcggacactccccgctgagagtccgcctgccatggactcggaatattacagcggcgaccagtcagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacagtaagtataagatggaaatatttcctccttgattgtgcttttttttggtgtttttatggcagtgat

SEQ ID NO: 463687 - DNA, 1395 bp, Homo sapiens
ttttgtcaccaccagacctgcctttcaagagctcctgaaggaagcactaaatatggaaaggaaaaaactggtaccagccactgcaaaaacataccaaaatgtaaagagcattgacactgtgaagaagctgcatcaactaatcggcaaaataaccagctactctgcagctgaaatggagaaagcaggagctgacttatctttttcagatgcttggctgggaagaggagggaacaagataaaatatcccatgaatgaacgcttactacttacggtgtttgtgaaagatactgtggcttccaggcacaactctcagatcctatgtctttggatccttaccaagacaggactgtccacttacctccatgaggctgccatttctgaaagagacattggaactccattttggggatggccttcacagcttaccacctatttctctgaatattctcagcgctaccaaatctttatcattggagaccagtcttaacttctgagatgacccaaatatttggagccaagtttgttgattaagtaagttttcatcctcgacattcttttgcccaccttatgagaccaatgagtctactgaagatcctccaagtgccgaggaaataaagacattggaggatgcccttaatattttcagaaatgttaccactgtaaagagcacttccaaaatctccttttcacatattctctgtgaagttatgcaacacaaaggcttcaaagcaatctcccaagtttcccagaaaataaatacatctgatttgaaaaatcttacatcggcaagattgtgcaaatattattcatatgtctgaaagggcagcctattcagctattaaaaggtacagccttttaactgaaggtagtcttaaggctggacacagctttcatactgagctttcaattactttaagatgtcaccatagcatacagaggtgtttacatttacatatacaaatagatcagccatacaaatacctactaactttgcaaaatggctagtaaaaaaactcatttttaccacatgtatattgcccttgcttatgtgtgttaatgaaaaacatgtgtgcttgtaatgcacataggcagtaaagagcaatgatttttaatgcattagtattgctatcaattatgggtgccaatgaaatgcatgggactacaatgcatatgaactcttcaaatttccttttagcgaataatttttccctccacactttttagcagaagtaatcacattgactaccttaatttcatctttttacattgtttcccagatgggaaacttttgcacatcttactctcagattctcatgaacattcccatctagtctccttgattaaatgttgtgctgacctaaagagaatatgtttttagtggtatccaaaggcaac

SEQ ID NO: 463688 - DNA, 1065 bp, Homo sapiens
  misc_feature (2)..(2): n is a, c, g, or t
  misc_feature (5)..(5): n is a, c, g, or t
  misc_feature (8)..(9): n is a, c, g, or t
  misc_feature (12)..(12): n is a, c, g, or t
antcntcnngtnagtccctgaacaggagtgatgcctccaggcaggtggcatgctgcctatccagctcaggcccagtcttcgagggagcgagggcggcttcagacagtaaagaaggaagaagaggatgaaagctatactccagtgcaggctgccaggccacagactctcaaccgccctggccaggagctgttccgccagctcttcagacagcttcgctaccatgagtcttcagggcccctagaaactctgagccggctccgggaactctgtcgctggtggctgaggcctgacgttctctccaaggcacagatcctagagctgctggtgctggaacagttcctgagcatcctgcctggggagctccgggtttgggtgcagcttcataaccctgagagtggcgaggaggctgtggccttgctggaggagctgcagagggaccttgatgggacatcctggaggacttcattccacaacctcaacatctgtggccacatagttgtacctttcagagcctctgttcgttgagaagaaaatgcagaaatggtttaatcgtgagaatttgttcggtaaatattcaagtgcttatcatgtgcctggccctggcagagttggcagtcccaggcctggcaggagagcagcagctggtcagttcaagtgcgttcgttcttcctgcccttctcctgcacacaggggagctgatgcttcctgtattgttacagttttttaaaaaagcatttatcacttttttaaggcttctttatataaaaatacatgattctggccaggcgtggtggctcactcctgtagtgctagcactttgggaggccaaggcgggcagatcacttgaggtcaggagttcgagactagcctggccaacatggtgaaactccatttctactaaaagggcagaaattagccgggtgtggtggtgtgcacctgtagacccagctactcaggaggctgaggcaggagaattgcttgaacctggaaggtggaggctgcagtgagctgagatttcaccagtgcagtctagactgggcaacagaacaagtcgctgtgtaaaaa

SEQ ID NO: 463689 - DNA, 1186 bp, Homo sapiens
agaaagtacaaaaaaactggccattttttttaattgcttgtttttctttgtaattaacattcagtctactttctaaaaaataaataaataataagcagtccagatgtggcaagttgctaaagaaaggaaccatcaggccatagacgtaaatatattctcttcttggattttaggtctcacctaagaaaataaacacatgctatgtcagagaagcctcagggtttccacacctgctcgaaaagggagttgagcttcagcagctgacccaggactctgttcccctttggtgagaagggtttttgttcagcaagacaatggagagctctcactgtggtggacgttcggccaagggaccaaggtggaaatcaaacgtgagtagaatttaaactttgcttcctcagttgtctgtgtcttctgttccctgtgtctatgaagtgatctataaggtgactctgcaatcagcctctgatatccttcagggaaaagataaagataagtctgtagtcaaactcgagaattgattgcacattttctttgaagagcaagcaagattcagtcattgggtgagaataacttgtctaagtaatagcttcagaaatgtcctggggaacataacatgttctggacagagccttggtcaattgtcagaaagggagtttttgtataggagggaagttaagaggaaccattgtgtgtacacttttggccaggggaccaagctggagatcaaacgtaagtacttttttccactgattcttcactgttgctaattagtttactttgtgttcctttgtgtggattttcattagtcggatgccagggatctaacaaacttcattcccaggttaggtacagaggaggggaaattgttccacaggacgctagcttgtggctaatttttaagatttctaaatcaaaataacttcattgggggaaagaggcttgctgagctttcagggaggtttttgtaaagggaaaagttaagacgaatcactgtgattcactttcggccctgggaccaaagtggatatcaaacgtaagtacatctgtctcaattattcgtgagattttagtgccattgtatcatttgtgcaagttttgtgatattttggttgaataaacctggtgacccagaagtaaatagcaggacaccagaaaatgaacttaaaaagctgagcaaatagac

SEQ ID NO: 463690 - DNA, 538 bp, Homo sapiens
  misc_feature (465)..(465): n is a, c, g, or t
  misc_feature (515)..(515): n is a, c, g, or t
  misc_feature (519)..(519): n is a, c, g, or t
  misc_feature (524)..(524): n is a, c, g, or t
  misc_feature (538)..(538): n is a, c, g, or t
agaaagtacaaaaaaactggccattttttttaattgcttgtttttctttgtaattaacattcagtctactttctaaaaaataaataaataataagcagtccagatgtggcaagttgctaaagaaaggaaccatcaggccatagacgtaaatatattctcttcttggattttaggtctcacctaagaaaataaacacatgctatgtcagagaagcctcagggtttccacacctgctcgaaaagggagttgagcttcagcagctgacccaggactctgttcccctttggtgagaagggtttttgttcagcaagacaatggagagctctcactgtggtggacgttcggccaagggaccaaggtggaaatcaaacgtgagtagaatttaaactttgcttcctcagttgtctgtgtcttctgttccctgtgtctatgaagtgatctataaggtgatgctacatctagctntgtttcctcgagtgtcctctcatgctgttatcaaacaggggagggagatnagancgacncatcctcacaccan

SEQ ID NO: 463691 - DNA, 1072 bp, Homo sapiens
cttttattttcattctatgctatccgatgcctactgctatttcccttcatatttaacctccaacagctgcattttgctccctccagaccacctgattggagctcacgtgctcccacacagtacctccaaccagagagagtcgagtcccacagaaaggcttgatgttgctggagttcagtgttgtgcagatggcagtgacaaatgccatgggcacatgagatatgataaaaggtccctgaagaaggtggagaaccagttatcttatgaaattttccagagaagtcaaaaaacacctgcagccttactgtccccttggaaacaagatgaacatctacattttctagagtgggacaagaatctctgttcatatttatgtcccatgcatttgcacgtggccggacaaaggactttgcttctgccagcacatctgtcttcagatatgagaggaaacagacacaacctggaggcggcaaagaagcagctctttctcaagtgacctcctctatctccctacttcctggctaatggggcagccttgatccttgggaatccaggacagatatccactcgtgacaaactagctggaagaatgacaaccaatcaggttccaagcaccactggatgtgaaccacagaatttcctcctctccttgtggaatgtcagcttacgtctgacaaaaaatgtaaaactgagagagttacaatcttaaggaggagtcaagctaaagcagaaagaatcacctactctggactccagcatgactgctgagctcaaatatatatatagagagaaagaaccacaaacttgaagatggatatcagctacagactttcctgagtcagatcaatcttatcaatgtccatcacagatattttgtagaacggtggatcctggcagagtctcacagatgcttctgagacaacatttgctttcaaaaaatgaaccacacacatcctaaagatctcagccacttcccatgtttcattttatgttacagcaaacatcacaacaatcattcctacagatcaccactgcatgtgatcaataaaatagtttttgcaacaatggtact

SEQ ID NO: 463692 - DNA, 1855 bp, Homo sapiens
cttttattttcattctatgctatccgatgcctactgctatttcccttcatatttaacctccaacagctgcattttgctccctccagaccacctgattggagctcacgtgctcccacacagtacctccaaccagagagagtcgagtcccacagaaaggcttgatgttgctggagttcagtgttgtgcagatggcagtgacaaatgccatgggcacatgagatatgataaaaggtccctgaagaaggtggagaaccagttatcttatgaaattttccagagaagtcaaaaaacacctgcagccttactgtccccttggaaacaagatgaacatctacattttctagagtgggacaagaatctctgttcatatttatgtcccatgcatttgcacgtggccggacaaaggactttgcttctgccagcacatctgtcttcagatatgagaggaaacagacacaacctggaggcggcaaagaagcagctctttctcaagtgacctcctctatctccctacttcctggctaatggggcagccttgatccttgggaatccaggacagatatccactcgtgacaaactagctggaagaatgacaaccaatcaggttccaagcaccactggatgtgaaccacagaatttcctcctctccttgtggaatgtcagcttacgtctgacaaaaaatgtaaaactgagagagttacaatcttaaggaggagtcaagctaaagcagaaagaatcacctactctggactccagcatgactgctgagctcaaatatatatatagagagaaagaaccacaaacttgaagatggatatcagctacagactttcctgagtcaggtctcacctaagaaaataaacacatgctatgtcagagaagcctcagggtttccacacctgctcgaaaagggagttgagcttcagcagctgacccaggactctgttcccctttggtgagaagggtttttgttcagcaagacaatggagagctctcactgtggtggacgttcggccaagggaccaaggtggaaatcaaacgtgagtagaatttaaactttgcttcctcagttgtctgtgtcttctgttccctgtgtctatgaagtgatctataaggtgactctgcaatcagcctctgatatccttcagggaaaagataaagataagtctgtagtcaaactcgagaattgattgcacattttctttgaagagcaagcaagattcagtcattgggtgagaataacttgtctaagtaatagcttcagaaatgtcctggggaacataacatgttctggacagagccttggtcaattgtcagaaagggagtttttgtataggagggaagttaagaggaaccattgtgtgtacacttttggccaggggaccaagctggagatcaaacgtaagtacttttttccactgattcttcactgttgctaattagtttactttgtgttcctttgtgtggattttcattagtcggatgccagggatctaacaaacttcattcccaggttaggtacagaggaggggaaattgttccacaggacgctagcttgtggctaatttttaagatttctaaatcaaaataacttcattgggggaaagaggcttgctgagctttcagggaggtttttgtaaagggaaaagttaagacgaatcactgtgattcactttcggccctgggaccaaagtggatatcaaacgtaagtacatctgtctcaattattcgtgagattttagtgccattgtatcatttgtgcaagttttgtgatattttggttgaataaacctggtgacccagaagtaaatagcaggacaccagaaaatgaacttaaaaagctgagcaaatagac

SEQ ID NO: 463693 - DNA, 1460 bp, Homo sapiens
cgcacaagcgtttcaactgctggacccggccggtgtgaagtttcacacccaaaaggatgaagggcacccacctggcttaagagaacgactcccaggtaaagggccagacccaggaggtggaggttgcagtgagccgagatcgcgccattacacttcagcctgggcaacaagagcaaaaaactccgtcaaaaaaaaaaaaaagaagaagaagttgtggagctgtctgattcctgatcctgtccgttcaggctggggccgccctggtctttcaaacccagcagtgagcttggacagacccagaggtgtttactccagatcatgtctactgtgaaggaagcagcacaccggctgtccaaaagtgagatgagcctctatgcagtgctggatcttaagaagggcgcctcacctgaagacttcaaaaaatcctacagccattccgcattgcttccccaccctccttttgagtatcacctgggtaggaaactggccttgcggtatcatcccgacaagaatccagggaatgctcaagcagcagaaatattcaaagagatcaacgcagctcatgccatactgagcgactctaagaagcggaaaatttacgaccagcatggctcattgggaatatatctgtatgatcactttggtgaagaaggcgtcagatactattttattctgaatagttgttggttcaaggtacacaattctccaggtcctttaagaataaggaaagaagggtgaccttcctttccttatgacaaatgcttctgttgtctcattttctgggtgccaggaggattgagggagggaagcttgagcagtcatatagaaaactgctggactgaggccattctcgcctaccttttagacacttgtcatcctgtgtactctgctcacttgttgctgtttctgttgttgctgctgtttttgctgtggagcacttaaaccaccacctgagcaggatagtgggagaaaatatcagcagaatgtccagagtcagcctccaaggtcaggagccaaatgtgattttagaagcgaggaaaatagcgaagatgatttttaagagatgaagaaggatgaggtgctgacccagtgagggtgccttctgctgcccagtcccctggacacattgaagagaggagcaagtagccctgtcctgacattgaccctgatttgacccctcttcttataaggatctcaagaatctcttcagaagcactgatgacgttgatcccagtaaggacatcacctctacccttggtaccacaactctgtatggggttgcccagctactcttcctttcagttgcagtcccaattttactccgtcagaaagcagccctcccctccctccccttatgaggtctcaggcagtggtggcagatttttcctgaagagtctttttcctgtgtctgccttgttattggaaccaatgccagctggtaggatccctgagccccttgc

SEQ ID NO: 463694 - DNA, 1288 bp, Homo sapiens
cgcacaagcgtttcaactgctggacccggccggtgtgaagtttcacacccaaaaggatgaagggcacccacctggcttaagagaacgactcccaggtaaagggccagacccaggaggtggaggttgcagtgagccgagatcgcgccattacacttcagcctgggcaacaagagcaaaaaactccgtcaaaaaaaaaaaaaagaagaagaagttgtggagctgtctgattcctgatcctgtccgttcaggctggggccgccctggtctttcaaacccagcagtgagcttggacagacccagaggtgtttactccagatcatgtctactgtgaaggaagcagcacaccggctgtccaaaagtgagatgagcctctatgcagtgctggatcttaagaagggcgcctcacctgaagacttcaaaaaatcctacagccattccgcattgcttccccaccctccttttgagtatcacctgggtaggaaactggccttgcggtatcatcccgacaagaatccagggaatgctcaagcagcagaaatattcaaagagatcaacgcagctcatgccatactgagcgactctaagaagcggaaaatttacgaccagcatggctcattgggaatatatctgtatgatcactttggtgaagaaggcgtcagatactattttattctgaatagttgttggttcaagacacttgtcatcctgtgtactctgctcacttgttgctgtttctgttgttgctgctgtttttgctgtggagcacttaaaccaccacctgagcaggatagtgggagaaaatatcagcagaatgtccagagtcagcctccaaggtcaggagccaaatgtgattttagaagcgaggaaaatagcgaagatgatttttaagagatgaagaaggatgaggtgctgacccagtgagggtgccttctgctgcccagtcccctggacacattgaagagaggagcaagtagccctgtcctgacattgaccctgatttgacccctcttcttataaggatctcaagaatctcttcagaagcactgatgacgttgatcccagtaaggacatcacctctacccttggtaccacaactctgtatggggttgcccagctactcttcctttcagttgcagtcccaattttactccgtcagaaagcagccctcccctccctccccttatgaggtctcaggcagtggtggcagatttttcctgaagagtctttttcctgtgtctgccttgttattggaaccaatgccagctggtaggatccctgagccccttgc

SEQ ID NO: 463695 - DNA, 1227 bp, Homo sapiens
ggagtgtgcattgtcaactgcaaagggaagcaggactgcgggtgcagggcccagggtggcctcagagccaccttcactctctgctctgtgatgtgggagctggccctgcacaccacacctctgccttgcctgctcctctgtgagggctcggctcgcagaaactcctcccttgtggttttcactcccagaggcacaagtgtccctattcactggactggctgtgctgactgtccccaagtggggacagcagggcctggctcttccacagcactaccctcaggacagcccaggacccggcacctggcgagcattcggcggatgtactcaatcaatcaccgacgcatcttccaaagcctcctgcgagatggagacctcactgtgcacctcctttcatccgcccccgagtgccgtacaccctcctccgtgatgtccacaccagcttacaattctaccatcgactgggccttgggaagctctgggttctcaggctctgtcctgagccagcagtgatcttttacatgggttggaaaattaagtctcattgtacagttttccatttataatacagagatagaaatagtcaaccagttggcaaaactggaaatctgaacgacggactttataacaaacagctgagatcaggtgacaagcacacgctgttactgcctgtcctgcctgaagctgccactgccattcactgctttgctgcctgtttaggaatgtctgggaagatgctggggtgagtcaaggggaccggctgcctgcctgggctcagagggcctcagtttccccagtggaaggaaagatgggggaggcagcatggtacattttttacttaaatctttctcttaaagataaaagctgtcaagggttttaaaggggcctgcaggtgcccgtgtctgagctctgacaggtctatttttacacactcagcggatgcctgcctggctggcaatgctgctggggctcagaaaacaatgccccaaatgagggcctcagcagcagcctcagaagcaaagtttctctctgaccttctcctgccctcttgtctctcaggcccattcttccccaaggccagccacagaaactagaatccctcttccccaaggcaggacatagaaaccagtatccctttctcccaaagccagccataaaacatacaaatatcactctttccctctacttttctgtgtaaaaactagccataaagaaattatctggctgggc

SEQ ID NO: 463696 - DNA, 2333 bp, Homo sapiens
tggcattactcttcagttctcaccatttttacccttctgcaaagtctcttgtttttatttaatggtctctttggcttgccgtcacaatgaaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggcctttttttttttaattattagtggtagtaatatatagaatgtattacataactgtcactgaagtggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctatttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaaaagtcaactgtggcaccaattctaatgtaatccaacttgtgactgtttttttttgttttgttttgtttttgtgtgtgtgtgtgtggcactgggaaaagtggaaacaaacatgtattgaaatacatattggaaataaaaatggtttgagcgtcagtgatattctcccagaatgtacttatcttacctcggcatgtactgtagtcactcagtatttgtatatgttgctagaatttagattgtaaaatagtgaaattttaatgtgttcatttgtttttaatgtatatatgtcttgctcagattatttggtttaaataaaacaaccttgaggtttgtagcttttcctta

SEQ ID NO: 463697 - DNA, 4230 bp, Homo sapiens
tggcattactcttcagttctcaccatttttacccttctgcaaagtctcttgtttttatttaatggtctctttggcttgccgtcacaatgaaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggcctttttttttttaattattagtggtagtaatatatagaatgtattacataactgtcactgaagtggttggggaaaatgtggtgactgaggtacaggaaactactaatcttgccatctggctttaaggtgttatggtggcacagttacgtgctcgccgtgttaaatttcaaatgtccgtgttggatactactgtagaacactatttttaatacagaaaaagctccctataatgcacttcagagaaattaaaaatcacagagtatttattaccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttatccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttcctagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctatttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaaaagtcaactgtggcaccaattctaatgtaatccaacttgtgactgtttttttttgttttgttttgtttttgtgtgtgtgtgtgtggcactgggaaaagtggaaacaaacatgtattgaaatacatattggaaataaaaatggtttgagcgtcagtgatattctcccagaatgtacttatcttacctcggcatgtactgtagtcactcagtatttgtatatgttgctagaatttagattgtaaaatagtgaaattttaatgtgttcatttgtttttaatgtatatatgtcttgctcagattatttggtttaaataaaacaaccttgaggtttgtagcttttccttaaaaaaaaaaaaaaatttggggcggggccgaaagtttaaccatgtggggggccaggatgaagtcaagtccagagacgggaaggggggtccaaaaaggggggggggaaacagggtggttgtaagggaacagg

SEQ ID NO: 463698 - DNA, 1340 bp, Homo sapiens
gactagttctagatcgcgagcggcgcccttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctatttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaaaagtcaactgtggcaccaattctaatgtaatccaacttgtgactgtttttttttgttttgttttgtttttgtgtgtgtgtgtgtggcactgggaaaagtggaaacaaacatgtattgaaatacatattggaaataaaaatggtttgagcgtcagtgatattctcccagaatgtacttatcttacctcggcatgtactgtagtcactcagtatttgtatatgttgctagaatttagattgtaaaatagtgaaattttaatgtgttcatttgtttttaatgtatatatgtcttgctcagattatttggtttaaataaaacaaccttgaggtttgtagcttttcctta

SEQ ID NO: 463699 - DNA, 3940 bp, Homo sapiens
tggcattactcttcagttctcaccatttttacccttctgcaaagtctcttgtttttatttaatggtctctttggcttgccgtcacaatgaaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggcctttttttttttaattattagtggtagtaatatatagaatgtattacataactgtcactgaagtggttggggaaaatgtggtgactgaggtacaggaaactactaatcttgccatctggctttaaggtgttatggtggcacagttacgtgctcgccgtgttaaatttcaaatgtccgtgttggatactactgtagaacactatttttaatacagaaaaagctccctataatgcacttcagagaaattaaaaatcacagagtatttattaccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttatccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttcctagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctatttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaaaagtcaactgtggcaccaattctaatgtaatccaacttgtgactgttttttgtggtggctgcgcgtgtgtgtcgtgcctcgcgcaccacttggcaccccctgtttgcctccctctcggaacacaaccggcttcggcgcgccaaacaaaagggggctaaaaaccagggccttctccctttaagcca

SEQ ID NO: 463700 - DNA, 3412 bp, Homo sapiens
tggcattactcttcagttctcaccatttttacccttctgcaaagtctcttgtttttatttaatggtctctttggcttgccgtcacaatgaaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggcctttttttttttaattattagtggtagtaatatatagaatgtattacataactgtcactgaagtggttggggaaaatgtggtgactgaggtacaggaaactactaatcttgccatctggctttaaggtgttatggtggcacagttacgtgctcgccgtgttaaatttcaaatgtccgtgttggatactactgtagaacactatttttaatacagaaaaagctccctataatgcacttcagagaaattaaaaatcacagagtatttattaccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttatccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttcctagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctatttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaaaagatgaacagtatttggtttcttgtttccatgaattatatcagtattctaaaacatcgcttcagaaagagaactgtttatttctgcag

SEQ ID NO: 463701 - DNA, 4100 bp, Homo sapiens
tggcattactcttcagttctcaccatttttacccttctgcaaagtctcttgtttttatttaatggtctctttggcttgccgtcacaatgaaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggcctttttttttttaattattagtggtagtaatatatagaatgtattacataactgtcactgaagtggttggggaaaatgtggtgactgaggtacaggaaactactaatcttgccatctggctttaaggtgttatggtggcacagttacgtgctcgccgtgttaaatttcaaatgtccgtgttggatactactgtagaacactatttttaatacagaaaaagctccctataatgcacttcagagaaattaaaaatcacagagtatttattaccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttatccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttcctagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctatttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaaaagtcaactgtggcaccaattctaatgtaatccaacttgtgactgtttttttttgttttgttttgtttttgtgtgtgtgtgtgtggcactgggaaaagtggaaacaaacatgtattgaaatacatattggaaataaaaatggtttgagcgtcagtgatattctcccagaatgtacttatcttacctcggcatgtactgtagtcactcagtatttgtatatgttgctagaatttagattgtaaaatagtgaaattttaatgtgttcatttgtttttaatgtatatatgtcttgctcagattatttggtttaaataaaacaaccttgaggtttgtagcttttcctta

SEQ ID NO: 463702 - DNA, 4943 bp, Homo sapiens
tggcattactcttcagttctcaccatttttacccttctgcaaagtctcttgtttttatttaatggtctctttggcttgccgtcacaatgaaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggcctttttttttttaattattagtggtagtaatatatagaatgtattacataactgtcactgaagtggttggggaaaatgtggtgactgaggtacaggaaactactaatcttgccatctggctttaaggtgttatggtggcacagttacgtgctcgccgtgttaaatttcaaatgtccgtgttggatactactgtagaacactatttttaatacagaaaaagctccctataatgcacttcagagaaattaaaaatcacagagtatttattaccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttatccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttcctagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctatttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaaaagtcaactgtggcaccaattctaatgtaatccaacttgtgactgtttttttttgttttgttttgtttttgtgtgtgtgtgtgtggcactgggaaaagtggaaacaaacatgtattgaaatacatattggaaataaaaatggtttgagcgtcagtgatattctcccagaatgtacttatcttacctcggcatgtactgtagtcactcagtatttgtatatgttgctagaatttagattgtaaaatagtgaaattttaatgtgttcatttgtttttaatgtatatatgtcttgctcagattatttggtttaaataaaacaaccttgaggtttgtagcttttccttaaaaaaaaaaaaaaaaaaaaatcaaaaaaaaacttgtttgggccgacctggacccctcgaggaaaaaggtttctcaacaacacttggcgtggggggcgggggcacccagaatagggtttagggagaacggtgtggccaatggggttggtccccgaagagacaatcccgcgggccacgaggaccaaggggccttggttgcctcaccccaaattaaaaaatcggcgcccgggggggacacccgcggcgcagtttcttggacacaacactccacaagagtggaggctatggagcgggaccaataacgtggagcttcataacaaagcaaggggatgtcacaagcgacaggagcgctcgagaattcaaaaatttaaggcacccgaggagtaggtagacagagagctgactagacgacgcacagagaagaagctacatagcacagccacgagacaacgatgaaatagaatcgaacgaacgaaacacgagcaagactacgaaggcacggacgaagttaactcagagataaaatagaaggagagaagaagacagcgagaaagaaaagagaatacgcgagcgaccaacggaaacggaatagaagcagacacgtagagaagacaacgagcgaacagcaaacgagcgatacgaacaagcacaagaagcacgagagaagaaaatcagccagaggcagaggaacacagaccgagcgcgacagaggcaataacagcaagaagacagaagagaagaggaaaagcaatgagagcgacggaaagcagggagagaagaagaagagagagaaagcggacagaacaagaaagaagaggagaagaagaacaggaaggaagagact

SEQ ID NO: 463703 - DNA, 3907 bp, Homo sapiens
tggcattactcttcagttctcaccatttttacccttctgcaaagtctcttgtttttatttaatggtctctttggcttgccgtcacaatgaaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggcctttttttttttaattattagtggtagtaatatatagaatgtattacataactgtcactgaagtggttggggaaaatgtggtgactgaggtacaggaaactactaatcttgccatctggctttaaggtgttatggtggcacagttacgtgctcgccgtgttaaatttcaaatgtccgtgttggatactactgtagaacactatttttaatacagaaaaagctccctataatgcacttcagagaaattaaaaatcacagagtatttattaccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttatccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttcctagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctatttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaaaagtcaactgtggcaccaattctaatgtaatccaacttgtgactgtttttttttgttttgttttgtttttgtgtgtgtgtgtgtggcactgggaaaagtggaaacaaacatgtattgaaatacatattggaaataaaaatggtttgagcgtc

SEQ ID NO: 463704 - DNA, 3346 bp, Homo sapiens
tggcattactcttcagttctcaccatttttacccttctgcaaagtctcttgtttttatttaatggtctctttggcttgccgtcacaatgaaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggcctttttttttttaattattagtggtagtaatatatagaatgtattacataactgtcactgaagtggttggggaaaatgtggtgactgaggtacaggaaactactaatcttgccatctggctttaaggtgttatggtggcacagttacgtgctcgccgtgttaaatttcaaatgtccgtgttggatactactgtagaacactatttttaatacagaaaaagctccctataatgcacttcagagaaattaaaaatcacagagtatttattaccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttatccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttcctagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctatttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaatagccgggtcctctggtcagcct

SEQ ID NO: 463705 - DNA, 4808 bp, Homo sapiens
ttgggagtacggtaacggttgaagaactacctattgggtactatgcttattacctggtgttataccacagaaatgctgcgtatcaatggtgctacatataaatccctgaatttaaaactacgcgaagaagaagaagactgggaatgctttggggactgtgatacaggacacagatttgacacttgtaaaagagagcgaaatgaaatggaagaagagtggattagaaaagtccatcagatcctccgctggcctgatcagggtgtggaccttggccacatcagtcttatagagcttcttcatagtcagtttgatcttgtgcttgttggccttgacatcctcaatgagcacaactgtgttgttagcttcgctcttcatggcagaatcagtggtcagggggaacttgatgatggcatagtggtcatactggtttctcctggtgctcttctgagatatttgggctgctttggagcctcagtgtcctgggccaccagaaggctcaaggaactgaaacaaagggaatttgctcgaaatgtagcatctaaatccaggaaagatgaaagaaaacaggaaaaggcactccaacgcctgcacaagctggctgagctaagaaaggaaactgtatgtgctcctggaagtggccccatgttcaaatcaacaactgttactgtgagagaaaactgtaatgaaatttcccaacgagttgttgtggattcagttaataaccagcaagatttcaaatatactttgattcatagtgaagagaatactaaagatgctaccactgttgctgaagatccagaaagtgcaaataattatacagcaaaaaataaccaagttggggatcaagcccaggggattcacagacacaaaatcggcttttcttttgcatttccaaagaaagcgtccgtgaagctagagtcctcagctgcagccttctctgaatacagtgatgatgcctcagtgggaaaaggatttagcagaaaaagtagatttgtccccagtgcttgtcatcttcaacaatcttcaccaacagatgtgcttttgagttctgaggagaaaactaactcttttcatccaccagaggcaatgtgcagagacaaagaaactgttcaaactcaagagataaaagaagtctctagtgaaaaagatgcattattattaccttcattttgcaagtttcaacttcagttatcttctgatgcagataattgtcaaaattcagtcccattagcagatcaaataccactagagagtgttgttattaatgaagacatacctgttagtggtaacagttttgagttgttaggaaataaatccacagttcttgacatgtctaatgattgcatatctgtgcaagctaccacagaggaaaatgttaagcataacgaggcatccacaactgaggttgaaaataaaaatggtcccgagacattggccccttcaaatactgaagaggttaacataactatacataagaaaacaaatttctgcaaaagacaatgtgagccatttgtacctgtccttaacaaacacagatctacagttcttcagtggccatcagaaatgctggtttatacaactacgaaaccatcaatttcctatagctgtaatcctctatgttttgacttcaagtctactaaagtaaataataatctagataaaaataagccagacttaaaagatctttgttctcagcagaagcaggaagacatttgcatgggaccactttcagattacaaggatgtatctacagaaggactcactgattatgaaattggaagtagcaaaaataaatgcagccaagtcactcctcttttggctgatgatattctctccagtagttgtgattctggaaaaaatgagaacacaggtcagaggtataaaaacatttcctgtaagatcagagaaacagaaaagtataattttactaaaagtcaaataaaacaggacactctagatgaaaaatacaacaaaataaggttgaaagagacccatgaatactggttccataaaagtagaagaaagaaaaaaagaaaaaagttatgtcagcatcatcatatggagaaaaccaaagaatcagaaactcgctgcaaaatggaagcagagaatagttacactgaaaatgctgggaaatatctattggaaccaatttcagaaaagcagtatttagctgcagagcaattattagactcacatcagttacttgataaaaggcccaaatcagaatccatatccttaagtgacaatgaagaaatgtgtaaaacatggaatactgaatacaacacttatgatactatcagttctaaaaaccactgtaaaaagaacacaatacttttaaatggacaatcaaatgcaacaatgatacattctgggaaacataatttaacatattctagaacttactgttgttggaaaaccaaaatgtcaagctgtagtcaggatcacagaagcttagttcttcaaaatgatatgaaacacatgagtcagaatcaggctgttaaaagaggttacaattctgtcatgaatgaatcagaaagattctatcgaaaacgtagacaacattcacattcttattcttcagatgaaagtttaaatcgacagaatcatttaccagaagaatttttgaggccaccaagtacttcagttgctccctgcaagcctaaaaagaaacggaggcgaaaaagaggcagattccaccccggatttgaaactttagaactcaaagaaaatacagattatcccgtgaaagacaattcttccttaaatcctctggataggttaataagtgaagacaaaaaagagaaaatgaaaccacaagaagttgcaaaaatcgaaaggaactcagaacaaacaaaccaattaagaaacaaactgtctttccaccctaacaatctccttccttctgaaaccaatggtgaaactgagcatttagaaatggagaccacttctggtgaattgtcagatgtttccaatgatcccaccacatctgtctgtgtagctagtgccccaacaaaagaagcaattgacaataccctgcttgaacacaaagaaagaagtgagaatataaatcttaatgaaaagcaaattccttttcaggtgcctaatattgaaaggaactttagacagtcacagcctaaatcctatctttgccattatgaactggctgaggcccttccacaaggaaagatgaatgagacaccaactgagtggctgcgttataattcaggaatccttaacacacaaccaccattaccattcaaagaagcacatgtcagtggtcatacttttgtaacagctgagcaaatcctggctccattagctttaccagagcaagcattattgatcccactagaaaaccatgacaaattcaaaaatgtaccatgtgaggtctaccagcacattctgcagccaaacatgctggccaacaaggttaaatttacctttcctccagctgccctcccaccccctagcacacctctgcagcctttgcctttgcagcagtccttatgttctacctctgtaaccactatccatcacactgttttgcagcagcacgctgcagctgctgcagctgcagctgcagccgcagctgcaggaacctttaaagtgcttcagccacaccaacagtttctttcccaaatcccagctctcaccagaacctcattacctcagctctcagtaggaccagtaggaccgaggctttgtcctgggaaccagccaacttttgttgctcctcctcagatgccaatcattccagcttccaatcaaggaaatcaggccaataggctgaagaacaacaatgagcagagcaaccagacagttcacattcccctcgagaacaagactagaccctatgctccttcctagctcctgttggcactgtattgtgctctgcagaatgtaactgctgcctggggtttgctcctgttgtgttttctaattgatccatcgtcttgctagtgcctaagcttgcaacccagacactgtgtcttgattattctagttgaacttgttgcaaccagcttctgtaaccgagtaaattatgtttcttctggatgcttattgacttacattgcacattatcctccttttgaataattccccttatatttcttgactgaggttacctaagttacaacattttaaagtcaaggagactttagtttttaaaaatccaacatttaaggtgccttaatatggaagcccatgttttctgtgcatctctgaaaatagctatgcttcaaattaatgctttgagttttgactaatctgcttaccacattcaacttgttttttaatctaatgattttgcaagtgactattacttcaacttatgactgttggcagagaatcaatcttcacattaaaatgataagcctcaaacagattatagtttttattaaatggctttcattcccagaacagttgtactgaaataaaacaatgatagaaatattaataagttttgagatgtgaaatcttttattttctatcctgcattacaacttttcagaccatgacctttgtgagcccatacaatttcttaggtagtgtgaagcataatgtaatattttaaataattttacacactagcaattataattgcattttatagtacctaaggattaattatgtgcttgccaatcctctgtgctaatatataacactgtcttgacactatcttttaaaattgctaaacaaatataatgtaacattattattccatatagaaaagctttgcctaaacatgttagcatagaaaagactctacagcaatgcatttgtatataaataaatgtagtactgtt

SEQ ID NO: 463706 - DNA, 4457 bp, Homo sapiens
gccggactcctctttctcccggaagcggagcaccgagccggcaaaggcttgggtgtgagacagcagcggtggcagacaccgcagaagcaaagagcagtgaggctcctgcattcgggtggagcaccatggacgaagctggcagctctgcgagcggcgggggcttccgcccgggcgtggacagcctggacgaaccgcccaacagccgcatcttccttgtgatcagcaagtacacacctgagtcggtgctgagggagcgcttctcgccttttggcgacatccaggacatctgggtggtgcgggacaagcacaccaaggagtccaagggcattgctttcgtcaagttcgcccgcagctcacaggcctgcagggccatggaggagatgcatggccagtgcctcggccccaacgacaccaagcccatcaaggttttcattgctcagtcccgatcatctggaagtcaccgagatgttgaagatgaagaacttacaagaatctttgttatgataccaaagtcctacacagaagaagatctgcgggaaaaatttaaggtgtatggagatatcgagtattgcagcattattaagaataaagtgactggagaaagtaaaggtttgggctacgtacgatacttaaaaccatcacaagctgcccaagcaatagaaaactgtgatcgaagttttagagcaatcttggctgaacctaaaaataaagcatctgaatcctctgaacaagattattatagtaatatgaggcaagaagctttgggacatgaacctagagtaaatatgtttccatttgaacaacaatctgaatttcaagttttgacaagaatgatagccgaggccaggaagcaatctccaaacgcttgtcagttgtatcaagagttcctttcactgaagaacagcttttcagcatttttgatatagtaccaggattggaatattgtgaagttcaacgagatccttattcaaattatggtcatggagtggttcagtattttaatgtagcatcagctatttatgcaaaatacaaattacatggatttcagtaccctcctgggaaccgaataggtgtttccttcattgatgatggaagtaatgcaacagagtaagtaccattccaggagtgtctaaagccgagctttgagtgtacatgattgataggacttgaagaataaaaatagaaacaattgacctctcaggtgagaaagtcacacaaaacaagctactgttaaaagactgaatatttttagttttctgtaaattatcagttattttttccagtctccttagaaaaatggcaacacagatggtagctgcacagcttgcatcaatggtgtggaataacccaagtcagcaacaatttatgcaatttggaggaagctctggatcacagttgcctcaaatccagacagatgttgtacttccatcatgcaaaaaaaaagctcctgctgaaactcctgtgaaagaaagactttttattgtgtttaatcctcatcctttacctttagacgtattagaagatatattctgtcgttttggtaacctgatcgaagtttaccttgtgtcaggaaaaaatgtggggtatgccaagtatgccgatagaataagtgctaatgatgccattgccactctacatggaaagattctgaatggggtgagacttaaagttatgctggcagattcgccaagagaagaatctaacaaacggcaaagaacttactgattcttgagaaacagtagctcaagaacacatggatcctgggaactgaagtggccctgaagctgcactatgttggaggtttccttgactaagagaaccacatgcggcattcagctcagtaggggagtcataaaagatctcgcctctgaccagaagagtatgaatgacaaaggtgacataaccagcacagaaagatgtcttagcctctgcacatcagctgatttagaatacttatgtagatagcggttggggtcgggggggtgcggaatgttcttttcagcttctttgccctgagaactttgatcttattgcaaggaagtcccttaccctcttctaccctagatctgatggacctcctgggatttcctggggaaataaaatgagtctaacacctttgaccacctgctggatattatatcagcacttacttaagtaagctgtggaagagctgaaagcagtattcagagtctgacagttctctgcaattggcctagataaactcattgtgaaataagtaactaaatgggcaaaagatttgaacaagcacttcacaaaagaagaccaagaagagggcagggttttttgtttggggagttttatttagttttgttttggggttgttttgttttggcaggggacaggagtagtggatagattcattttgtaaagaaatattaaaatattctttttaatttgatagttaatataagcttaagaatcttttaaaactcagaatgttcagccgtattagtcatcaatgaactgctcattaaaactacaataagctaccctaacagtggtatgaacagcaagaattaaaatgttgacaataccaagtactggtgacagtgtgaagcaacaagaactgctgatgcaaattggctcaaccgcttgggaaaatgtttgacagtatctactaaagttgaacatatgtataccctcgactcagcaattccacttctaagcatatatccaacaaagatgtgtacatatatgtaccaaaagacacatacaaaaacattcttggtattattcatagtagccccaaagtggaaacaaccccaatgtccatgaacagaatgcatatgacactctatagcaaggaaatgagctaacttgctacacttataatgatttgaaggaatctcacaaacataatgttgaacaaaagcaaccagccaacaaaagatgtgctgtaggattcccagttacagagttcaaaaacaagcaaaacatatctttgagcagaatggaatgggggagttcacaaagggagttatggtgtgctggtggtcttgtttttcttgaccaggatggggataactgatcatttttgagctgtactctatggagtatgcattttttatttatcttatacttcaattaaagtttttctttcttagtgaataaagcaaaaatcagcatgaggctggtgaaacagacagttctgcagaatgagagaagaacaatgtcctgaagcatttagaaagaaggactttgttcttccagtgcttatagaacaaaaaatattagaaaatatctgcttttgctccccctatggtgcagcagggtattatgatggcaagagggcaggaaaataagagtgagaaaagaaagggagaagctaaattaatatttgagtcagaaatagtaaatagtcatagcactaaagaaaattgaatccatgatgaacagtgaatactgaactacttttcagaatcctgtgggttctcatgagtccacaaagcgaagatggagggaagttcccccactttttgttcattatccagatcagaactgctttcatcaatgttatatattgtgctttaaaagctttcttttaaaggattctctgcagcttaaataagttaggatgaacaaaaagcaccagagcaaaagataaaaagcaccctccgacaaatatagtaagagaaaaggtgcagatcaaaaaggctgattacagagatttatcctttgactaatagatgttcccaataaacaataactcgttttaatagaagaaacatggttgatctaaaaaattttaaaagtcacaagactgaagatcctcttctacacattttaaatgccatctggaatggagcaatgtctgtagttttgtagcccaagatttctctactcatccaaattgtaaaggtaacaggcattctgtgatatacaatgtactgctcatttgccctttctggaaaaaaattaatcaccacactcccaaaatgaatcaaaattaagaataaaagaagaaggaaagaaaggccagtcggtgagtattgaaatcatcactgaaactattagaataatgaaggtaattgtaaatttcatttttaaaaaaaagttttattatatgacttatctattccgaaatttttcagtgggatttataaccctaggttaagttaatgaaggccaagaaggaatggcagtttattttttgggggggatggaggtgggtgaggggtaaaatccttctcttttgtaaagaaatattaaaattcattctttttttactttgataattaaatgtaagattaagaatcttttgaagtctgttaaggtgcttaataataaaattaataacagaatgtctcctcttcaaattattgaacaatacaaaagtgaaattgtgtgtatgacaaaagtaaaaaaaaaaaaaaagcacgtaagaccaaaactgtttaaactttaaattctaaaaacaaaatgaaattatttccttc

SEQ ID NO: 463707 - DNA, 2922 bp, Homo sapiens
ctagaaagaatttctactaaatagaaattcagtagaatcccagtaaggggtaggattttaaaaaatggctgactccaattctgcattggaacatgctgttaataaaacaagatgacaccttagcctcccatcttctgacactccttattaacttatgtatgagaaggctatactgttaatttgagacagctattgagagtcttgtcataataggcttctttctgcattccttcactagtggccctgaagctgcactatgttggaggtttccttgactaagagaaccacatgcggcattcagctcagtaggggagtcataaaagatctcgcctctgaccagaagagtatgaatgacaaaggtgacataaccagcacagaaagatgtcttagcctctgcacatcagctgatttagaatacttatgtagatagcggttggggtcgggggggtgcggaatgttcttttcagcttctttgccctgagaactttgatcttattgcaaggaagtcccttaccctcttctaccctagatctgatggacctcctgggatttcctggggaaataaaatgagtctaacacctttgaccacctgctggatattatatcagcacttacttaagtaagctgtggaagagctgaaagcagtattcagagtctgacagttctctgcaattggcctagataaactcattgtgaaataagtaactaaatgggcaaaagatttgaacaagcacttcacaaaagaagaccaagaagagggcagggttttttgtttggggagttttatttagttttgttttggggttgttttgttttggcaggggacaggagtagtggatagattcattttgtaaagaaatattaaaatattctttttaatttgatagttaatataagcttaagaatcttttaaaactcagaatgttcagccgtattagtcatcaatgaactgctcattaaaactacaataagctaccctaacagtggtatgaacagcaagaattaaaatgttgacaataccaagtactggtgacagtgtgaagcaacaagaactgctgatgcaaattggctcaaccgcttgggaaaatgtttgacagtatctactaaagttgaacatatgtataccctcgactcagcaattccacttctaagcatatatccaacaaagatgtgtacatatatgtaccaaaagacacatacaaaaacattcttggtattattcatagtagccccaaagtggaaacaaccccaatgtccatgaacagaatgcatatgacactctatagcaaggaaatgagctaacttgctacacttataatgatttgaaggaatctcacaaacataatgttgaacaaaagcaaccagccaacaaaagatgtgctgtaggattcccagttacagagttcaaaaacaagcaaaacatatctttgagcagaatggaatgggggagttcacaaagggagttatggtgtgctggtggtcttgtttttcttgaccaggatggggataactgatcatttttgagctgtactctatggagtatgcattttttatttatcttatacttcaattaaagtttttctttcttagtgaataaagcaaaaatcagcatgaggctggtgaaacagacagttctgcagaatgagagaagaacaatgtcctgaagcatttagaaagaaggactttgttcttccagtgcttatagaacaaaaaatattagaaaatatctgcttttgctccccctatggtgcagcagggtattatgatggcaagagggcaggaaaataagagtgagaaaagaaagggagaagctaaattaatatttgagtcagaaatagtaaatagtcatagcactaaagaaaattgaatccatgatgaacagtgaatactgaactacttttcagaatcctgtgggttctcatgagtccacaaagcgaagatggagggaagttcccccactttttgttcattatccagatcagaactgctttcatcaatgttatatattgtgctttaaaagctttcttttaaaggattctctgcagcttaaataagttaggatgaacaaaaagcaccagagcaaaagataaaaagcaccctccgacaaatatagtaagagaaaaggtgcagatcaaaaaggctgattacagagatttatcctttgactaatagatgttcccaataaacaataactcgttttaatagaagaaacatggttgatctaaaaaattttaaaagtcacaagactgaagatcctcttctacacattttaaatgccatctggaatggagcaatgtctgtagttttgtagcccaagatttctctactcatccaaattgtaaaggtaacaggcattctgtgatatacaatgtactgctcatttgccctttctggaaaaaaattaatcaccacactcccaaaatgaatcaaaattaagaataaaagaagaaggaaagaaaggccagtcggtgagtattgaaatcatcactgaaactattagaataatgaaggtaattgtaaatttcatttttaaaaaaaagttttattatatgacttatctattccgaaatttttcagtgggatttataaccctaggttaagttaatgaaggccaagaaggaatggcagtttattttttgggggggatggaggtgggtgaggggtaaaatccttctcttttgtaaagaaatattaaaattcattctttttttactttgataattaaatgtaagattaagaatcttttgaagtctgttaaggtgcttaataataaaattaataacagaatgtctcctcttcaaattattgaacaatacaaaagtgaaattgtgtgtatgacaaaagtaaaaaaaaaaaaaaagcacgtaagaccaaaactgtttaaactttaaattctaaaaacaaaatgaaattatttccttc

SEQ ID NO: 463708 - DNA, 2804 bp, Homo sapiens
gacagagcgagactccgtctcaaacaaacaaaaacaaataaaacaagatgacaccttagcctcccatcttctgacactccttattaacttatgtatgagaaggctatactgttaatttgagacagctattgagagtcttgtcataataggcttctttctgcattccttcactagtggccctgaagctgcactatgttggaggtttccttgactaagagaaccacatgcggcattcagctcagtaggggagtcatcacagaaagatgtcttagcctctgcacatcagctgatttagaatacttatgtagatagcggttggggtcgggggggtgcggaatgttcttttcagcttctttgccctgagaactttgatcttattgcaaggaagtcccttaccctcttctaccctagatctgatggacctcctgggatttcctggggaaataaaatgagtctaacacctttgaccacctgctggatattatatcagcacttacttaagtaagctgtggaagagctgaaagcagtattcagagtctgacagttctctgcaattggcctagataaactcattgtgaaataagtaactaaatgggcaaaagatttgaacaagcacttcacaaaagaagaccaagaagagggcagggttttttgtttggggagttttatttagttttgttttggggttgttttgttttggcaggggacaggagtagtggatagattcattttgtaaagaaatattaaaatattctttttaatttgatagttaatataagcttaagaatcttttaaaactcagaatgttcagccgtattagtcatcaatgaactgctcattaaaactacaataagctaccctaacagtggtatgaacagcaagaattaaaatgttgacaataccaagtactggtgacagtgtgaagcaacaagaactgctgatgcaaattggctcaaccgcttgggaaaatgtttgacagtatctactaaagttgaacatatgtataccctcgactcagcaattccacttctaagcatatatccaacaaagatgtgtacatatatgtaccaaaagacacatacaaaaacattcttggtattattcatagtagccccaaagtggaaacaaccccaatgtccatgaacagaatgcatatgacactctatagcaaggaaatgagctaacttgctacacttataatgatttgaaggaatctcacaaacataatgttgaacaaaagcaaccagccaacaaaagatgtgctgtaggattcccagttacagagttcaaaaacaagcaaaacatatctttgagcagaatggaatgggggagttcacaaagggagttatggtgtgctggtggtcttgtttttcttgaccaggatggggataactgatcatttttgagctgtactctatggagtatgcattttttatttatcttatacttcaattaaagtttttctttcttagtgaataaagcaaaaatcagcatgaggctggtgaaacagacagttctgcagaatgagagaagaacaatgtcctgaagcatttagaaagaaggactttgttcttccagtgcttatagaacaaaaaatattagaaaatatctgcttttgctccccctatggtgcagcagggtattatgatggcaagagggcaggaaaataagagtgagaaaagaaagggagaagctaaattaatatttgagtcagaaatagtaaatagtcatagcactaaagaaaattgaatccatgatgaacagtgaatactgaactacttttcagaatcctgtgggttctcatgagtccacaaagcgaagatggagggaagttcccccactttttgttcattatccagatcagaactgctttcatcaatgttatatattgtgctttaaaagctttcttttaaaggattctctgcagcttaaataagttaggatgaacaaaaagcaccagagcaaaagataaaaagcaccctccgacaaatatagtaagagaaaaggtgcagatcaaaaaggctgattacagagatttatcctttgactaatagatgttcccaataaacaataactcgttttaatagaagaaacatggttgatctaaaaaattttaaaagtcacaagactgaagatcctcttctacacattttaaatgccatctggaatggagcaatgtctgtagttttgtagcccaagatttctctactcatccaaattgtaaaggtaacaggcattctgtgatatacaatgtactgctcatttgccctttctggaaaaaaattaatcaccacactcccaaaatgaatcaaaattaagaataaaagaagaaggaaagaaaggccagtcggtgagtattgaaatcatcactgaaactattagaataatgaaggtaattgtaaatttcatttttaaaaaaaagttttattatatgacttatctattccgaaatttttcagtgggatttataaccctaggttaagttaatgaaggccaagaaggaatggcagtttattttttgggggggatggaggtgggtgaggggtaaaatccttctcttttgtaaagaaatattaaaattcattctttttttactttgataattaaatgtaagattaagaatcttttgaagtctgttaaggtgcttaataataaaattaataacagaatgtctcctcttcaaattattgaacaatacaaaagtgaaattgtgtgtatgacaaaagtaaaaaaaaaaaaaaagcacgtaagaccaaaactgtttaaactttaaattctaaaaacaaaatgaaattatttccttc

SEQ ID NO: 463709 - DNA, 1993 bp, Homo sapiens
gccggactcctctttctcccggaagcggagcaccgagccggcaaaggcttgggtgtgagacagcagcggtggcagacaccgcagaagcaaagagcagtgaggctcctgcattcgggtggagcaccatggacgaagctggcagctctgcgagcggcgggggcttccgcccgggcgtggacagcctggacgaaccgcccaacagccgcatcttccttgtgatcagcaagtacacacctgagtcggtgctgagggagcgcttctcgccttttggcgacatccaggacatctgggtggtgcgggacaagcacaccaaggagtccaagggcattgctttcgtcaagttcgcccgcagctcacaggcctgcagggccatggaggagatgcatggccagtgcctcggccccaacgacaccaagcccatcaaggttttcattgctcagtcccgatcatctggaagtcaccgagatgttgaagatgaagaacttacaagaatctttgttatgataccaaagtcctacacagaagaagatctgcgggaaaaatttaaggtgtatggagatatcgagtattgcagcattattaagaataaagtgactggagaaagtaaaggtttgggctacgtacgatacttaaaaccatcacaagctgcccaagcaatagaaaactgtgatcgaagttttagagcaatcttggctgaacctaaaaataaagcatctgaatcctctgaacaagattattatagtaatatgaggcaagaagctttgggacatgaacctagagtaaatatgtttccatttgaacaacaatctgaatttcaagttttgacaagaatgatagccgaggccaggaagcaatctccaaacgcttgtcagttgtatcaagagttcctttcactgaagaacagcttttcagcatttttgatatagtaccaggattggaatattgtgaagttcaacgagatccttattcaaattatggtcatggagtggttcagtattttaatgtagcatcagctatttatgcaaaatacaaattacatggatttcagtaccctcctgggaaccgaataggtgtttccttcattgatgatggaagtaatgcaacagagtaagtaccattccaggagtgtctaaagccgagctttgagtgtacatgattgataggacttgaagaataaaaatagaaacaattgacctctcaggtgagaaagtcacacaaaacaagctactgttaaaagactgaatatttttagttttctgtaaattatcagttattttttccagtctccttagaaaaatggcaacacagatggtagctgcacagcttgcatcaatggtgtggaataacccaagtcagcaacaatttatgcaatttggaggaagctctggatcacagttgcctcaaatccagacagatgttgtacttccatcatgcaaaaaaaaagctcctgctgaaactcctgtgaaagaaagactttttattgtgtttaatcctcatcctttacctttagacgtattagaagatatattctgtcgttttggtaacctgatcgaagtttaccttgtgtcaggaaaaaatgtggggtatgccaagtatgccgatagaataagtgctaatgatgccattgccactctacatggaaagattctgaatggggtgagacttaaagttatgctggcagattcgccaagagaagaatctaacaaacggcaaagaacttactgattcttgagaacaaagactaaataatgacataatcctcagctgactgactgaaaatgtgactggacgcattccctgtggacagttgacagctttttttttttccatatacctgatagtctgtgtacagcattgttttgtctgggaagcagggattgctgacatgtatttttgaatccatacattaatgctaaaacgaatatagtagttgttccttagagcaatatgttgttacgtgtagcagaaataaagttttctttgcttaactaaa

SEQ ID NO: 463710 - DNA, 4417 bp, Homo sapiens
gccggactcctctttctcccggaagcggagcaccgagccggcaaaggcttgggtgtgagacagcagcggtggcagacaccgcagaagcaaagagcagtgaggctcctgcattcgggtggagcaccatggacgaagctggcagctctgcgagcggcgggggcttccgcccgggcgtggacagcctggacgaaccgcccaacagccgcatcttccttgtgatcagcaagtacacacctgagtcggtgctgagggagcgcttctcgccttttggcgacatccaggacatctgggtggtgcgggacaagcacaccaaggagtccaagggcattgctttcgtcaagttcgcccgcagctcacaggcctgcagggccatggaggagatgcatggccagtgcctcggccccaacgacaccaagcccatcaaggttttcattgctcagtcccgatcatctggaagtcaccgagatgttgaagatgaagaacttacaagaatctttgttatgataccaaagtcctacacagaagaagatctgcgggaaaaatttaaggtgtatggagatatcgagtattgcagcattattaagaataaagtgactggagaaagtaaaggtttgggctacgtacgatacttaaaaccatcacaagctgcccaagcaatagaaaactgtgatcgaagttttagagcaatcttggctgaacctaaaaataaagcatctgaatcctctgaacaagattattatagtaatatgaggcaagaagctttgggacatgaacctagagtaaatatgtttccatttgaacaacaatctgaatttcaagttttgacaagaatgatagccgaggccaggaagcaatctccaaacgcttgtcagttgtatcaagagttcctttcactgaagaacagcttttcagcatttttgatatagtaccaggattggaatattgtgaagttcaacgagatccttattcaaattatggtcatggagtggttcagtattttaatgtagcatcagctatttatgcaaaatacaaattacatggatttcagtaccctcctgggaaccgaataggtgtttccttcattgatgatggaagtaatgcaacagagtaagtaccattccaggagtgtctaaagccgagctttgagtgtacatgattgataggacttgaagaataaaaatagaaacaattgacctctcaggtgagaaagtcacacaaaacaagctactgttaaaagactgaatatttttagttttctgtaaattatcagttattttttccagtctccttagaaaaatggcaacacagatggtagctgcacagcttgcatcaatggtgtggaataacccaagtcagcaacaatttatgcaatttggaggaagctctggatcacagttgcctcaaatccagacagatgttgtacttccatcatgcaaaaaaaaagctcctgctgaaactcctgtgaaagaaagactttttattgtgtttaatcctcatcctttacctttagacgtattagaagatatattctgtcgttttggtaacctgatcgaagtttaccttgtgtcaggaaaaaatgtggggtatgccaagtatgccgatagaataagtgctaatgatgccattgccactctacatggaaagattctgaatggggtgagacttaaagttatgctggcagattcgccaagagaagaatctaacaaacggcaaagaacttactgattcttgagtggccctgaagctgcactatgttggaggtttccttgactaagagaaccacatgcggcattcagctcagtaggggagtcataaaagatctcgcctctgaccagaagagtatgaatgacaaaggtgacataaccagcacagaaagatgtcttagcctctgcacatcagctgatttagaatacttatgtagatagcggttggggtcgggggggtgcggaatgttcttttcagcttctttgccctgagaactttgatcttattgcaaggaagtcccttaccctcttctaccctagatctgatggacctcctgggatttcctggggaaataaaatgagtctaacacctttgaccacctgctggatattatatcagcacttacttaagtaagctgtggaagagctgaaagcagtattcagagtctgacagttctctgcaattggcctagataaactcattgtgaaataagtaactaaatgggcaaaagatttgaacaagcacttcacaaaagaagaccaagaagagggcagggttttttgtttggggagttttatttagttttgttttggggttgttttgttttggcaggggacaggagtagtggatagattcattttgtaaagaaatattaaaatattctttttaatttgatagttaatataagcttaagaatcttttaaaactcagaatgttcagccgtattagtcatcaatgaactgctcattaaaactacaataagctaccctaacagtggtatgaacagcaagaattaaaatgttgacaataccaagtactggtgacagtgtgaagcaacaagaactgctgatgcaaattggctcaaccgcttgggaaaatgtttgacagtatctactaaagttgaacatatgtataccctcgactcagcaattccacttctaagcatatatccaacaaagatgtgtacatatatgtaccaaaagacacatacaaaaacattcttggtattattcatagtagccccaaagtggaaacaaccccaatgtccatgaacagaatgcatatgacactctatagcaaggaaatgagctaacttgctacacttataatgatttgaaggaatctcacaaacataatgttgaacaaaagcaaccagccaacaaaagatgtgctgtaggattcccagttacagagttcaaaaacaagcaaaacatatctttgagcagaatggaatgggggagttcacaaagggagttatggtgtgctggtggtcttgtttttcttgaccaggatggggataactgatcatttttgagctgtactctatggagtatgcattttttatttatcttatacttcaattaaagtttttctttcttagtgaataaagcaaaaatcagcatgaggctggtgaaacagacagttctgcagaatgagagaagaacaatgtcctgaagcatttagaaagaaggactttgttcttccagtgcttatagaacaaaaaatattagaaaatatctgcttttgctccccctatggtgcagcagggtattatgatggcaagagggcaggaaaataagagtgagaaaagaaagggagaagctaaattaatatttgagtcagaaatagtaaatagtcatagcactaaagaaaattgaatccatgatgaacagtgaatactgaactacttttcagaatcctgtgggttctcatgagtccacaaagcgaagatggagggaagttcccccactttttgttcattatccagatcagaactgctttcatcaatgttatatattgtgctttaaaagctttcttttaaaggattctctgcagcttaaataagttaggatgaacaaaaagcaccagagcaaaagataaaaagcaccctccgacaaatatagtaagagaaaaggtgcagatcaaaaaggctgattacagagatttatcctttgactaatagatgttcccaataaacaataactcgttttaatagaagaaacatggttgatctaaaaaattttaaaagtcacaagactgaagatcctcttctacacattttaaatgccatctggaatggagcaatgtctgtagttttgtagcccaagatttctctactcatccaaattgtaaaggtaacaggcattctgtgatatacaatgtactgctcatttgccctttctggaaaaaaattaatcaccacactcccaaaatgaatcaaaattaagaataaaagaagaaggaaagaaaggccagtcggtgagtattgaaatcatcactgaaactattagaataatgaaggtaattgtaaatttcatttttaaaaaaaagttttattatatgacttatctattccgaaatttttcagtgggatttataaccctaggttaagttaatgaaggccaagaaggaatggcagtttattttttgggggggatggaggtgggtgaggggtaaaatccttctcttttgtaaagaaatattaaaattcattctttttttactttgataattaaatgtaagattaagaatcttttgaagtctgttaaggtgcttaataataaaattaataacagaatgtctcctcttcaaattattgaacaatacaaaagtgaaattgtgtgtatgacaaaagtaaaaaaaaaaaaaaagcacgtaagaccaaaactgtttaaactttaaattctaaaaacaaaatgaaattatttccttc

SEQ ID NO: 463711 - DNA, 2119 bp, Homo sapiens
gccggactcctctttctcccggaagcggagcaccgagccggcaaaggcttgggtgtgagacagcagcggtggcagacaccgcagaagcaaagagcagtgaggctcctgcattcgggtggagcaccatggacgaagctggcagctctgcgagcggcgggggcttccgcccgggcgtggacagcctggacgaaccgcccaacagccgcatcttccttgtgatcagcaagtacacacctgagtcggtgctgagggagcgcttctcgccttttggcgacatccaggacatctgggtggtgcgggacaagcacaccaaggagtccaagggcattgctttcgtcaagttcgcccgcagctcacaggcctgcagggccatggaggagatgcatggccagtgcctcggccccaacgacaccaagcccatcaaggttttcattgctcagtcccgatcatctggaagtcaccgagatgttgaagatgaagaacttacaagaatctttgttatgataccaaagtcctacacagaagaagatctgcgggaaaaatttaaggtgtatggagatatcgagtattgcagcattattaagaataaagtgactggagaaagtaaaggtttgggctacgtacgatacttaaaaccatcacaagctgcccaagcaatagaaaactgtgatcgaagttttagagcaatcttggctgaacctaaaaataaagcatctgaatcctctgaacaagattattatagtaatatgaggcaagaagctttgggacatgaacctagagtaaatatgtttccatttgaacaacaatctgaatttcaagttttgacaagaatgatagccgaggccaggaagcaatctccaaacgcttgtcagttgtatcaagagttcctttcactgaagaacagcttttcagcatttttgatatagtaccaggattggaatattgtgaagttcaacgagatccttattcaaattatggtcatggagtggttcagtattttaatgtagcatcagctatttatgcaaaatacaaattacatggatttcagtaccctcctgggaaccgaataggtgtttccttcattgatgatggaagtaatgcaacagagtaagtaccattccaggagtgtctaaagccgagctttgagtgtacatgattgataggacttgaagaataaaaatagaaacaattgacctctcaggtgagaaagtcacacaaaacaagctactgttaaaagactgaatatttttagttttctgtaaattatcagttattttttccagtctccttagaaaaatggcaacacagatggtagctgcacagcttgcatcaatggtgtggaataacccaagtcagcaacaatttatgcaatttggaggaagctctggatcacagttgcctcaaatccagacagatgttgtacttccatcatgcaaaaaaaaagctcctgctgaaactcctgtgaaagaaagactttttattgtgtttaatcctcatcctttacctttagacgtattagaagatatattctgtcgttttggtaacctgatcgaagtttaccttgtgtcaggaaaaaatgtggggtatgccaagtatgccgatagaataagtgctaatgatgccattgccactctacatggaaagattctgaatggggtgagacttaaagttatgctggcagattcgccaagagaagaatctaacaaacggcaaagaacttactgattcttgagaacaaagactaaataatgacataatcctcagctgactgactgaaaatgtgactggacgcattccctgtggacagttgacagctttttttttttccatatacctgatagtctgtgtacagcattgttttgtctgggaagcagggattgctgacatgtatttttgaatccatacattaatgctaaaacgaatatagtagttgttccttagagcaatatgttgttacgtgtagcagaaataaagttttctttgcttaactaaaaaaaaaaaaaaaacaaaaaaaacccggccctttttcgggcggaaacagaggtttaacggcccagtgcaaggtttctgcaccgtttgtaaaggggaacaccgcccaaggagggaatcgaactcgaga

SEQ ID NO: 463712 - DNA, 831 bp, Homo sapiens
ctttgttggtgtattaaataaacatattaccttattttaagtttcgataaaatactgtggaagactttgccaaattttatatgattgtgacaagttttttggggtaggtgcacttttttgtttgtttctttaatttttaaaaggctgcaaacacagctcatgaaggctggtttcttttatctctgaggtatgggcctgggagtatgtgagtcatgcctaggaaatagaagcaactgatccaagatataacattgaaagtagttgaattctattttgagatgggtctgataaccacaatgtaattctctttctatttgaggaaaatataaattttagtatttcagagcatcagattttttgttaattcacaacactttccctctagaaattcagcacctgcatcgcccttcttagtaagtttggttttatttgggggcagctatgattaagcagataacattgggtatattgaaataaaggaacaattcctaacattttaggaatactacaacagctatttcctttcctttcaggtgatgattttcatacttgtgttgtgttctttctacagaacaaagactaaataatgacataatcctcagctgactgactgaaaatgtgactggacgcattccctgtggacagttgacagctttttttttttccatatacctgatagtctgtgtacagcattgttttgtctgggaagcagggattgctgacatgtatttttgaatccatacattaatgctaaaacgaatatagtagttgttccttagagcaatatgttgttacgtgtagcagaaataaagttttctttgcttaactaaa

SEQ ID NO: 463713 - DNA, 711 bp, Homo sapiens
tctgaacaagattattatagtaatatgaggcaagaagctttgggacatgaacctagagtaaatatgtttccatttggtaagtaggcaacctttacttttaatagtataatgtagtatatgcaatctaatttgggttttaaagaatactctgttattgggcatctataaatttcacctagtgaataaaaatcttaaatgtagtttttttattcctaaaatgtggattatgactcctaaagttcttaatatttaacacttattttgtttaactgatttctaattatagttttctctgttaagttacgcattcctcatattagaaactattaccactgccacttttttgggtgagcttctgcctctatatagctgaccaaaaacttaaaaagacatatgtagagatcctctccgtatgagtcctaaaattttgttccagaactactgctactttaaaattagggctacagaaaggagaggaatggtaaaagtagaagctctaatagaaaaaggggaaaatgggtaatgaaagtaaggcctgtgaatgttatttgacgtaaacattcaggtaaaatacttaccatatttttcagttttgcatactaaacttctttctgtgaaattagactatgcatttcttcttatatttctgcattaaaggtaggggagtggggagagttgtctcttcttgtcattagtcccatcggtagttct

SEQ ID NO: 463714 - DNA, 838 bp, Homo sapiens
gccggactcctctttctcccggaagcggagcaccgagccggcaaaggcttgggtgtgagacagcagcggtggcagacaccgcagaagcaaagagcagtgaggctcctgcattcgggtggagcaccatggacgaagctggcagctctgcgagcggcgggggcttccgcccgggcgtggacagcctggacgaaccgcccaacagccgcatcttccttgtgatcagcaagtacacacctgagtcggtgctgagggagcgcttctcgccttttggcgacatccaggacatctgggtggtgcgggacaagcacaccaaggagtccaagggcattgctttcgtcaagttcgcccgcagctcacaggcctgcagggccatggaggagatgcatggccagtgcctcggccccaacgacaccaagcccatcaaggtgcgggtgcccgggtcggggtgccctcgggggaaggagtgggcctcttggacctcccttcacctgctgctctgccggggtgagggaggagtggaacatccgttcccggcagctgaccagacagcacctggcttggggacaggggctgctttgaggagaggctcccctcccacgaagctgcgccgggttgcagggaaggggacgggatgcggagtgtttgccccacgagagcggacccggcagccgcggccaccgggtgacagaacagcagtggctgggcttcccctctccctcgccctcactaatccaccagctcttgagttcactgcaaactcgtcctagcctactttgagtacttttctgaccttcctctctcagatgcccagatttccatatataaaaaacggaaaaac

SEQ ID NO: 463715 - DNA, 1817 bp, Homo sapiens
gccggactcctctttctcccggaagcggagcaccgagccggcaaaggcttgggtgtgagacagcagcggtggcagacaccgcagaagcaaagagcagtgaggctcctgcattcgggtggagcaccatggacgaagctggcagctctgcgagcggcgggggcttccgcccgggcgtggacagcctggacgaaccgcccaacagccgcatcttccttgtgatcagcaagtacacacctgagtcggtgctgagggagcgcttctcgccttttggcgacatccaggacatctgggtggtgcgggacaagcacaccaaggagtccaagggcattgctttcgtcaagttcgcccgcagctcacaggcctgcagggccatggaggagatgcatggccagtgcctcggccccaacgacaccaagcccatcaaggttttcattgctcagtcccgatcatctggaagtcaccgagatgttgaagatgaagaacttacaagaatctttgttatgataccaaagtcctacacagaagaagatctgcgggaaaaatttaaggtgtatggagatatcgagtattgcagcattattaagaataaagtgactggagaaagtaaaggtttgggctacgtacgatacttaaaaccatcacaagctgcccaagcaatagaaaactgtgatcgaagttttagagcaatcttggctgaacctaaaaataaagcatctgaatcctctgaacaagattattatagtaatatgaggcaagaagctttgggacatgaacctagagtaaatatgtttccatttgaacaacaatctgaatttcaagttttgacaagaatgatagccgaggccaggaagcaatctccaaacgcttgtcagttgtatcaagagttcctttcactgaagaacagcttttcagcatttttgatatagtaccaggattggaatattgtgaagttcaacgagatccttattcaaattatggtcatggagtggttcagtattttaatgtagcatcagctatttatgcaaaatacaaattacatggatttcagtaccctcctgggaaccgaataggtgtttccttcattgatgatggaagtaatgcaacagatctccttagaaaaatggcaacacagatggtagctgcacagcttgcatcaatggtgtggaataacccaagtcagcaacaatttatgcaatttggaggaagctctggatcacagttgcctcaaatccagacagatgttgtacttccatcatgcaaaaaaaaagctcctgctgaaactcctgtgaaagaaagactttttattgtgtttaatcctcatcctttacctttagacgtattagaagatatattctgtcgttttggtaacctgatcgaagtttaccttgtgtcaggaaaaaatgtggggtatgccaagtatgccgatagaataagtgctaatgatgccattgccactctacatggaaagattctgaatggggtgagacttaaagttatgctggcagattcgccaagagaagaatctaacaaacggcaaagaacttactgattcttgagaacaaagactaaataatgacataatcctcagctgactgactgaaaatgtgactggacgcattccctgtggacagttgacagctttttttttttccatatacctgatagtctgtgtacagcattgttttgtctgggaagcagggattgctgacatgtatttttgaatccatacattaatgctaaaacgaatatagtagttgttccttagagcaatatgttgttacgtgtagcagaaataaagttttctttgcttaactaaa

SEQ ID NO: 463716 - DNA, 2286 bp, Homo sapiens
gccggactcctctttctcccggaagcggagcaccgagccggcaaaggcttgggtgtgagacagcagcggtggcagacaccgcagaagcaaagagcagtgaggctcctgcattcgggtggagcaccatggacgaagctggcagctctgcgagcggcgggggcttccgcccgggcgtggacagcctggacgaaccgcccaacagccgcatcttccttgtgatcagcaagtacacacctgagtcggtgctgagggagcgcttctcgccttttggcgacatccaggacatctgggtggtgcgggacaagcacaccaaggagtccaagggcattgctttcgtcaagttcgcccgcagctcacaggcctgcagggccatggaggagatgcatggccagtgcctcggccccaacgacaccaagcccatcaaggttttcattgctcagtcccgatcatctggaagtcaccgagatgttgaagatgaagaacttacaagaatctttgttatgataccaaagtcctacacagaagaagatctgcgggaaaaatttaaggtgtatggagatatcgagtattgcagcattattaagaataaagtgactggagaaagtaaaggtttgggctacgtacgatacttaaaaccatcacaagctgcccaagcaatagaaaactgtgatcgaagttttagagcaatcttggctgaacctaaaaataaagcatctgaatcctctgaacaagattattatagtaatatgaggcaagaagctttgggacatgaacctagagtaaatatgtttccatttgaacaacaatctgaatttcaagttttgacaagaatgatagccgaggccaggaagcaatctccaaacgcttgtcagttgtatcaagagttcctttcactgaagaacagcttttcagcatttttgatatagtaccaggattggaatattgtgaagttcaacgagatccttattcaaattatggtcatggagtggttcagtattttaatgtagcatcagctatttatgcaaaatacaaattacatggatttcagtaccctcctgggaaccgaataggtgtttccttcattgatgatggaagtaatgcaacagagtaagtaccattccaggagtgtctaaagccgagctttgagtgtacatgattgataggacttgaagaataaaaatagaaacaattgacctctcaggtgagaaagtcacacaaaacaagctactgttaaaagactgaatatttttagttttctgtaaattatcagttattttttccagtctccttagaaaaatggcaacacagatggtagctgcacagcttgcatcaatggtgtggaataacccaagtcagcaacaatttatgcaatttggaggaagctctggatcacagttgcctcaaatccagacagatgttgtacttccatcatgcaaaaaaaaagctcctgctgaaactcctgtgaaagaaagactttttattgtgtttaatcctcatcctttacctttagacgtattagaagatatattctgtcgttttggtaacctgatcgaagtttaccttgtgtcaggaaaaaatgtggggtatgccaagtatgccgatagaataagtgctaatgatgccattgccactctacatggaaagattctgaatggggtgagacttaaagttatgctggcagattcgccaagagaagaatctaacaaacggcaaagaacttactgattcttgaggtaagccctttttaatctgaattttaaaacatattgagtaaatagtatatgaggaatatgtgtaagtactttataaacttttctttttagtgatttagaagttgtcagttaaaagagctttgcaactatttaaactttaaaaattgttgacatttactgaagaatgtttttgcccttctgtaaaataaaatcacatttcaatttagaaagataaataattgttttttgtttgtgaaatcttcgattttaagaattcaactttttattatgtgcttatataaacttttaagttgtccggtgctagaataaggattgctttaaaaaaaaattgaaatacttctaaagatttttaacttgaaaaattggtgtcttgagttatgaattgaggtaatttataacagtcgtttataaagataatgttttgacttctctctaatgaaatgcctaaaaagcaatatcaaataatatatcatttttggaccttttgaacctaaatgttggtgttttctggacttgtatttgtgagtttgtgcattaaaacaatacattcaga

SEQ ID NO: 463717 - DNA, 1218 bp, Homo sapiens
gcagagataaggtaagggaacagcctatatgatttggcaaaactctctgagggacattattatcattgtcaccatccgtctgttccatagaaatcagaaaatgttgcctaagagtgttgtgttggaatatatttatcttacaggttctgatttatctgcctatgtctctagctcttccggatcttctctagccccttcaagtctcaacttgaggctctctggtatttcctcaaaccatggagctttgtccccagccagcttccaggtccaggcctggcctacaaagaaggccatgactcaccacctcctcgttcctagaagattccctcctcggatctggaagaaaggcaagatggtgttgaggacattggtgcagaggcatgagggagtgagggccacctctgctacttagtgagtggtttggggcatcacttaacctcttggagcctcagggttttcactggtaaaagactgggaatggagattgtgaggattaatacgaagtggatgaggaggaccagagaaaatgtgtcattgcctggagtctcccctgtactctcttgttattggctgaaatgtgtacctccaaaatttatttattgaagccctaacctcagtatctgagaatgaaagtgtatctagaaacatggcctttaagagagtcatctgggaagctttagacaaatcctgatgcccagatccaattgcagaccaattatctgaatttctgggggaaggaacaaagccttacttttcttgtcaaaactctccaggtgattcctgtgtctatccaaagttgagaacactggtctattagataatgggagtttgtcccagctctacaggtctggggataatgctgatggctgcatttggggaagaggaacagagaagccagcttgagcaacatcttctgagtcactggccaagaaatgcttccccacctatccttcaggtaggagagtggacactagtcaaaaaggcacaagtatttccaattcaatttccctgcacatggctgcaagagacaaatgtcaccgattgagtctgagcttcacacatcccaacttaaagctcattaaaaagctcccaaaaaatgaggacttcaagcttggagttccctctgaaagccatgccggatctaaagttcagatcttacaacatgcaggcaccagactagtcatctgacatgcatttttctatttaattcccacaaaa

SEQ ID NO: 463718 - DNA, 737 bp, Homo sapiens
actccagtgtgctttttgggctcacagtttggttagttctcttcatcatctaggactaaccttttttaactatcatcatggtgacaggtaagagaatgtgatggctagaaccacagacagattcagaggattcttctgtgaccaggccctgttcctctgccagctctcccgctaactgactatgtaaccttgaggcaagtcacttcccctttctagccctcagttttccggttattaaaatgaagagattgaactggataatcttcaggtttccgttaagtcaaaatggaccatatgattcatctaaaaatgttctaagacaggaagcccgtttcttcacaactctcagtagctttggagattttcctatgaattatccattaccaaaaaatgacacccccattcccactatccacttctctggagcgtcctggcagcagacggaaagctcattagcagggcgggagccttggcagacacccactttcaggctgccaaagggcaaggacaagctcaaggcagaacaagaagaatattccgtcactgaacgtgggaagagagtgttcaaggagtgggcattcagccagactcggaggtcaggggtgactgaccggaagatgatcatgagatttagtgatgagctggtcactggtgctttttctcataggagtctcagtggcataaagagttaggaagtaagattctaggtcattgaggaggaggaggaggaggaagag

SEQ ID NO: 463719 - DNA, 993 bp, Homo sapiens
gcacagtgatacaaataatgccactaagggaaagagaacagaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagatcagtactgggaaagtggggaaggacagtcatggagaaactacataaggaagcaccttgcccttctgcctcttgagaatgttgatgagtatcaaatctttcaaactttggaggtttgagtaggggtgagactcagtaatgtcccttccaatgacatgaacttgctcactcatccctgggggccaaattgaacaatcaaaggcaggcataatccagttatgaattcaaaccttcttctcagaagataacactctgaagtgaaacccacccataacctaagcaagtgaagacaggtgctgcaggtggaattgtgtccttcaaaaagtgggccctaaatccaatgactggtgtccttataagaagaaggagattggagatgcagtgacacataggaagaaagccacatgaccaaggaggcagagaccagagggatgcagctgagagccaaagagcaccaaggattgctgggagccaccagaagctggagaggtgtgggatggtttctccccgagaacctgcagaagacactaactctgcctgtgccttgaattcagatttctgtctccagacctatgacagaataaacttctgttgttttacggctcttagtttgtggtactttgttagggcaga

SEQ ID NO: 463720 - DNA, 940 bp, Homo sapiens
gcctcttacctacccacacctttaaaaaatttcctcctctttctccaatacccactcttttccttttaaatattgagatccccagaccctcttcaggaaagggacccatatgttgaggatgtgctgcgtcctgggctggcctggggcacagggccaggcagcttttgtcgcgtccacatgcctgctctattcttctccaggactcagcagctggctccaagcagcacagcccttaaccacccgcggagggagtggcccctgcccccaaatagttgcacacttgagcaggccttttgtctgcttagaagacattccaactgcccataagcagttggccttcgcacaaaggagggtgtccatggaggagggcatggccatcaagaacagctggttttctaagaggcttccgagatttgaaaaacggtggctaatgatgacaacagcaacagcactgagcacagaaaactccacaggcctgggctcggctcatcgcacagcctccatctctggatgccctgattcaaggagattcaaaacccgtgtcactgctgccatcttcctagaatccctttaaatcctcatggatttgctgacattgggagcatcctgaaagagtccccatgctagggtggctgcagtaacaggttctccccactccagaaaaaatcaaatcagattgtgaatttattccctgacattaacacacggcattacaggagcatgtacatcacatggtcaatttattggcatgaggattatgtcatcggggaataaatgggaaattctcaaggtactttgctccagtaatcaggactttatttatctctaagctaaaagaggggattgacttctttaatgatgatcagaaaatgcttttaggaagattcctttcctattaaacaatttcttaaagttgcagtaaatgttgtgtggcttgtct

SEQ ID NO: 463721 - DNA, 958 bp, Homo sapiens
gcctcttacctacccacacctttaaaaaatttcctcctctttctccaatacccactcttttccttttaaatattgagatccccagaccctcttcaggaaagggacccatatgttgaggatgtgctgcgtcctgggctggcctggggcacagggccaggcagcttttgtcgcgtccacatgcctgctctattcttctccaggactcagcagctggctccaagcagcacagcccttaaccacccgcggagggagtggcccctgcccccaaatagttgcacacttgagcaggccttttgtctgcttagaagacattccaactgcccataagcagttggccttcgcacaaaggagggtgtccatggaggagggcatggccatcaagaacagctggttttctaagaggcttccgagatttgaaaaacggtggctaatgatgacaacagcaacagcactgagcacagaaaactccacaggcctgggctcggctcatcgcacagcctccatctctggatgccctgattcaaggagattcaaaacccgtgtcactgctgccatcttcctagaatccctttaaatcctcatggatttgctgacattgggagcatcctgaaagagtccccatgctagggtggctgcagtaacaggtacaatgagaaatgatggttctccccactccagaaaaaatcaaatcagattgtgaatttattccctgacattaacacacggcattacaggagcatgtacatcacatggtcaatttattggcatgaggattatgtcatcggggaataaatgggaaattctcaaggtactttgctccagtaatcaggactttatttatctctaagctaaaagaggggattgacttctttaatgatgatcagaaaatgcttttaggaagattcctttcctattaaacaatttcttaaagttgcagtaaatgttgtgtggcttgtct

SEQ ID NO: 463722 - DNA, 5199 bp, Homo sapiens
cggccatcttggctccaccctcgtagcaaatgtggagagtgtcctccaggtgtaggtagagtttcatatagtagcctaaaatgggtgaaaagagagttcatcctcagaaaactaaagaaaatgtctgctttgtgaatcttgatgtgaacaaggatgaatgcagcacagagcacctgcaacagaaactggtcaacgtttcaccagatcttccaaaacttatcagttccatgaatgtccaacaaccaaaagaaaatgaaattgttgtcctaagtgggttagcctctggaaatctccaggcagattttgaagtttcacagtgcccttggctgccagatatctgcttggtccaatgtgcaagagggaacagaccaaacagtaccaactgcatcatctttgaaatcaacaaatttctgattggtctggaactggtgcaggagcgacagctccacctggaaacaaacatcttgaaactggaggatgacacgaactgttccttatcttcaatcgaggaagactttctcaccgcttctgagcacttggaggaggaaagcgaggtggatgaatctaggaacgattatgaaaatataaatgtctcagccaatgttttggaaagtaaacagctaaagggagccacccaggtggaatggaattgcaacaaggaaaagtggctttatgctttggaagacaaatacatcaacaaatatcccacaccattgattaaaacagaacgatctccagaaaacctaacaaagaacacagccttgcagagtctagatccctcagccaagccatcacagtggaaaagagaagctgtggggaatgggagacaagccacacattattatcattcagaagcttttaaaggtcaaatggaaaaatcacaggcactgtatattccaaaagatgcttatttctccatgatggataaagatgtaccttctgcatgtgctgtggcagagcagagaagcaacctaaacccaggagaccatgaagacacaagaaacgctctccctcctagacaagatggagaagtcaccactggcaagtatgctacaaatttagcagaatccgtgctgcaggatgcatttattagattatctcaatctcagtccacattaccccaggaatctgcagtcagtgtttctgtaggaagttctctgcttcccagttgctattccacaaaagatacagtggtttctcggtcatggaatgagctccccaaaatcgtcgttgttcagagtccagatggcagtgatgctgccccacagccaggcatctcctcctggcctgagatggaagtctctgttgaaacctcaagcatcctctctggagagaactccagcagacaaccccagagtgctctagaagtggcgttagcttgtgcagccactgtgattggaactatttccagtccacaggccacagaaagactcaaaatggagcaagtggtctcgaactttcccccagggagcagtggtgcactgcaaactcaagcaccccaaggactcaaggaaccttccatcaatgagtactcctttccatctgctttgtgtggcatgactcaggtggccagtgccgtggctgtctgtggtctgggtgaaagagaagaggtgacatgctcagtggctccaagtggtagcctcccgcctgcagctgaggcttctgaagccatgcccccactttgtggtttagcaagcatggagcttggcaaggaagccattgccaagggattgctcaaggaggctgctctggttttaacaaggcctaatacctacagcagcattggagactttctggactccatgaacaggagaatcatggaaactgcttcaaagtctcagaccctgtgctcagaaaatgtcgtcaggaatgaactggcacataccctgtccaatgttatcctgaggcattccattgatgaagttcaccacaaaaatatgataatcgaccccaatgacaacaggcattcatctgaaattctggacaccttaatggaaagtacaaatcaactgcttttagatgtgatatgcttcacgttcaagaagatgagtcatattgtacggcttggtgaatgtcctgctgtcctttctaaggagaccatcagaaggagggagacagaaccaagctgccagccatctgatccgggtgctagtcaagcttggacaaaagccactgaatcctccagcagctctccacttagcaattcacacaacacgagtcttgtcatcaacaatcttgtggatggcatgtattcaaaacaagacaagggtggagtgaggccaggcctcttcaagaaccccacgctgcagtcacaattatcacgtagtcacagagtgcccgattcttcaactgctacaacatcctccaaggaaatatatctgaaaggaatagcaggagaggatacaaaaagccctcatcacagtgagaatgaatgcagagcctcttccgaaggacaaaggtccccaacggtcagccagtccagaagtggttcccaggaggctgaggagagtatccacccaaacacccaagaaaagtacaactgtgccacatctcgcatcaacgaagttcaagtcaacctgtccttgttaggggatgacctgctgcttcctgctcaatccacgcttcaaacaaagcatccagacatctactgcattacagactttgcggaagaattagcagacacggtcgtctccatggcaactgaaattgcagcgatttgccttgacaactccagtggaaaacaaccctggttttgtgcatggaaaagagggagtgagtttctgatgacacccaacgtaccctgccgatccttgaagaggaagaaagagagccaggggagcgggaccgctgtgaggaaacacaagcctccccggctcagtgagatcaagaggaagacggacgagcaccctgagcttaaagaaaagctgatgaacagggttgtggatgagtccatgaaccttgaagatgtcccagattctgtcaatctttttgccaatgaagtggcagccaagatcatgaacctaacggagttctctatggtggacggcatgtggcaggcgcagggctatccccggaatcggttactgagtggcgacaggtggagccggctgaaggcctccagctgcgaaagcattcctgaggaagactccgaggccagggcctatgtcaacagcctgggcttaatgagcacgctgagccagccggtcagcagggccagctctgtctccaagcagtcgagctgtgagagcatcaccgatgagttttccaggttcatggtgaaccagatggaaaatgaagggagaggatttgagttactgctggattactatgctggcaagaacgccagcagcattctgaactcagccatgcaacaggcgtgccggaaaagtgaccacctcagtgtgaggcctagctgtccctctaagcagtccagcacagagagcatcactgaggagttctacaggtacatgctgagggacatcgaaagagacagcagagaaagtgcctcctccagacggagcagccaggattggacagccggcctgctgtctccttctctgcgatccccagtgtgccacagacagtcgtccatgccagacagcagatccccatgctccaggctgacagtgaatgtgcccatcaaagccaactctttagatggctttgctcagaactgcccacaagatttcctaagcgtgcagccggtcagtagcgcgtcctcatccggtctctgcaaatctgactcttgcttgtatcggagaggtgggactgaccacatcaccaacatgttaattcatgaaacgtgggctagctccattgaggctctcatgcgcaagaacaaaatcattgtggatgatgcagaggaagctgacactgagcctgtttctggtggctctccctcgcaagcagagaagtgtgcaaatagattagctgcgagcaggatgtgcagtgggccaactctgcttgttcaggagtctctcgattgcccgaggaaagactctgttaccgaatgtaaacagcccccagtgtcatctttgagcaaaactgcttctcttacaaaccacagccctttagattctaaaaaagaaacttcctcgtgccaggaccctgtaccaataaaccacaaaaggcgatcactttgctcgagggaagtgcctttgattcagattgaaacagatcagagagaagcctgtgctggggaacctgaacccttcctttccaaaagcagcctcctagaggaagcagaagggcattcgaatgacaaaaacatcccagatgtggtgagaggtggagacacagccgtgagcgcttgtcaaatccataggtgagtgaatcgtctcagactacatagggtgcatgtgactggagtttgcgtcttaatcagtgtttagtctaaattttagacataaaggatttgattggtgcaagaactaaattttcaagaccaaaaaaaaaaaaaatgagttaatgagtgcagcacaccaacatggcacatgtatacatatgtaacaaacatgcacgttgtgcacatgtgccctaaaatttaaagtgtaataaaaaaaaaatgatctcctaggttaatatgcatttatgatagagagttgaaagtaaatctcttcttaaaatctccaaaactaactaaactcatctatataaccaaagaagtaagatatcattcctcccattaaaattaatctcctacggtttcctaccttttaaaattcattcatggcaatttttaagcaaataataatattaatagtatatgatgcaataatattaataataaatgatgcaacttattcatttgaaaacagtcaaataaatattagttttggcatttgacattaaatattttggcatcatttttctctcctctcatttttcttctccatagagtctctcctttcaagttttgctttctgtttttgttttttgtctttttctaaagatcttgccaaggacactgtgtcctagaagggctgccctttagatgcctggtataattctagcagtgtaaatgcaaagcaacactgaagtattgttatttaaacagctttttccagaaaattatgacatagttgacaatccattttgaatttgacgcaaggtaataatttctctgaggctgcttaaagaactctccattccttttacaccttatattttctgtagaaaatttataagattcttgaatat

SEQ ID NO: 463723 - DNA, 1991 bp, Homo sapiens
ttcggtaataatctgaaattcttaaaaagaaaatagattatcccggaaaacagtcctctgacactagagacatttaaacagagactggagagccattggcttcgcgagggtggttgaatgaggtggctttgaggaccctctgtgctctgtgagccctaactctccgttttattttagtttctagatgtcgtgcagctggttcatcggaagtcctggaaagtgggtgatatcttccatgcagttgtccagtactgcaaaatgcatgaggagcagaaggatgggagactgagtctctttgactggctcttggaactgggataataaggcagtctgccgtatagatcattccttccctttattccaacttagattacagtggtttgttctaaatgctctaaacattctcaaaacatcacatcacattagcagaactataaaaaaaaatctgctactcagatccactgcatacagaattcaatggggcccaaattagaatgcttataatgagacccaatctccaggaaaacaacactcacataagtttaatcatataaaatgatttgtaatgtctctaattagatgaatcaactagaaacaaactcagtggtcaaaataatttttaagagtattccgtaacctatattttacttttctgattatattaaggggctgccagcccggagaaatacttaagatatgggtgagaaatccccagacttttatacaaaagatttccactttcaaatcaatgtcagtagacattgataaaagtatagcagcatcctctactgaggtgatttcatttattccctgcagcccactgataaatatctcacttctcccaaatagtatgtggactcccagctaagcagaaaactattgtcattcaactgaagaagaggaagataaaagattgtcttgtttccatcactgtattacttgtgtaacatgattacataattcttatcctaagagaaagctttcatatttaaaaaaaagtcttttcagataaaatctgcttgtgtcttgaataatatgaaatacaaactttcactttattttattgtaaattataaagagattattgtcttaaataatatattgagttagcttcaagcttcctaaaatatgaagagattgttgtctaaagtcacatattgacattgagctcagtggcctgtttcatcacgtatgtgctgctacctgtacagcagacatgccgctccagtgacatttataatgacagaagcagggtaatggtcttgtgtttgacatgatcagttaggatcatagactttccctgactcgtagatattagccttgaattgggggaaaagaagactttgacacattttagttattttaataacagagatttactcttttgaaaaataaaggtatctaatgtctccctaataagtcttctttccttccaactaaatgacctacacggacttttattttcttgatcaaagaggtgtttattaaggacttctggataactatacttttactctatttttaaagatcacaaagtaattttaaatgtgaacaggttcccataccatgaatgctggcctcaccttctctatcatccacattttgaaatgcaaagaaagctcccttgtaagccatacttccttccccactcccatcctaggatacttgcccagtgctcattaggcatttcttattcagatagtccaaatttaggttattatgcttaatttgacacattaactaaatgcccagttttaaaatatatccatcaattcacgctgaaatgtgcttctttgtgctatcaaatggaatagaatacacttattttttaaacaatcccagaatactgtgtgtagacttttgttgtgctcaaataaatgtttacttatcttacaaagctcaaatactggattgtaaccatgtgatgaagttatctatgttgtacctaacattgcaaattaatcaataaatctctgttgtcagattgttga

SEQ ID NO: 463724 - DNA, 4915 bp, Homo sapiens
cggccatcttggctccaccctcgtagcaaatgtggagagtgtcctccaggtgtaggtagagtttcatatagtagcctaaaatgggtgaaaagagagttcatcctcagaaaactaaagaaaatgtctgctttgtgaatcttgatgtgaacaaggatgaatgcagcacagagcacctgcaacagaaactggtcaacgtttcaccagatcttccaaaacttatcagttccatgaatgtccaacaaccaaaagaaaatgaaattgttgtcctaagtgggttagcctctggaaatctccaggcagattttgaagtttcacagtgcccttggctgccagatatctgcttggtccaatgtgcaagagggaacagaccaaacagtaccaactgcatcatctttgaaatcaacaaatttctgattggtctggaactggtgcaggagcgacagctccacctggaaacaaacatcttgaaactggaggatgacacgaactgttccttatcttcaatcgaggaagactttctcaccgcttctgagcacttggaggaggaaagcgaggtggatgaatctaggaacgattatgaaaatataaatgtctcagccaatgttttggaaagtaaacagctaaagggagccacccaggtggaatggaattgcaacaaggaaaagtggctttatgctttggaagacaaatacatcaacaaatatcccacaccattgattaaaacagaacgatctccagaaaacctaacaaagaacacagccttgcagagtctagatccctcagccaagccatcacagtggaaaagagaagctgtggggaatgggagacaagccacacattattatcattcagaagcttttaaaggtcaaatggaaaaatcacaggcactgtatattccaaaagatgcttatttctccatgatggataaagatgtaccttctgcatgtgctgtggcagagcagagaagcaacctaaacccaggagaccatgaagacacaagaaacgctctccctcctagacaagatggagaagtcaccactggcaagtatgctacaaatttagcagaatccgtgctgcaggatgcatttattagattatctcaatctcagtccacattaccccaggaatctgcagtcagtgtttctgtaggaagttctctgcttcccagttgctattccacaaaagatacagtggtttctcggtcatggaatgagctccccaaaatcgtcgttgttcagagtccagatggcagtgatgctgccccacagccaggcatctcctcctggcctgagatggaagtctctgttgaaacctcaagcatcctctctggagagaactccagcagacaaccccagagtgctctagaagtggcgttagcttgtgcagccactgtgattggaactatttccagtccacaggccacagaaagactcaaaatggagcaagtggtctcgaactttcccccagggagcagtggtgcactgcaaactcaagcaccccaaggactcaaggaaccttccatcaatgagtactcctttccatctgctttgtgtggcatgactcaggtggccagtgccgtggctgtctgtggtctgggtgaaagagaagaggtgacatgctcagtggctccaagtggtagcctcccgcctgcagctgaggcttctgaagccatgcccccactttgtggtttagcaagcatggagcttggcaaggaagccattgccaagggattgctcaaggaggctgctctggttttaacaaggcctaatacctacagcagcattggagactttctggactccatgaacaggagaatcatggaaactgcttcaaagtctcagaccctgtgctcagaaaatgtcgtcaggaatgaactggcacataccctgtccaatgttatcctgaggcattccattgatgaagttcaccacaaaaatatgataatcgaccccaatgacaacaggcattcatctgaaattctggacaccttaatggaaagtacaaatcaactgcttttagatgtgatatgcttcacgttcaagaagatgagtcatattgtacggcttggtgaatgtcctgctgtcctttctaaggagaccatcagaaggagggagacagaaccaagctgccagccatctgatccgggtgctagtcaagcttggacaaaagccactgaatcctccagcagctctccacttagcaattcacacaacacgagtcttgtcatcaacaatcttgtggatggcatgtattcaaaacaagacaagggtggagtgaggccaggcctcttcaagaaccccacgctgcagtcacaattatcacgtagtcacagagtgcccgattcttcaactgctacaacatcctccaaggaaatatatctgaaaggaatagcaggagaggatacaaaaagccctcatcacagtgagaatgaatgcagagcctcttccgaaggacaaaggtccccaacggtcagccagtccagaagtggttcccaggaggctgaggagagtatccacccaaacacccaagaaaagtacaactgtgccacatctcgcatcaacgaagttcaagtcaacctgtccttgttaggggatgacctgctgcttcctgctcaatccacgcttcaaacaaagcatccagacatctactgcattacagactttgcggaagaattagcagacacggtcgtctccatggcaactgaaattgcagcgatttgccttgacaactccagtggaaaacaaccctggttttgtgcatggaaaagagggagtgagtttctgatgacacccaacgtaccctgccgatccttgaagaggaagaaagagagccaggggagcgggaccgctgtgaggaaacacaagcctccccggctcagtgagatcaagaggaagacggacgagcaccctgagcttaaagaaaagctgatgaacagggttgtggatgagtccatgaaccttgaagatgtcccagattctgtcaatctttttgccaatgaagtggcagccaagatcatgaacctaacggagttctctatggtggacggcatgtggcaggcgcagggctatccccggaatcggttactgagtggcgacaggtggagccggctgaaggcctccagctgcgaaagcattcctgaggaagactccgaggccagggcctatgtcaacagcctgggcttaatgagcacgctgagccagccggtcagcagggccagctctgtctccaagcagtcgagctgtgagagcatcaccgatgagttttccaggttcatggtgaaccagatggaaaatgaagggagaggatttgagttactgctggattactatgctggcaagaacgccagcagcattctgaactcagccatgcaacaggcgtgccggaaaagtgaccacctcagtgtgaggcctagctgtccctctaagcagtccagcacagagagcatcactgaggagttctacaggtacatgctgagggacatcgaaagagacagcagagaaagtgcctcctccagacggagcagccaggattggacagccggcctgctgtctccttctctgcgatccccagtgtgccacagacagtcgtccatgccagacagcagatccccatgctccaggctgacagtgaatgtgcccatcaaagccaactctttagatggctttgctcagaactgcccacaagatttcctaagcgtgcagccggtcagtagcgcgtcctcatccggtctctgcaaatctgactcttgcttgtatcggagaggtgggactgaccacatcaccaacatgttaattcatgaaacgtgggctagctccattgaggctctcatgcgcaagaacaaaatcattgtggatgatgcagaggaagctgacactgagcctgtttctggtggctctccctcgcaagcagagaagtgtgcaaatagattagctgcgagcaggatgtgcagtgggccaactctgcttgttcaggagtctctcgattgcccgaggaaagactctgttaccgaatgtaaacagcccccagtgtcatctttgagcaaaactgcttctcttacaaaccacagccctttagattctaaaaaagaaacttcctcgtgccaggaccctgtaccaataaaccacaaaaggcgatcactttgctcgagggaagtgcctttgattcagattgaaacagatcagagagaagcctgtgctggggaacctgaacccttcctttccaaaagcagcctcctagaggaagcagaagggcattcgaatgacaaaaacatcccagatgtggtgagaggtggagacacagccgtgagcgcttgtcaaatccatagtgacagccttgataccagagatgtaccagaggctgaagcctccacagaagccagagcccccgatgaggcccccaaccctccaagcagcagcgaggagagcacaggcagctggacccagcttgccaatgaggaagacaacccagatgacacaagtagctttctccagctcagtgagcgatccatgagtgaattagtagaagaaaagaagattcttaaaggacagtcagaaagcacagaggcacctgcatctggaccgcctacgggaacagccagcccccagaggagcctgctggtgatcaactttgacctggagccagagtgtccagatgccgagctccgagccactctgcagtggatagctgcctctgaactggggattcccaccatctactttaagaaatctcaggaaaacagaattgaaaaggtatcatgtaccaggtttggaaaacaagaaagctttgtgttttcatcaccactggaaactcagtaaatgctcagtaaacccctgtccatttgaattatttgatcctgactgttcttgatcttaaaattgcggctagaacattgaaatcttccacctgtgtaaatata

SEQ ID NO: 463725 - DNA, 6661 bp, Homo sapiens
cggccatcttggctccaccctcgtagcaaatgtggagagtgtcctccaggtgtaggtagagtttcatatagtagcctaaaatgggtgaaaagagagttcatcctcagaaaactaaagaaaatgtctgctttgtgaatcttgatgtgaacaaggatgaatgcagcacagagcacctgcaacagaaactggtcaacgtttcaccagatcttccaaaacttatcagttccatgaatgtccaacaaccaaaagaaaatgaaattgttgtcctaagtgggttagcctctggaaatctccaggcagattttgaagtttcacagtgcccttggctgccagatatctgcttggtccaatgtgcaagagggaacagaccaaacagtaccaactgcatcatctttgaaatcaacaaatttctgattggtctggaactggtgcaggagcgacagctccacctggaaacaaacatcttgaaactggaggatgacacgaactgttccttatcttcaatcgaggaagactttctcaccgcttctgagcacttggaggaggaaagcgaggtggatgaatctaggaacgattatgaaaatataaatgtctcagccaatgttttggaaagtaaacagctaaagggagccacccaggtggaatggaattgcaacaaggaaaagtggctttatgctttggaagacaaatacatcaacaaatatcccacaccattgattaaaacagaacgatctccagaaaacctaacaaagaacacagccttgcagagtctagatccctcagccaagccatcacagtggaaaagagaagctgtggggaatgggagacaagccacacattattatcattcagaagcttttaaaggtcaaatggaaaaatcacaggcactgtatattccaaaagatgcttatttctccatgatggataaagatgtaccttctgcatgtgctgtggcagagcagagaagcaacctaaacccaggagaccatgaagacacaagaaacgctctccctcctagacaagatggagaagtcaccactggcaagtatgctacaaatttagcagaatccgtgctgcaggatgcatttattagattatctcaatctcagtccacattaccccaggaatctgcagtcagtgtttctgtaggaagttctctgcttcccagttgctattccacaaaagatacagtggtttctcggtcatggaatgagctccccaaaatcgtcgttgttcagagtccagatggcagtgatgctgccccacagccaggcatctcctcctggcctgagatggaagtctctgttgaaacctcaagcatcctctctggagagaactccagcagacaaccccagagtgctctagaagtggcgttagcttgtgcagccactgtgattggaactatttccagtccacaggccacagaaagactcaaaatggagcaagtggtctcgaactttcccccagggagcagtggtgcactgcaaactcaagcaccccaaggactcaaggaaccttccatcaatgagtactcctttccatctgctttgtgtggcatgactcaggtggccagtgccgtggctgtctgtggtctgggtgaaagagaagaggtgacatgctcagtggctccaagtggtagcctcccgcctgcagctgaggcttctgaagccatgcccccactttgtggtttagcaagcatggagcttggcaaggaagccattgccaagggattgctcaaggaggctgctctggttttaacaaggcctaatacctacagcagcattggagactttctggactccatgaacaggagaatcatggaaactgcttcaaagtctcagaccctgtgctcagaaaatgtcgtcaggaatgaactggcacataccctgtccaatgttatcctgaggcattccattgatgaagttcaccacaaaaatatgataatcgaccccaatgacaacaggcattcatctgaaattctggacaccttaatggaaagtacaaatcaactgcttttagatgtgatatgcttcacgttcaagaagatgagtcatattgtacggcttggtgaatgtcctgctgtcctttctaaggagaccatcagaaggagggagacagaaccaagctgccagccatctgatccgggtgctagtcaagcttggacaaaagccactgaatcctccagcagctctccacttagcaattcacacaacacgagtcttgtcatcaacaatcttgtggatggcatgtattcaaaacaagacaagggtggagtgaggccaggcctcttcaagaaccccacgctgcagtcacaattatcacgtagtcacagagtgcccgattcttcaactgctacaacatcctccaaggaaatatatctgaaaggaatagcaggagaggatacaaaaagccctcatcacagtgagaatgaatgcagagcctcttccgaaggacaaaggtccccaacggtcagccagtccagaagtggttcccaggaggctgaggagagtatccacccaaacacccaagaaaagtacaactgtgccacatctcgcatcaacgaagttcaagtcaacctgtccttgttaggggatgacctgctgcttcctgctcaatccacgcttcaaacaaagcatccagacatctactgcattacagactttgcggaagaattagcagacacggtcgtctccatggcaactgaaattgcagcgatttgccttgacaactccagtggaaaacaaccctggttttgtgcatggaaaagagggagtgagtttctgatgacacccaacgtaccctgccgatccttgaagaggaagaaagagagccaggggagcgggaccgctgtgaggaaacacaagcctccccggctcagtgagatcaagaggaagacggacgagcaccctgagcttaaagaaaagctgatgaacagggttgtggatgagtccatgaaccttgaagatgtcccagattctgtcaatctttttgccaatgaagtggcagccaagatcatgaacctaacggagttctctatggtggacggcatgtggcaggcgcagggctatccccggaatcggttactgagtggcgacaggtggagccggctgaaggcctccagctgcgaaagcattcctgaggaagactccgaggccagggcctatgtcaacagcctgggcttaatgagcacgctgagccagccggtcagcagggccagctctgtctccaagcagtcgagctgtgagagcatcaccgatgagttttccaggttcatggtgaaccagatggaaaatgaagggagaggatttgagttactgctggattactatgctggcaagaacgccagcagcattctgaactcagccatgcaacaggcgtgccggaaaagtgaccacctcagtgtgaggcctagctgtccctctaagcagtccagcacagagagcatcactgaggagttctacaggtacatgctgagggacatcgaaagagacagcagagaaagtgcctcctccagacggagcagccaggattggacagccggcctgctgtctccttctctgcgatccccagtgtgccacagacagtcgtccatgccagacagcagatccccatgctccaggctgacagtgaatgtgcccatcaaagccaactctttagatggctttgctcagaactgcccacaagatttcctaagcgtgcagccggtcagtagcgcgtcctcatccggtctctgcaaatctgactcttgcttgtatcggagaggtgggactgaccacatcaccaacatgttaattcatgaaacgtgggctagctccattgaggctctcatgcgcaagaacaaaatcattgtggatgatgcagaggaagctgacactgagcctgtttctggtggctctccctcgcaagcagagaagtgtgcaaatagattagctgcgagcaggatgtgcagtgggccaactctgcttgttcaggagtctctcgattgcccgaggaaagactctgttaccgaatgtaaacagcccccagtgtcatctttgagcaaaactgcttctcttacaaaccacagccctttagattctaaaaaagaaacttcctcgtgccaggaccctgtaccaataaaccacaaaaggcgatcactttgctcgagggaagtgcctttgattcagattgaaacagatcagagagaagcctgtgctggggaacctgaacccttcctttccaaaagcagcctcctagaggaagcagaagggcattcgaatgacaaaaacatcccagatgtggtgagaggtggagacacagccgtgagcgcttgtcaaatccatagtgacagccttgataccagagatgtaccagaggctgaagcctccacagaagccagagcccccgatgaggcccccaaccctccaagcagcagcgaggagagcacaggcagctggacccagcttgccaatgaggaagacaacccagatgacacaagtagctttctccagctcagtgagcgatccatgagtgaattagtagaagaaaagaagattcttaaaggacagtcagaaagcacagaggcacctgcatctggaccgcctacgggaacagccagcccccagaggagcctgctggtgatcaactttgacctggagccagagtgtccagatgccgagctccgagccactctgcagtggatagctgcctctgaactggggattcccaccatctactttaagaaatctcaggaaaacagaattgaaaagtttctagatgtcgtgcagctggttcatcggaagtcctggaaagtgggtgatatcttccatgcagttgtccagtactgcaaaatgcatgaggagcagaaggatgggagactgagtctctttgactggctcttggaactgggataataaggcagtctgccgtatagatcattccttccctttattccaacttagattacagtggtttgttctaaatgctctaaacattctcaaaacatcacatcacattagcagaactataaaaaaaaatctgctactcagatccactgcatacagaataagtcagaggaaaagcaaaatataggtctgtccaaattcatacaacttgtgggtgagttccaaagagcttggattagaagggctggacaaagagagaattcaatggggcccaaattagaatgcttataatgagacccaatctccaggaaaacaacactcacataagtttaatcatataaaatgatttgtaatgtctctaattagatgaatcaactagaaacaaactcagtggtcaaaataatttttaagagtattccgtaacctatattttacttttctgattatattaaggggctgccagcccggagaaatacttaagatatgggtgagaaatccccagacttttatacaaaagatttccactttcaaatcaatgtcagtagacattgataaaagtatagcagcatcctctactgaggtgatttcatttattccctgcagcccactgataaatatctcacttctcccaaatagtatgtggactcccagctaagcagaaaactattgtcattcaactgaagaagaggaagataaaagattgtcttgtttccatcactgtattacttgtgtaacatgattacataattcttatcctaagagaaagctttcatatttaaaaaaaagtcttttcagataaaatctgcttgtgtcttgaataatatgaaatacaaactttcactttattttattgtaaattataaagagattattgtcttaaataatatattgagttagcttcaagcttcctaaaatatgaagagattgttgtctaaagtcacatattgacattgagctcagtggcctgtttcatcacgtatgtgctgctacctgtacagcagacatgccgctccagtgacatttataatgacagaagcagggtaatggtcttgtgtttgacatgatcagttaggatcatagactttccctgactcgtagatattagccttgaattgggggaaaagaagactttgacacattttagttattttaataacagagatttactcttttgaaaaataaaggtatctaatgtctccctaataagtcttctttccttccaactaaatgacctacacggacttttattttcttgatcaaagaggtgtttattaaggacttctggataactatacttttactctatttttaaagatcacaaagtaattttaaatgtgaacaggttcccataccatgaatgctggcctcaccttctctatcatccacattttgaaatgcaaagaaagctcccttgtaagccatacttccttccccactcccatcctaggatacttgcccagtgctcattaggcatttcttattcagatagtccaaatttaggttattatgcttaatttgacacattaactaaatgcccagttttaaaatatatccatcaattcacgctgaaatgtgcttctttgtgctatcaaatggaatagaatacacttattttttaaacaatcccagaatactgtgtgtagacttttgttgtgctcaaataaatgtttacttatcttacaaagctcaaatactggattgtaaccatgtgatgaagttatctatgttgtacctaacattgcaaattaatcaataaatctctgttgtcagattgttga

SEQ ID NO: 463726 - DNA, 1586 bp, Homo sapiens
gcagtctctggagagtgccctccttctgagctaggctgaggtgatgcgaggtttgtctttccctgcctagtgtgtttcatttaccataatgtcctccaggttccacagtgttgccacggatgacctgatttcagtacccgtgtctggctgtagagtatctggtcgtgactggatactgcagtttctggatctcatcctctgggggtggacaggtaggttgattccttatcttggctattgcgactggttccgcagtcagcgtgggaaggcagatgtgtcttccttttctgaggaacctcctgcctctgtagtgtgcgtaccaatttacctgttaacagttgtggataagagagctctcctctttggaaattcacagcagcattttgtggtttcccttcttttaagatacatgaaggtctttgttatactcattccaccgagagagacacagtatctgagtcttgttctgattttcatttttgtcatgattagtgattgaactgatgtccggaagtttgatggctgaagagtataccgttgtgcatatatccttcaattcctgcattttttaatctgtagaaagacaagtaggttgattccccatcttagttattgtccagagtacttcatgaaacatgagagggagatacctccttaagagaacagaccctcccagtcttcagtgcactctaaatactggctaattctggccaatggaaggcatctgtggaagagaaaagcctcaggtcatgtgctatctgtctttattcactgtgacatattaggtaatggtcacagccactcaccatggccccagtttttaataacatgaccctgcttttgtgttccagtaacttgtgttgttttcccagtcctaagtatgatagaaacttcctgctgctgctaatctctgggttccatttaaaatccttccatcacgtgaatactatgctgtgtactaaatttttccataattaaatacttagaattatttttgcctacttattttgccccttagtgatatgttttaaaaacacttaaaatgtgttacaatatatttagaaaaggtagggaatgacatttttactttcatcagcatttatgctagcatttatggagcaatgctatctaaagtatttttagtaatttaaacgttatataatacatatgcttttgattcctttgttactatgtaaataaatatatttgtgatattcagtaaatagtattgaatacatgtttcatgtatataatataaagttatgattttttttaaacagtacatcatatttgcttgttggctttatgataacttagaaataatattctggattaactgtgtgactcatgagagagtttgtgcaactatgtttccaaatttacttgattttcaagacttacactagaactgtgcgaacaagggaccaagtcatctaaattctttaccaaagcctgtgttgagaaaggtatttcctagtttttcttgtaggacttgtatagtttgcggtcttctgctgaaatctttcattcaccttgagttagtttttgcatcttgtgagaggaaacctgaagccaattatgttatg

SEQ ID NO: 463727 - DNA, 1336 bp, Homo sapiens
tgttggtattttttctattgtgggctccagaggcactgctaaaggttttaaaaaccattctaagtcacctgcatgccttttgatgccacaccatccatggccaccttagaagaaagattagtcccagagagcaacagcctggtgcagactgtggtcatccgtgggaatgttcctcctgcatcggcgggacctgcattgccccagtgtgtggccacgtgctcctctgggctcatacagatgtctgtactcagaggacgccactgtgccatcctctttggaccatatgtacttccttggactgggtccttccttcctgacatggatatcatggttacttgcagccctgatgactacccgaaaggcactggggtggacatcgaggacaaagcagtcaatctgacagcttcttgcactcaggtgctcagagtcaaggaaggtgacgccggcccaccgaggcttggattcggcttatgtggaggaggggcaggggtggtggtgaagctgcaacttggagaacaaacagaaacagcaataggccagtcacaaggaaatgcactcagacaattttgcaataatccggttgagaactgtgtctatgaaaccagctgcatctgtctcatagagtgcatgttcctatattacttcacccagccgaacatctgctggtgccatcctgaggggtgctagaagctcccgtgtactctgcaggcttctacctccgagagaccaagacctgcctctggactttgcctccaaaggtttaaagcagtttttgcctgcatgtcctagacgttcagtagaaaaagatctcctcgtgctccagcacctttggggaaaccagaggctccacaatgctcagcagtttaatttactgcaggtcttctcaacatctttaattcacaatatatattgtgaatctgcaagaaggggtaagagggtgaatagtccatttcccacacccatttgaccacggaacttcctccacttctggccttggtagaggctcctcccctggggaagaggaagcacagctaagggcccagcctcgcctggaggagatgctgaagggcagccaagcttggtctcctagactttaggggtaggcgggtggttcgggataaggatcagcaatgtctggatttgcctagggcagtccgagctcacacaggttgccccagtataattataataaactccctcttttttctctccaaagggtcctggtttggggcatcaattctatgatcctggccatagtcaccgcagacctagggtcccgccacttggcattttgaagcccaaagagcagctcattgttagactctgcccctgccca

SEQ ID NO: 463728 - DNA, 2403 bp, Homo sapiens
ttgtaaaaacatccttttccgagatggttgacagagccaagctaagaagaaatggtttatattttcaagtaacacattcatttgggaactcctacacagaggatgaccataaggataatttcttgtacagtaaaatgtttttccttcggaccttccacacaaatccgcttatgtggaagccccaggaacctctcaaggcccagcttcagcctcaccttccctgtggtcttcttcaagcagacccataccaagctctctgtgctttggaaactgccagtgaggtgaagtggggaggcatcggagcgacagccacgttgtatgcctgctgcacgagccagaccgcaggacaatactcaatgagaggcaccaacatccatcctggctgagctgatgatggtgagaggccacagagccatgaaaatgacttggagcagcctccatgtattcctcagggttgaatcattgtgtgcaccacagagcatttgctttgtaaaaaagctaacactgtgaaaaatggggtaggcacttcctgttttgaccaggaacaaatgcaaaccagaccctgctcctctcaccaggcagagcttgctctttcaattcagagatatcttcaaggacccaattatgctgtggtgcggaatggagcatgtatgtaactgaggttcctgccaaagacatcatctcctggctgaatggcaagactggccaggacaccaggaaactgagactgattggacacacaagaatgtgagctggttccctcggcatagtctcagctctgagacgtctcttctccatcctagccctctggagatgtttgaggagccaactgttcacctgtcttgtctaccaagctcaaagttccttgttttacctgttcactgacttcttactgttgggaaacttccctcaaaacaaaggctgcctcctctttattagcccctgtgttctcagagagaaagatcttttagtctcattttagacactttcagtccttctacatgcagtggggcccccaacacttatacagtttctttcatcctgaccacagctgtgagggcagttgggccttggtggctcagtggtggccaattctgaacgcagtggacacgtgactgcctgggtttaaaactgacttcactgacaagtctccaacaagcactcaagtacccagaggaagagtgaaggcatgaactctaacctgttgtctacccaaatgggtctgctcttgtcagatctgtagacctcagaaggcattttcaggagtcttcgtgtattagtccattttcatactgctatgaagaaatacccaagactaggtaatttataaagaaaaagagatttaatggactcacagttccatatggctggggaggcctcaaaatcatggcagaaggtgaaggaggagcaaaggcacatcttacatggcagcaggcaagagagcatgtgcagggaaactgccctttataaaaccatcagatcttaagagacttactcactatcatgagaacagcatggaaacaacccactcccatgattcaattatctcccactgagtccctcccatgacgtgtggggattatgggagctacaattcaggatgagatttgtgtggggacacagttaagccacatcaccttaccttattgggaaaggtactgctgtttttctgtttgttccatggccttcagtatataattaaaaaaaattgtggaggcagcatcttgcccaggattagaactgtaggggagaaagatcatccttgggccagggtgagggtaagcagaatgaaggccctgggcataacttgaacacccgaggaacttgaacccaaggctggcacaaaagccagaaggtgttactctccaccagctcagggattgtgaagatctctgtgcagactccactctgcggttggacagcatccctgagacatgcattttggaaattgtgatcaaccagaatccagaacacgctgtgcttaatggagtgaactgcctgtgaagcgcaggtgtgaggggcggatgataagtgacagtgccggtgcccccagcgcccttttacctgatggctcacccggcctacagctgcgcccttccctttgaatcgtcttgggtaacgggtgctgctttggaaatgcctggaaggtcatgtcctttgtctggggatggcttccagctgtggttgactgatagcagggggcacagaaggccagacacaacttgcctcaggtgggccgactctgagggtttgttcggcctccacgtggacttcagctgagcctgcatctttgcttggcttttcccactggcctattctgcttccctctccttaagggttctcccaggagaactcccttaataaatcacttgcacaaggatccctgtcttagcctttgcttct

SEQ ID NO: 463729 - DNA, 439 bp, Homo sapiens
cacagagccatgaaaatgacttggagcagcctccatgtattcctcagggttgaatcattgtgtgcaccacagagcatttgctttgtaaaaaagctaacactgtgaaaaatggggtaggcacttcctgttttgaccaggaacaaatgcaaaccagaccctgctcctctcaccaggcagagcttgctctttcaattcagagatatcttcaaggacccaattatgctgtggtgcggaatggagcatgtatgtaactgaggttcctgccaaagacatcatctcctggctgaatggcaagactggccaggacaccaggaaactgagactgattggacacacaagaatgtgagctggtgagacagtgggacacaggactaagcaaattatgtttctcttctgccttctgttctttgtcactaatgtaacaatagagtaataatac

SEQ ID NO: 463730 - DNA, 769 bp, Homo sapiens
taaaggggcagtgatgtgctggctttgtgtccgctgctctacgtgctagttggtgcatgcctgcctttcctggggatgagggctgcctccttcggttcaccagctgccgtgtgctatatcgtgccaatgataatgaagatcccccagaagacccccagaactttgcttcacctccacactcctctcaagaatcctttgggatggaccggacaagtggggcagtcagtgttgactcagtcccttcttacagtgctcatacgcggcccgtctggaaacctactacaaattatacttcaaattggatatcacggttgatcatgtgtttacttccaaatccacgtcagatggaaatctggcattgcaaatgtgacttgctatctgcttcagagtctgccaatactctatcatccttccaagtgttctctattttcccagtacctgagcgacttgatctgaagtcaattacagaactgttgagcctgaactcctatgggcctgtctaccattcataacccaaaaccccttaatcttcccccagtcgactcctttgctaaggccaagtctacaacgtgatcaacactgccctctgggcttctccttctcctcaccccatgggtggagatttgctagccttaagggtattaaagaacagatgttcaccttcctccttccagcctgtttccccttcaaatttctgtagaacaagctggagttgttctgtcctattaccccaacagagacgttataaatttcaaccaagttccaggac

SEQ ID NO: 463731 - DNA, 953 bp, Homo sapiens
gcaccgtggatttttgtcaggctcaaatttaaagcacaagaggccagatacacagtgacgctgaaagatctggtatgagctctcttcaaagaagatcaataaccatggtgtcctcaaattcttcattcatatcttctaactggcttcgggatgacatcatcacatcttcaaagatgggctcagcatcttcctccattagaccccgactggttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaat

SEQ ID NO: 463732 - DNA, 923 bp, Homo sapiens
  misc_feature (19)..(19): n is a, c, g, or t
ttgatgttgatgccttgtntaatctccgggatttcttcaactacctgcccctgagcagtcaggacccggctcccgtccgtaagtgccacgatcccagtgaccttctggttcctgagcttaacacaattgtccctttggaatcaaccaaagcctacaacatggtgtacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaat

SEQ ID NO: 463733 - DNA, 1827 bp, Homo sapiens
gccaaggaggtctccgaggcttccaaagagagcagtgttaactccacaccaggggacaaaggaccagggatcaagggcaaggcgagctccatgtgggccaaagagggtcagggtacaaagaagccctggaggtttctgcagacgatgcggctggggcggagcccgtcttacctgagcagcccccagcaaggcagccagcccagcgagtccagcggtggcgactccagagggtgagctgagggcaagctcagagcccagggtgagtcatttcctgtctccatggattgatggaccctgagagaggtggtccctccaggctcggcaaggccacaggtgtcaaaagcatcaaagcacagaacatcagtcacggtcactacgtgggtgaggtggtctcatatggttatcaggacattttcctgatgacaaatctgaatacatttcatacatatcatttttttgtgaagtgtctgatttctgtacatttttgttggattattggcctggttcttatggttacctattggttctctatgtattctggggaccagcccggtgtggtgtggtacacgtatcttcttccagtttgcatcttgccttatttctatttatttatttattttgagatggagttttgctcttcttgctcaggctggagtgcagtggtgtgatctcagctcaccgcaacctccgcctcccaggttcaagcgattctcttgtctcagcctcccgagtagctgggattacaggcatgtgccaccacacccggctaattttttgtatttttagtagagacggggttttgccatgttgggcaggctggtctcaaactcctgacctcaggtgatccgcccgcctcagcctcccaaagtgctgggattacaggcatgagccactacacctggccaccttatttctgttcactattgtcttttgaagaacaggaattcttaattttagtgaagccaaatttaccaatctttaattttataattgtgtggccacgccttgtggtgaagaccagccaccactggggcatgctgctgcgccacgcacaggctgctgttaacgttgcccaccatgacgccctgctggctacatccatctggagggtggattatcagaaaggcatcgtatgggccagcagcgccctgcaggcagccggctctctcatcttccctgccaaaacctgtgggttgcaggaaccacagctgtacttcacggagccccagcagctcctggatgtcttccgagagctggaggagcagaacctgtcgctgatccagaacagccaggagacggagaagaccctggaggagctgagccacaccctgaaacacacccagatccgcatcactgggagccaagttggggaaacagcccacacccgtccgtggccctggcctggtccaggttgtctgaaaagctccgagcgaagctccgtttgtgggccggatcctggagagagggtggtggagctgggggtgggcagggcccaggcacccgtgcccaccctgaagcagcccatggctagagccaggcctctccaaggaccttctgccctaggcgccttctgctgctgccaagctcctgggaggcccttggagtggctggaggtccacagcgaccctgaccccccagttcatagcagcactaacatgcttcacacaggcaccgaaagcagtcatttgctcagaagggcctggaagctgctgctgcttcatatttcgtagaccactgagcgggtgttcgcggcacagaactggggaaggccaagccacctgtgggctgctgtgaagtgtgtcccctgctgttgttcagcagcataac

SEQ ID NO: 463734 - DNA, 782 bp, Homo sapiens
aagtggagatgatggagcaggtacatggctgaaaacctgtttatccatgtgtttctcactccccttcccccttctatctctcctaattatggagtccaggccactatctccactggtccagatcactgtcctagcattctaaatgaactgtcagctcctatttgtgtcttccagcagtttacactctacttaatagcaggagtgaccctgttgaaacacaagcgagtttgtgtcacctctctgctcaaaccatccagcggctcttcattcttttcagagaaaatcccaattccttatggtgaccacaaggttccacccctcagccttcagcatgagaacagggacatcagcctgctttgcccatggaactgtctccagagcctacaacaatgctcagcctatgagaggtgtctcctagaagactttccatttcaacaagcctcatttatatgcaactggcaatttctctaaacagaagaaaaggggagattttgccaatcaattggcttcaccatcccccagccccaaagtgtgtttaagaacatttgcctgtgcatgcatgtgttttcctttgcatcccacaagaggaagggtctcgctctgtggcccaggctggagagtatggtgcaatcaaggctcactgccccatgttcaagccatcctcccacctcagcctcccagatagctgggactagagacacacatcaccacgcatggctctgggttacttcaataagtatttttcaataaatatttcttcaataaatatttaataacacaaa

SEQ ID NO: 463735 - DNA, 1111 bp, Homo sapiens
gacacaactttctgaccagcatcttttggaaatggagtactgctgtggaagtagaaagggaattttcctatcattagggacctacagtgtgatgccaaagctggaagcctttatacatatctctactgccttttcaaatggtaacctgaagcacatcgatgaagttgtttatccgtgccctgtggagccaaaaaaaaaatcgtcgattcccttgagtaattggtcaaataaagggatcaaggtagccaataaagagaggcggaaagtgagtgtgaggtggtgtcctacaaagcggacactgggctcacacacagcgcacacagggtttacagcaggtccactcggcagtaatacaggagatgggctgtgcgttcagcagttggtttcaccacctggtactgattctcttgccaccaagctctccagtgcatcctggactgtgcgtattttgtcagactggatatccaactgcaacgtgaaaaatggctgcaaagtggcagattcttttgcactctgctggtggtacattgtcgggaaagcaaccaatgcctggctacaggatcccctgaaactggaacaagcccttctttgacttcaacctgcttttcagaaaccaggggagatatagcgggaggggaatacttagcttccacataggccaccggccaggaggaagagggcttagaatcgtgaaagagactggtccaggacctgggctggctgacaggaagggtgcctgatgcagagcccgtgccgtcagcaggaggtagtttatccccagcttgtgtgccacacagaactgttccactgcatggaggaagctcaactgaagatcgaggagtcacaaagaactgattgaattcatcagggctaaaatctccaaaaatatactgcgggctgtggagggccatggctgccggtttcaatgggactcggcgctcctccggctgctcacgctgcctcccccgccgccgccatcttctcccccgcacatacacccatctatgactatttcaataactcctataacagatggaatttttgcaagttttagaataacaaataacattaaaaatccttatgaataaacattaatttacctaaatgcagg

SEQ ID NO: 463736 - DNA, 810 bp, Homo sapiens
gcttcatggaagaaatgatatttgaagtaggcacaagaagtatgtttaatatgcacaactattatgacaaggcctgggagaagttactgtttggagtttgtttttttcatgcccttgtgcaagagagaaagaaatttggtcctcttggttggaatattccatatggatttaatgaatctgacttgcgcatcagtatccgacaactgcagttatttatcaatgaatatgatacaattccatttgaagctatatcttacctgactggggagtgtaattatggaggaagagtgacagacgattgggacagacgtcttctattaaccatgctggctgacttttataatctgtacatagttgaaaaccctcattataagttttctcccagtggaaactattttgcacctcctaaaggcacttatgaggactacattgaattcattaagaaacttccatttactcaacaccctgagatatttggattacatgaaaacgttgacatctccaaggatcttcaacaaacaaaaaccctctttgagtccttgctcctcacccagggaggctccaaacagacaggagcctcaggaagtactgatcagattctgttagaaattaccaaagatatcctcaacaagctccctagtgatttcgacattgaaatggcactacggaagtatcctgtgagatatgaagaaagcatgaatactgtgttagtacaagaaatggaaagatttaacaagtaaggatctatatccccagtgattcagaaggcaactgtcttcttatattaataagaaaaataaaatagtgttg

SEQ ID NO: 463737 - DNA, 3186 bp, Homo sapiens
ccgggtgcctgccctccttgcaggccacagtagacaggccagtgcacaggctggggcagctgactggctggctgcaggggggcagctggacggcaccctccttggtctcccagtctgctcacgctgctgtggccccccaagggtgccaagacgctgtccctgcctgcagtgcccactctgctctccactgagctgcagacaggactgccaaagtcccgggagaccagtttgagagaatgcttttagattttccagattgccaggagtaaatcagcttttaggacttggaaagcccacacgacgtggtcaccttcctcacatgcgtcacggtggcctgcaccatccacagctggtgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgcaagcgacctgctgccttccttcccactgcttgtcttcagtgtgcccggctgggcaggggtgcggtggtggtggccgatgaggacaggaaagggagatagccagggcgaggtggggcgagggctccttcccccaagcaacaccgcccagccctgctccaggcccctgcactccgcccacccctaccctggctgcacctgagcttgctgcccccggggatgttgcccagtggctgtgcactgctctgtgcacgtgcgtgtgtgtgagtgcacttgtgtgtgggtgactaagtggatgcatgtgtgtgcctgtgtgagtgagggtatgtgcacctaagtgtgtacatgtgtgtatgttgtgaaagtgtctgtgcacatgaatgtttgtgtgtgtgtgaactctttcttactgctggaagtcacagaattcatattgctgcccgggttggtgtggccacctttccctttgtccaagactccacatggaaggcatttgagctcgacctccgaaaagctacccagcaaagagcagtctgtgcctctgagcagaccgtgagaactcaggggacgagtggctaagagcatggcctctcccagaacccacccagggtggtgtggtgggggcaacaggggccagactcctctagagggagggtggctctggggccctggaaaacgtgagagactgccctgagctggtccagtgggccagcactttataccaactcagcatttaagggaagtatcttagattgcctccatctcaatgtgaatgcaccaggctgagggttccctagcgccttgagtcaaggccacttttcagcccatcgagccctgagttctacttggtgtttgttctctggagctgattgcacttgagctctgtggtgggcaggcgcactttagcctaagttgggtgccccagggcaccccctcctctctgctccttgccagcttcattcactcccagcctctcgctgtcctcactttgcaggggctcctcctcaacatttgcatgcacctgcaagaattgggaagaaagagcatttattaggcactgtagcaatttgcattttaaaatgcctgagcatttattaagcttcttggtattcacttgggtttgataattgatctgagctacctcattgaatgtttttggaaaggtgttttttggtatgcaagtcagctttgcctcacagttgaaaatgttcggtcatgattgcttttgaaaccaaaggggaaggtaccgatatcattgagctatttaaagttgccagtttgggctccagtaatgctttctggtgggtaaaattccacattcaggccacgagagcatctacagtttgtactctggggctgcaggcatcctgggacgctgtacgcaattcagtggtctagtcctttataccgactcagattccttaagcatgcagagtcactcgaatgaaaaaacatactcgacctctccctaaaaagatgttgcaacccagtttctctgaattccaccacaaaaagagaccctgaataagaagagcagttttcctgtgcatatagagggtgtgtcaaaggtgagctttttggggaccgggaaaaacaaagttgcctgattccgcgcaggtgcacaggccccggatgtacacccggaaaggggagtgtggctgtagaatcatccatccgtctacagctaaaacaatttgccaataaagtacatgtttttcctaagccaaaaataaatacgttaacagaaaaatgatttaggatatagcttgaatgcttaaatatgtgcacctttacaaacctctcagtgtattcttggagttcttgaaatgttgttttaatatttgttgccagtaatgttctttcttcacagccgctccaggaattatgaagttctgggcctttctcagaagactgtaatgtacctgaagtttttgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagttt

SEQ ID NO: 463738 - DNA, 8139 bp, Homo sapiens
caaaatgtgctttgaggtaggaagggacctcctgtagagcggctttggcatgaggtcgacccgccctggggtggctccttttccctgtgttggcttggggccactgccccttcatgtttggctcacatggtccagaagcatcagggctcttttaacccagaatagtcaagccttggtttccttacccctgcagttttccagagcagctaaaaaacatccaagctggcaaaccattcttcctactccaaacattaggagcttttaccagtaagcaaggggtgggaagcttttcctttcttgaagatgctgccagcgtagtttcccttgtagctgccatcctgggtgcatgacttgcaaaactgatatgtgagtgacaataagccagatggcctttgcaaaagctctgcttattttgatttttgtggttccttacaaaaggcgaagtgagcattgatctttgttggtgctgttgtagctcaacggcaacatcactgtgttgtttcctcattttatttttcctaaaacctttacccattatctgcagattttcacatctaagcaaaataggttcatatgagtccagttacctagacaattaataaaaaagagcaaaatgttgagtgactatgtcataggttacttattgttaagttacagctttgtaagcagcttgctttgtaaatttttcatcccctgatggatgctgattttagaaggtgagagacgtgttagaaggatgtgaatatcgttttatttattggccataattaagtgcctttgggctttttgggtacagggttaaactacagctcaacatttaaatcaaatccaaccataaaattctcttaagtacaaaaaaaccagatgaccaacctcagggagaacccaagaaaaggtgggctttcccagcattgctgtgcagcattctgagaatacagcttgatttttctacatctttgcatgggcaacagtggtactgggtcctgtctcttgggacaagtttcactgtgattttaaatttttgtttcaacttggattcttcacgattgaccgtcaagttgaaatcctggttttgactttcactactgtgggatgtgcacaggaagttttccaccaaattttccacgtcgttcccctggcttgtttaatgagagcttggatttcagttttactccaacacctaaatagcctgggtctctaccagcatgccactagggttttacttcatttcagcctcctgtgggcattggacacccggcactctgtgagggtaacatgaaagataggcccttttcttacccaagctgatgtctgaagtacccgttttcacatgactcggaattaggaattgccgtcagataacactgggctcttctcactcaccctttgcacttggagtttttgttttactgtttccttaacctgtcacagtcccttaattagaatgtattgctagaggacagggtgcgttgtccaactttgtgcgcattttatagaaacacacaaaatcaccagacaaagcagctgtagtgtgaactcatccagatgcgatactgaaattccccagaggggcatcttcattgttttctttctttgttccagaagcaaaggccgataatgaaccgagctgttcgccggcagctcaagaactgttgacaaggctgggatttttactgggagaagggatcccaagtgccacacacataaccattgaagacaaaaatgaaaccatgtgcacagctctgagtcaaggcatcagtccttgctccacactaacaagcagcaccgcatctcctagcaccgatagcccctgctcaaccttgaatagctgtgtcagcaagacggcagccaacaaaagtccctgtgagaccattagcagccctagttccaccctggaaagcaaggacagtggaattataggtaagaagcacactgctcggtaacataatggctcgaatctcatcaaccagagcattcaccaggcacttcctcagagggttttagcatggtctgtgaaggtcagtctgccagcgcctgctctgttctttgcaggcagcactgactccatgtgtagctgagagagtggagcattggcttttacattccttgatgtttactttataacagtcagctcatttgttaaaaaaaaaaaaaaaaggaattccagatcagatctggcctgtgaaacaaaaatcattgctcttctatattcagttccatttgttgggcatcaggtcccactggggcacacagcagagcaatgaaattcctgcatattaagacgtcgtcttatcccaatctcaaggtggtggcctaccactactgccaggctgacaacacgtacacttgcctggtgcccgagtttgtgcacagcatcgcagctttgctctgccggtcccatcagctggccgcctacagagaccttctgataaaggagccccaactacagagcatgctgagcctccgatcctgtgtgcaggacccggtggcagctttcaagaggggagtgctggagccactcacaaacctgagaaatgatgacttcccagacaacaaagacatccacagtgacctgcacgcctacgtccagcacagggtgcacagcagccaggacatcctcagcaacatctccctgaacggcaaggccgatgccacactcattggaaaagtgagcagccacctggtgctgcggagcctcggctcctacctgtacctcaagctcaccctggaccttttccagaggggccacttggtcattaagagtgccagctacaaggtggtgcccgtgtctctctctgagctctatttgcttcagtgcaacatgaagttcatgacccagtccgcctttgagagggcacttccgattctcaacgtggccctcgcatccctccaccccatgacagacgagcagatctttcaggctattaatgctggccacatccagggggagcagggatgggaagactttcagcagaggatggacgccctctcctgcttcctcattaagaggcgagacaaaacccgcatgttctgccacccgtccttcagggagtggcttgtatggagagcagacggggaaaacacggccttcctgtgtgagcccaggaacgggcacgcgctcttggcattcatgttctcgcgtcaggagggcaagttgaaccgccagcagaccatggagcttggccaccacatcctgaaggcgcacattttcaaggcattctttgtgtgtgaccccgtgccttctgcaggtatctgcaccctctgcggcagacccactttcagagtgaccctgcagggcctcagtaagaagacgggaatttcttcaagccatctccaagccctgtggatcggctacagcaccgaggggctgtccgccgccctggcctctctcaggaatctctatactcccaacgtgaagtctcaccttggccacgaggaagttgtcactctgctcctggaatttggtgcctgcctggacggaacgtcagagaacggcatgactgccctctgttacgcagcagctgctggccacatgaagctggtgtgtctgctgaccaagaagggagtgagagtggaccacttggataagaagggccagtgtgcgcttgtccacagtgccctacggggccacggtgacattctccagtacctgctgacttgtgagtggtcgccgggtcctccccagccaggcaccctgaggaagagccacgccctgcagcaggcgctgaccgcggcggccagcatgggccacagctcggtggtccagtgcttgctggggatggagaaggaacatgaagtagaagtcaatggcaccgacacattgtggggagaaacaggtccacaagaccaggactgcctgctgcccacgcttactccctcactttccggtgacgaggccccagatagaacgcagagctcaggtgatccacgggagagatgtggctacctctctgtgacatgtgaagagacatgtagtgttctgctgattgactatgccactttcttgaagcttgctaatgatgatgatgatggttgtttggattgtttgcagcccggggtgcggctccctggcatggggaccacaccttttgaaggcctgttcttgtgttgccccattttcagcctgagagccctgactgccgccgcaggaagagggaagctggaggtctgtgagctgctgctggggcatggagctgctattgttagactgctgttggaacgcggctgtgatgtgaacctaagtgacaagcaaggccggacgcccctcatggtggctgcttgtgaagggcacttgagcaccgtggaattcctcctttcaaaagacaaagagggtctgtcagcattaagctgggcttgtctgaaaggtcacagggcagtggtccagtatctggttgaagaaggagctgcaatagaccagacagacaagaatggccgcacacccttggacctggctgccttctatggcgatgccgagactgtgctgtacctggtggagaagggagccgtgatcgagcatgtggaccacagcgggatgcggcccttggacagagccatcggctgccggaacacatctgtagtggtggcgctactcagaaagggagccaagttaggaatgcacttgggtttcgtttccttggcctcagtaatgagaagcaaatgcagtctgctcctctgcagcttcccaacactgttgctgctggcactgccgtccccggattcaggagagtccaacccaagcctattgtggtgggcctgccttctgactttggcatggcagaggaatttgcttccaaggctctcgaattgaagcccaagtcctatgaagccttttatgccagagcaagagcgaagagaaatagcaggcaattcgtggcagctctggctgacctgcaagaggctgtgaaactctgtcccaccaatcaggaagtcaagaggcttctggcccgcgtagaagaggagtgcaaacaactccagaggagtcaacagcaaaaacagcagggcccgctaccagctccactcaacgactccgagaacgaagaggacaccccaacccctggcttaagtgaccactttcactctgaggagactgaagaggaagaaacttctccccaggaagaatctgtttccccaactcccaggtcccagccatcctcatctgtcccttcctcatacatccgaaaccttcaagaagggttacagtccaaaggaaggccggtatcgccacagagcagggcaggaatcggcaagtccctgagagagcctgtggcccagccagggctgctcctgcagccctccaagcaggcccagatcgtgaaaaccagccagcacctgggctctggccagtcggcagtgagaaatggcagtatgaaagttcagatctcttctcagaaccctcctccaagtcccatgccagggagaatcgctgccactcctgctgggagcagaacccagcatttagagggaacaggtactttcactacaagagctggttgtggccactttggggatcggctgggccccagccagaatgtccgcctgcagtgtggtgagaatggccctgcacaccctttaccaagtaagacgaaaaccacagagaggcttctgtctcattcctccgtggctgtggacgcagcccctccaaaccaaggtgggctggcgacctgcagcgacgtgcgacacccagcttccctcaccagctcaggctcttctggttctccatccagcagcataaagatgtcaagttcaaccagtagtttgacttcgagcagcagtttttcagatggcttcaaggtccaaggaccagatactagaattaaagacaaggttgtaacccacgttcagagcggtacagctgagcacagaccccgcaacacgccgttcatgggcatcatggataagactgcgaggttccaacagcagagcaatcctccaagccgcagctggcactgtccggcaccagaggggctgctgacaaacacgtcttctgcagctggcctgcagtctgctaacactgagaagccctctctcatgcaagtgggaggatataataaccaagccaaaacctgttctgtttctaccctgagtgcaagtgtccacaatggggcacaagtgaaggagctagaagaaagcaagtgccaaattccagtccactctcaagagaacaggataactaagactgtttctcatctgtaccaggaaagtatctccaaacagcagcctcatattagtaatgaagcccacaggagccacctcactgcagccaaaccaaagcgatcatttatagagtcaaatgtgtgaaccttaagaaagccccatttgtggaatttggaaacgtgtgttgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaacttaaaattttaagacagcccagaagacattaatgactctcacttatgaaattgtttggcttttgccactttcctccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacctttttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaatagaatgtgttttgcactaaatgagtcaatggataagtagagaacagcctgatgacagctatctctgttgcttttaatctttgttaccctagagggaatagtgaaaagcatattttatattaacactacaaaatgcttatttaatttcgttttataatttcagaataagggtgacagctgctagaaattccacaat

SEQ ID NO: 463739 - DNA, 4921 bp, Homo sapiens
caaaatgtgctttgaggtaggaagggacctcctgtagagcggctttggcatgaggtcgacccgccctggggtggctccttttccctgtgttggcttggggccactgccccttcatgtttggctcacatggtccagaagcatcagggctcttttaacccagaatagtcaagccttggtttccttacccctgcagttttccagagcagctaaaaaacatccaagctggcaaaccattcttcctactccaaacattaggagcttttaccagtaagcaaggggtgggaagcttttcctttcttgaagatgctgccagcgtagtttcccttgtagctgccatcctgggtgcatgacttgcaaaactgatatgtgagtgacaataagccagatggcctttgcaaaagctctgcttattttgatttttgtggttccttacaaaaggcgaagtgagcattgatctttgttggtgctgttgtagctcaacggcaacatcactgtgttgtttcctcattttatttttcctaaaacctttacccattatctgcagattttcacatctaagcaaaataggttcatatgagtccagttacctagacaattaataaaaaagagcaaaatgttgagtgactatgtcataggttacttattgttaagttacagctttgtaagcagcttgctttgtaaatttttcatcccctgatggatgctgattttagaaggtgagagacgtgttagaaggatgtgaatatcgttttatttattggccataattaagtgcctttgggctttttgggtacagggttaaactacagctcaacatttaaatcaaatccaaccataaaattctcttaagtacaaaaaaaccagatgaccaacctcagggagaacccaagaaaaggtgggctttcccagcattgctgtgcagcattctgagaatacagcttgatttttctacatctttgcatgggcaacagtggtactgggtcctgtctcttgggacaagtttcactgtgattttaaatttttgtttcaacttggattcttcacgattgaccgtcaagttgaaatcctggttttgactttcactactgtgggatgtgcacaggaagttttccaccaaattttccacgtcgttcccctggcttgtttaatgagagcttggatttcagttttactccaacacctaaatagcctgggtctctaccagcatgccactagggttttacttcatttcagcctcctgtgggcattggacacccggcactctgtgagggtaacatgaaagataggcccttttcttacccaagctgatgtctgaagtacccgttttcacatgactcggaattaggaattgccgtcagataacactgggctcttctcactcaccctttgcacttggagtttttgttttactgtttccttaacctgtcacagtcccttaattagaatgtattgctagaggacagggtgcgttgtccaactttgtgcgcattttatagaaacacacaaaatcaccagacaaagcagctgtagtgtgaactcatccagatgcgatactgaaattccccagaggggcatcttcattgttttctttctttgttccagaagcaaaggccgataatgaaccgagctgttcgccggcagctcaagaactgttgacaaggctgggatttttactgggagaagggatcccaagtgccacacacataaccattgaagacaaaaatgaaaccatgtgcacagctctgagtcaaggcatcagtccttgctccacactaacaagcagcaccgcatctcctagcaccgatagcccctgctcaaccttgaatagctgtgtcagcaagacggcagccaacaaaagtccctgtgagaccattagcagccctagttccaccctggaaagcaaggacagtggaattataggtaagaagcacactgctcggtaacataatggctcgaatctcatcaaccagagcattcaccaggcacttcctcagagggttttagcatggtctgtgaaggtcagtctgccagcgcctgctctgttctttgcaggcagcactgactccatgtgtagctgagagagtggagcattggcttttacattccttgatgtttactttataacagtcagctcatttgttaaaaaaaaaaaaaaaaggaattccagatcagatctggcctgtgaaacaaaaatcattgctcttctatattcagttccatttgttgggcatcaggtcccactggggcacacagcagagcaatgaaattcctgcatattaagacgtcgtcttatcccaatctcaaggtggtggcctaccactactgccaggctgacaacacgtacacttgcctggtgcccgagtttgtgcacagcatcgcagctttgctctgccggtcccatcagctggccgcctacagagaccttctgataaaggagccccaactacagagcatgctgagcctccgatcctgtgtgcaggacccggtggcagctttcaagaggggagtgctggagccactcacaaacctgagaaatgagcagaaaattcctgaagaagaatacattattttgatagatggcttaaatgaagctgagtttcataaacctgattatggagatacgctttcttcatttattaccaaaattatttctaaatttcctgcctggttgaagttgattgtgactgtaagagcaaattttcaggaaatcataagtgcgctgccatttgtcaagctttccttagatgacttcccagacaacaaagacatccacagtgacctgcacgcctacgtccagcacagggtgcacagcagccaggacatcctcagcaacatctccctgaacggcaaggccgatgccacactcattggaaaagtgagcagccacctggtgctgcggagcctcggctcctacctgtacctcaagctcaccctggaccttttccagaggggccacttggtcattaagagtgccagctacaaggtggtgcccgtgtctctctctgagctctatttgcttcagtgcaacatgaagttcatgacccagtccgcctttgagagggcacttccgattctcaacgtggccctcgcatccctccaccccatgacagacgagcagatctttcaggctattaatgctggccacatccagggggagcagggatgggaagactttcagcagaggatggacgccctctcctgcttcctcattaagaggcgagacaaaacccgcatgttctgccacccgtccttcagggagtggcttgtatggagagcagacggggaaaacacggccttcctgtgtgagcccagtgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaacttaaaattttaagacagcccagaagacattaatgactctcacttatgaaattgtttggcttttgccactttcctccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacctttttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaataga

SEQ ID NO: 463740 - DNA, 8359 bp, Homo sapiens
caaaatgtgctttgaggtaggaagggacctcctgtagagcggctttggcatgaggtcgacccgccctggggtggctccttttccctgtgttggcttggggccactgccccttcatgtttggctcacatggtccagaagcatcagggctcttttaacccagaatagtcaagccttggtttccttacccctgcagttttccagagcagctaaaaaacatccaagctggcaaaccattcttcctactccaaacattaggagcttttaccagtaagcaaggggtgggaagcttttcctttcttgaagatgctgccagcgtagtttcccttgtagctgccatcctgggtgcatgacttgcaaaactgatatgtgagtgacaataagccagatggcctttgcaaaagctctgcttattttgatttttgtggttccttacaaaaggcgaagtgagcattgatctttgttggtgctgttgtagctcaacggcaacatcactgtgttgtttcctcattttatttttcctaaaacctttacccattatctgcagattttcacatctaagcaaaataggttcatatgagtccagttacctagacaattaataaaaaagagcaaaatgttgagtgactatgtcataggttacttattgttaagttacagctttgtaagcagcttgctttgtaaatttttcatcccctgatggatgctgattttagaaggtgagagacgtgttagaaggatgtgaatatcgttttatttattggccataattaagtgcctttgggctttttgggtacagggttaaactacagctcaacatttaaatcaaatccaaccataaaattctcttaagtacaaaaaaaccagatgaccaacctcagggagaacccaagaaaaggtgggctttcccagcattgctgtgcagcattctgagaatacagcttgatttttctacatctttgcatgggcaacagtggtactgggtcctgtctcttgggacaagtttcactgtgattttaaatttttgtttcaacttggattcttcacgattgaccgtcaagttgaaatcctggttttgactttcactactgtgggatgtgcacaggaagttttccaccaaattttccacgtcgttcccctggcttgtttaatgagagcttggatttcagttttactccaacacctaaatagcctgggtctctaccagcatgccactagggttttacttcatttcagcctcctgtgggcattggacacccggcactctgtgagggtaacatgaaagataggcccttttcttacccaagctgatgtctgaagtacccgttttcacatgactcggaattaggaattgccgtcagataacactgggctcttctcactcaccctttgcacttggagtttttgttttactgtttccttaacctgtcacagtcccttaattagaatgtattgctagaggacagggtgcgttgtccaactttgtgcgcattttatagaaacacacaaaatcaccagacaaagcagctgtagtgtgaactcatccagatgcgatactgaaattccccagaggggcatcttcattgttttctttctttgttccagaagcaaaggccgataatgaaccgagctgttcgccggcagctcaagaactgttgacaaggctgggatttttactgggagaagggatcccaagtgccacacacataaccattgaagacaaaaatgaaaccatgtgcacagctctgagtcaaggcatcagtccttgctccacactaacaagcagcaccgcatctcctagcaccgatagcccctgctcaaccttgaatagctgtgtcagcaagacggcagccaacaaaagtccctgtgagaccattagcagccctagttccaccctggaaagcaaggacagtggaattataggtaagaagcacactgctcggtaacataatggctcgaatctcatcaaccagagcattcaccaggcacttcctcagagggttttagcatggtctgtgaaggtcagtctgccagcgcctgctctgttctttgcaggcagcactgactccatgtgtagctgagagagtggagcattggcttttacattccttgatgtttactttataacagtcagctcatttgttaaaaaaaaaaaaaaaaggaattccagatcagatctggcctgtgaaacaaaaatcattgctcttctatattcagttccatttgttgggcatcaggtcccactggggcacacagcagagcaatgaaattcctgcatattaagacgtcgtcttatcccaatctcaaggtggtggcctaccactactgccaggctgacaacacgtacacttgcctggtgcccgagtttgtgcacagcatcgcagctttgctctgccggtcccatcagctggccgcctacagagaccttctgataaaggagccccaactacagagcatgctgagcctccgatcctgtgtgcaggacccggtggcagctttcaagaggggagtgctggagccactcacaaacctgagaaatgagcagaaaattcctgaagaagaatacattattttgatagatggcttaaatgaagctgagtttcataaacctgattatggagatacgctttcttcatttattaccaaaattatttctaaatttcctgcctggttgaagttgattgtgactgtaagagcaaattttcaggaaatcataagtgcgctgccatttgtcaagctttccttagatgacttcccagacaacaaagacatccacagtgacctgcacgcctacgtccagcacagggtgcacagcagccaggacatcctcagcaacatctccctgaacggcaaggccgatgccacactcattggaaaagtgagcagccacctggtgctgcggagcctcggctcctacctgtacctcaagctcaccctggaccttttccagaggggccacttggtcattaagagtgccagctacaaggtggtgcccgtgtctctctctgagctctatttgcttcagtgcaacatgaagttcatgacccagtccgcctttgagagggcacttccgattctcaacgtggccctcgcatccctccaccccatgacagacgagcagatctttcaggctattaatgctggccacatccagggggagcagggatgggaagactttcagcagaggatggacgccctctcctgcttcctcattaagaggcgagacaaaacccgcatgttctgccacccgtccttcagggagtggcttgtatggagagcagacggggaaaacacggccttcctgtgtgagcccaggaacgggcacgcgctcttggcattcatgttctcgcgtcaggagggcaagttgaaccgccagcagaccatggagcttggccaccacatcctgaaggcgcacattttcaaggcattctttgtgtgtgaccccgtgccttctgcaggtatctgcaccctctgcggcagacccactttcagagtgaccctgcagggcctcagtaagaagacgggaatttcttcaagccatctccaagccctgtggatcggctacagcaccgaggggctgtccgccgccctggcctctctcaggaatctctatactcccaacgtgaaggtgagccgtctcctgattttgggaggggccaacgtgaactacaggacagaagtgttaaataatgccccaatcctgtgcgtccagtctcaccttggccacgaggaagttgtcactctgctcctggaatttggtgcctgcctggacggaacgtcagagaacggcatgactgccctctgttacgcagcagctgctggccacatgaagctggtgtgtctgctgaccaagaagggagtgagagtggaccacttggataagaagggccagtgtgcgcttgtccacagtgccctacggggccacggtgacattctccagtacctgctgacttgtgagtggtcgccgggtcctccccagccaggcaccctgaggaagagccacgccctgcagcaggcgctgaccgcggcggccagcatgggccacagctcggtggtccagtgcttgctggggatggagaaggaacatgaagtagaagtcaatggcaccgacacattgtggggagaaacaggtccacaagaccaggactgcctgctgcccacgcttactccctcactttccggtgacgaggccccagatagaacgcagagctcaggtgatccacgggagagatgtggctacctctctgtgacatgtgaagagacatgtagtgttctgctgattgactatgccactttcttgaagcttgctaatgatgatgatgatggttgtttggattgtttgcagcccggggtgcggctccctggcatggggaccacaccttttgaaggcctgttcttgtgttgccccattttcagcctgagagccctgactgccgccgcaggaagagggaagctggaggtctgtgagctgctgctggggcatggagctgctgtgtcgcggacaaacaggagaggggttccacctttgttttgtgcagcacgccaggggcattggcagattgttagactgctgttggaacgcggctgtgatgtgaacctaagtgacaagcaaggccggacgcccctcatggtggctgcttgtgaagggcacttgagcaccgtggaattcctcctttcaaaaggtgcagccctttcttctctagacaaagagggtctgtcagcattaagctgggcttgtctgaaaggtcacagggcagtggtccagtatctggttgaagaaggagctgcaatagaccagacagacaagaatggccgcacacccttggacctggctgccttctatggcgatgccgagactgtgctgtacctggtggagaagggagccgtgatcgagcatgtggaccacagcgggatgcggcccttggacagagccatcggctgccggaacacatctgtagtggtggcgctactcagaaagggagccaagttaggaaatgctgcttgggcgatggccacttccaaacctgatatcttgattatacttttacagaaattaatggaggaaggaaatgtgatgtacaaaaaagggaaaatgaaagaggcagcccagaggtaccagtatgccttaagaaagtttcctcgagaaggattcggagaggacatgagacccttcaatgaattaagggtttccctctatctcaatttgtcgcgatgccgaagaaaaaccaatgactttggcatggcagaggaatttgcttccaaggctctcgaattgaagcccaagtcctatgaagccttttatgccagagcaagagcgaagagaaatagcaggcaattcgtggcagctctggctgacctgcaagaggctgtgaaactctgtcccaccaatcaggaagtcaagaggcttctggcccgcgtagaagaggagtgcaaacaactccagaggagtcaacagcaaaaacagcagggcccgctaccagctccactcaacgactccgagaacgaagaggacaccccaacccctggcttaagtgaccactttcactctgaggagactgaagaggaagaaacttctccccaggaagaatctgtttccccaactcccaggtcccagccatcctcatctgtcccttcctcatacatccgaaaccttcaagaagggttacagtccaaaggaaggccggtatcgccacagagcagggcaggaatcggcaagtccctgagagagcctgtggcccagccagggctgctcctgcagccctccaagcaggcccagatcgtgaaaaccagccagcacctgggctctggccagtcggcagtgagaaatggcagtatgaaagttcagatctcttctcagaaccctcctccaagtcccatgccagggagaatcgctgccactcctgctgggagcagaacccagcatttagagggaacaggtactttcactacaagagctggttgtggccactttggggatcggctgggccccagccagaatgtccgcctgcagtgtggtgagaatggccctgcacaccctttaccaagtaagacgaaaaccacagagaggcttctgtctcattcctccgtggctgtggacgcagcccctccaaaccaaggtgggctggcgacctgcagcgacgtgcgacacccagcttccctcaccagctcaggctcttctggttctccatccagcagcataaagatgtcaagttcaaccagtagtttgacttcgagcagcagtttttcagatggcttcaaggtccaaggaccagatactagaattaaagacaaggttgtaacccacgttcagagcggtacagctgagcacagaccccgcaacacgccgttcatgggcatcatggataagactgcgaggttccaacagcagagcaatcctccaagccgcagctggcactgtccggcaccagaggggctgctgacaaacacgtcttctgcagctggcctgcagtctgctaacactgagaagccctctctcatgcaagtgggaggatataataaccaagccaaaacctgttctgtttctaccctgagtgcaagtgtccacaatggggcacaagtgaaggagctagaagaaagcaagtgccaaattccagtccactctcaagagaacaggataactaagactgtttctcatctgtaccaggaaagtatctccaaacagcagcctcatattagtaatgaagcccacaggagccacctcactgcagccaaaccaaagcgatcatttatagagtcaaatgtgtgaaccttaagaaagccccatttgtggaatttggaaacgtgtgttgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaatttggcttttgccactttcctccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacctttttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaataga

SEQ ID NO: 463741 - DNA, 7567 bp, Homo sapiens
agcggaggctttgctgtggcagctgctggagcggcggccgcctcgggagccggaggagaggcagccgcggagcgccgagctggcctcgccccgaggcccggccctgggtgtggggaaccgcgctgaggagctggaaactttcccggcaggagctgactgctgggcaggaacgtctctcaggagaaagagtggaagagaaaattgtgaactaaggccccctgcccccttttcctggtgcatgtgaagttatcaaaaacagaaacaagtgttgaaaatgttaaaggctgtgctgaagaagagccgagagggaggaaagggaggcaagaaggaagcaggaagtgactttggtccagagacttctccagtcctgcaccttgaccacagtgctgactctcctgtgagcagtcttcccacagcagaggacacctatagggtgagcttggccaaaggtgtctcgatgtctctgccttcctcacctttgctgcctcgacagtctcacttggtgcaatcaagagtgaacaaaaaatccccaggtcccgtcaggaagcccaagtatgtggaaagccccagagtgcctggagatgcagttataatgccattcagagaagtagccaagccaacagagcctgatgagcatgccacaattacaagttcatccgaaaatgatgaccggagtggctccagtttggaatggaataaagatggaagcctaagattaggggttcagaagggagtgcttcatgaccgcagggcagataactgctccccagtggcagaagaggagaccaccgggtcagcagagagcacgctgcccaaagcagaatcctcagctggagatggtccagtcccttattctcagggctccagctcactaataatgccacggcccaactcagttgcagcaacaagctcaaccaaattggaagatctgagttatttagacgggcagagaaatgctcctctacggacgtcaattagattaccatggcacaatacggccggaggtagggcacaggaagttaaagcacgatttgctccctacaagccacaagacattttgttgaaacccttgttgtttgaagtaccaagcataacaacagactctgtgtttgtgggaagggattggctctttcaccagatagaagaaaacttgaggaacacagaactggcagaaaacagaggcgcggtggtggttggcaatgtgggatttgggaagacggcaatcatttccaagttggtggccctgagctgccacggaagccgcatgaggcagattgcttccaacagcccgggttcatcacctaaaacctctgaccccactcaggatcttcatttcactccgttgctttcaccgagttcttccacaagtgcttccagcacagctaaaacacctcttgggtctatcagtgctgaaaaccagagaccaagagaggatgcagtgaaatatcttgcttctaaggtggtggcctaccactactgccaggctgacaacacgtacacttgcctggtgcccgagtttgtgcacagcatcgcagctttgctctgccggtcccatcagctggccgcctacagagaccttctgataaaggagccccaactacagagcatgctgagcctccgatcctgtgtgcaggacccggtggcagctttcaagaggggagtgctggagccactcacaaacctgagaaatgagcagaaaattcctgaagaagaatacattattttgatagatggcttaaatgaagctgagtttcataaacctgattatggagatacgctttcttcatttattaccaaaattatttctaaatttcctgcctggttgaagttgattgtgactgtaagagcaaattttcaggaaatcataagtgcgctgccatttgtcaagctttccttagatgacttcccagacaacaaagacatccacagtgacctgcacgcctacgtccagcacagggtgcacagcagccaggacatcctcagcaacatctccctgaacggcaaggccgatgccacactcattggaaaagtgagcagccacctggtgctgcggagcctcggctcctacctgtacctcaagctcaccctggaccttttccagaggggccacttggtcattaagagtgccagctacaaggtggtgcccgtgtctctctctgagctctatttgcttcagtgcaacatgaagttcatgacccagtccgcctttgagagggcacttccgattctcaacgtggccctcgcatccctccaccccatgacagacgagcagatctttcaggctattaatgctggccacatccagggggagcagggatgggaagactttcagcagaggatggacgccctctcctgcttcctcattaagaggcgagacaaaacccgcatgttctgccacccgtccttcagggagtggcttgtatggagagcagacggggaaaacacggccttcctgtgtgagcccaggaacgggcacgcgctcttggcattcatgttctcgcgtcaggagggcaagttgaaccgccagcagaccatggagcttggccaccacatcctgaaggcgcacattttcaaggcattctttgtgtgtgaccccgtgccttctgcaggtatctgcaccctctgcggcagacccactttcagagtgaccctgcagggcctcagtaagaagacgggaatttcttcaagccatctccaagccctgtggatcggctacagcaccgaggggctgtccgccgccctggcctctctcaggaatctctatactcccaacgtgaaggtgagccgtctcctgattttgggaggggccaacgtgaactacaggacagaagtgttaaataatgccccaatcctgtgcgtccagtctcaccttggccacgaggaagttgtcactctgctcctggaatttggtgcctgcctggacggaacgtcagagaacggcatgactgccctctgttacgcagcagctgctggccacatgaagctggtgtgtctgctgaccaagaagggagtgagagtggaccacttggataagaagggccagtgtgcgcttgtccacagtgccctacggggccacggtgacattctccagtacctgctgacttgtgagtggtcgccgggtcctccccagccaggcaccctgaggaagagccacgccctgcagcaggcgctgaccgcggcggccagcatgggccacagctcggtggtccagtgcttgctggggatggagaaggaacatgaagtagaagtcaatggcaccgacacattgtggggagaaacaggtccacaagaccaggactgcctgctgcccacgcttactccctcactttccggtgacgaggccccagatagaacgcagagctcaggtgatccacgggagagatgtggctacctctctgtgacatgtgaagagacatgtagtgttctgctgattgactatgccactttcttgaagcttgctaatgatgatgatgatggttgtttggattgtttgcagcccggggtgcggctccctggcatggggaccacaccttttgaaggcctgttcttgtgttgccccattttcagcctgagagccctgactgccgccgcaggaagagggaagctggaggtctgtgagctgctgctggggcatggagctgctgtgtcgcggacaaacaggagaggggttccacctttgttttgtgcagcacgccaggggcattggcagattgttagactgctgttggaacgcggctgtgatgtgaacctaagtgacaagcaaggccggacgcccctcatggtggctgcttgtgaagggcacttgagcaccgtggaattcctcctttcaaaaggtgcagccctttcttctctagacaaagagggtctgtcagcattaagctgggcttgtctgaaaggtcacagggcagtggtccagtatctggttgaagaaggagctgcaatagaccagacagacaagaatggccgcacacccttggacctggctgccttctatggcgatgccgagactgtgctgtacctggtggagaagggagccgtgatcgagcatgtggaccacagcgggatgcggcccttggacagagccatcggctgccggaacacatctgtagtggtggcgctactcagaaagggagccaagttaggaaatgctgcttgggcgatggccacttccaaacctgatatcttgattatacttttacagaaattaatggaggaaggaaatgtgatgtacaaaaaagggaaaatgaaagaggcagcccagaggtaccagtatgccttaagaaagtttcctcgagaaggattcggagaggacatgagacccttcaatgaattaagggtttccctctatctcaatttgtcgcgatgccgaagaaaaaccaatgactttggcatggcagaggaatttgcttccaaggctctcgaattgaagcccaagtcctatgaagccttttatgccagagcaagagcgaagagaaatagcaggcaattcgtggcagctctggctgacctgcaagaggctgtgaaactctgtcccaccaatcaggaagtcaagaggcttctggcccgcgtagaagaggagtgcaaacaactccagaggagtcaacagcaaaaacagcagggcccgctaccagctccactcaacgactccgagaacgaagaggacaccccaacccctggcttaagtgaccactttcactctgaggagactgaagaggaagaaacttctccccaggaagaatctgtttccccaactcccaggtcccagccatcctcatctgtcccttcctcatacatccgaaaccttcaagaagggttacagtccaaaggaaggccggtatcgccacagagcagggcaggaatcggcaagtccctgagagagcctgtggcccagccagggctgctcctgcagccctccaagcaggcccagatcgtgaaaaccagccagcacctgggctctggccagtcggcagtgagaaatggcagtatgaaagttcagatctcttctcagaaccctcctccaagtcccatgccagggagaatcgctgccactcctgctgggagcagaacccagcatttagagggaacaggtactttcactacaagagctggttgtggccactttggggatcggctgggccccagccagaatgtccgcctgcagtgtggtgagaatggccctgcacaccctttaccaagtaagacgaaaaccacagagaggcttctgtctcattcctccgtggctgtggacgcagcccctccaaaccaaggtgggctggcgacctgcagcgacgtgcgacacccagcttccctcaccagctcaggctcttctggttctccatccagcagcataaagatgtcaagttcaaccagtagtttgacttcgagcagcagtttttcagatggcttcaaggtccaaggaccagatactagaattaaagacaaggttgtaacccacgttcagagcggtacagctgagcacagaccccgcaacacgccgttcatgggcatcatggataagactgcgaggttccaacagcagagcaatcctccaagccgcagctggcactgtccggcaccagaggggctgctgacaaacacgtcttctgcagctggcctgcagtctgctaacactgagaagccctctctcatgcaagtgggaggatataataaccaagccaaaacctgttctgtttctaccctgagtgcaagtgtccacaatggggcacaagtgaaggagctagaagaaagcaagtgccaaattccagtccactctcaagagaacaggataactaagactgtttctcatctgtaccaggaaagtatctccaaacagcagcctcatattagtaatgaagcccacaggagccacctcactgcagccaaaccaaagcgatcatttatagagtcaaatgtgtgaaccttaagaaagccccatttgtggaatttggaaacgtgtgttgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaacttaaaattttaagacagcccagaagacattaatgactctcacttatgaaattgtttggcttttgccactttcctccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacctttttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaataga

SEQ ID NO: 463742 - DNA, 1058 bp, Homo sapiens
acccaacgcgtcgcccaccgcgtcggttcttattcatatatttttatagcacctttttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaataga

SEQ ID NO: 463743 - DNA, 5902 bp, Homo sapiens
caaaatgtgctttgaggtaggaagggacctcctgtagagcggctttggcatgaggtcgacccgccctggggtggctccttttccctgtgttggcttggggccactgccccttcatgtttggctcacatggtccagaagcatcagggctcttttaacccagaatagtcaagccttggtttccttacccctgcagttttccagagcagctaaaaaacatccaagctggcaaaccattcttcctactccaaacattaggagcttttaccagtaagcaaggggtgggaagcttttcctttcttgaagatgctgccagcgtagtttcccttgtagctgccatcctgggtgcatgacttgcaaaactgatatgtgagtgacaataagccagatggcctttgcaaaagctctgcttattttgatttttgtggttccttacaaaaggcgaagtgagcattgatctttgttggtgctgttgtagctcaacggcaacatcactgtgttgtttcctcattttatttttcctaaaacctttacccattatctgcagattttcacatctaagcaaaataggttcatatgagtccagttacctagacaattaataaaaaagagcaaaatgttgagtgactatgtcataggttacttattgttaagttacagctttgtaagcagcttgctttgtaaatttttcatcccctgatggatgctgattttagaaggtgagagacgtgttagaaggatgtgaatatcgttttatttattggccataattaagtgcctttgggctttttgggtacagggttaaactacagctcaacatttaaatcaaatccaaccataaaattctcttaagtacaaaaaaaccagatgaccaacctcagggagaacccaagaaaaggtgggctttcccagcattgctgtgcagcattctgagaatacagcttgatttttctacatctttgcatgggcaacagtggtactgggtcctgtctcttgggacaagtttcactgtgattttaaatttttgtttcaacttggattcttcacgattgaccgtcaagttgaaatcctggttttgactttcactactgtgggatgtgcacaggaagttttccaccaaattttccacgtcgttcccctggcttgtttaatgagagcttggatttcagttttactccaacacctaaatagcctgggtctctaccagcatgccactagggttttacttcatttcagcctcctgtgggcattggacacccggcactctgtgagggtaacatgaaagataggcccttttcttacccaagctgatgtctgaagtacccgttttcacatgactcggaattaggaattgccgtcagataacactgggctcttctcactcaccctttgcacttggagtttttgttttactgtttccttaacctgtcacagtcccttaattagaatgtattgctagaggacagggtgcgttgtccaactttgtgcgcattttatagaaacacacaaaatcaccagacaaagcagctgtagtgtgaactcatccagatgcgatactgaaattccccagaggggcatcttcattgttttctttctttgttccagaagcaaaggccgataatgaaccgagctgttcgccggcagctcaagaactgttgacaaggctgggatttttactgggagaagggatcccaagtgccacacacataaccattgaagacaaaaatgaaaccatgtgcacagctctgagtcaaggcatcagtccttgctccacactaacaagcagcaccgcatctcctagcaccgatagcccctgctcaaccttgaatagctgtgtcagcaagacggcagccaacaaaagtccctgtgagaccattagcagccctagttccaccctggaaagcaaggacagtggaattataggtaagaagcacactgctcggtaacataatggctcgaatctcatcaaccagagcattcaccaggcacttcctcagagggttttagcatggtctgtgaaggtcagtctgccagcgcctgctctgttctttgcaggcagcactgactccatgtgtagctgagagagtggagcattggcttttacattccttgatgtttactttataacagtcagctcatttgttaaaaaaaaaaaaaaaaggaattccagatcagatctggcctgtgaaacaaaaatcattgctcttctatattcagttccatttgttgggcatcaggtcccactggggcacacagcagagcaatgaaattcctgcatattaagacgtcgtcttatcccaatctcaaggtggtggcctaccactactgccaggctgacaacacgtacacttgcctggtgcccgagtttgtgcacagcatcgcagctttgctctgccggtcccatcagctggccgcctacagagaccttctgataaaggagccccaactacagagcatgctgagcctccgatcctgtgtgcaggacccggtggcagctttcaagaggggagtgctggagccactcacaaacctgagaaatgagcagaaaattcctgaagaagaatacattattttgatagatggcttaaatgaagctgagtttcataaacctgattatggagatacgctttcttcatttattaccaaaattatttctaaatttcctgcctggttgaagttgattgtgactgtaagagcaaattttcaggaaatcataagtgcgctgccatttgtcaagctttccttagatgacttcccagacaacaaagacatccacagtgacctgcacgcctacgtccagcacagggtgcacagcagccaggacatcctcagcaacatctccctgaacggcaaggccgatgccacactcattggaaaagtgagcagccacctggtgctgcggagcctcggctcctacctgtacctcaagctcaccctggaccttttccagaggggccacttggtcattaagagtgccagctacaaggtggtgcccgtgtctctctctgagctctatttgcttcagtgcaacatgaagttcatgacccagtccgcctttgagagggcacttccgattctcaacgtggccctcgcatccctccaccccatgacagacgagcagatctttcaggctattaatgctggccacatccagggggagcagggatgggaagactttcagcagaggatggacgccctctcctgcttcctcattaagaggcgagacaaaacccgcatgttctgccacccgtccttcagggagtggcttgtatggagagcagacggggaaaacacggccttcctgtgtgagcccaggaacgggcacgcgctcttggcattcatgttctcgcgtcaggagggcaagttgaaccgccagcagaccatggagcttggccaccacatcctgaaggcgcacattttcaaggcattctttgtgtgtgaccccgtgccttctgcaggtatctgcaccctctgcggcagacccactttcagagtgaccctgcagggcctcagtaagaagacgggaatttcttcaagccatctccaagccctgtggatcggctacagcaccgaggggctgtccgccgccctggcctctctcaggaatctctatactcccaacgtgaaggtgagccgtctcctgattttgggaggggccaacgtgaactacaggacagaagtgttaaataatgccccaatcctgtgcgtccagtctcaccttggccacgaggaagttgtcactctgctcctggaatttggtgcctgcctggacggaacgtcagagaacggcatgactgccctctgttacgcagcagctgctggccacatgaagctggtgtgtctgctgaccaagaagggagtgagagtggaccacttggataagaagggccagtgtgcgcttgtccacagtgccctacggggccacggtgacattctccagtacctgctgacttgtgagtggtcgccgggtcctccccagccaggcaccctgaggaagagccacgccctgcagcaggcgctgaccgcggcggccagcatgggccacagctcggtggtccagtgcttgctggggatggagaaggaacatgaagtagaagtcaatggcaccgacacattgtggggagaaacaggtccacaagaccaggactgcctgctgcccacgcttactccctcactttccggtgacgaggccccagatagaacgcagagctcaggtgatccacgggagagatgtggctacctctctgtgacatgtgaagagacatgtagtgttctgctgattgactatgccactttcttgaagcttgctaatgatgatgatgatggttgtttggattgtttgcagcccggggtgcggctccctggcatggggaccacaccttttgaaggcctgttcttgtgttgccccattttcagcctgagagccctgactgccgccgcaggaagagggaagctggaggtctgtgagctgctgctggggcatggagctgctgtgtcgcggacaaacaggagaggggttccacctttgttttgtgcagcacgccaggggcattggcagattgttagactgctgttggaacgcggctgtgatgtgaacctaagtgacaagcaaggccggacgcccctcatggtggctgcttgtgaagggcacttgagcaccgtggaattcctcctttcaaaaggtgcagccctttcttctctagacaaagagggtctgtcagcattaagctgggcttgtctgaaaggtcacagggcagtggtccagtatctggttgaagaaggagctgcaatagaccagacagacaagaatggccgcacacccttggacctggctgccttctatggcgatgccgagactgtgctgtacctggtggagaagggagccgtgatcgagcatgtggaccacagcgggatgcggcccttggacagagccatcggctgccggaacacatctgtagtggtggcgctactcagaaagggagccaagttaggaaatgctgcttgggcgatggccacttccaaacctgatatcttgattatacttttacagaaattaatggaggaaggaaatgtgatgtacaaaaaagggaaaatgaaagaggcagcccagaggtaccagtatgccttaagaaagtttcctcgagaaggattcggagaggacatgagacccttcaatgaattaagggtttccctctatctcaatttgtcgcgatgccgaagaaaaaccaatgactttggcatggcagaggaatttgcttccaaggctctcgaattgaagcccaagtcctatgaagccttttatgccagagcaagagcgaagagaaatagcaggcaattcgtggcagctctggctgacctgcaagaggctgtgaaactctgtcccaccaatcaggaagtcaagaggcttctggcccgcgtagaagaggagtgcaaacaactccagaggagtcaacagcaaaaacagcagggcccgctaccagctccactcaacgactccgagaacgaagaggacaccccaacccctggcttaagtgaccactttcactctgaggagactgaagaggaagaaacttctccccaggaagaatctgtttccccaactcccaggtcccagccatcctcatctgtcccttcctcatacatccgaaaccttcaagaagggttacagtccaaaggaaggccggtatcgccacagagcagggcaggaatcggcaagtccctgagagagcctgtggcccagccagggctgctcctgcagccctccaagcaggcccagatcgtgaaaaccagccagcacctgggctctggccagtcggcagtgagaaatggcagtatgaaagttcagatctcttctcagaaccctcctccagccagcttggtaccgagctcgattgtatcatgtcaa

SEQ ID NO: 463744 - DNA, 450 bp, Homo sapiens
taatcggacccaggcttatgcggaggaaaatgttttcatgttacttatactaacattagttcttctatagggggatagattggcccaattgggtgggaggagttcagttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaataga

SEQ ID NO: 463745 - DNA, 553 bp, Homo sapiens
ctcgccggcgtcctgctccctccctcatcgtgctgtggtccttgcagctgggctcctgctggtgctgacctccagccgtggggccacggaggaattgggatcctttccgcagggcctctgaagtgcctctgaatgcgtgtttgttttgcaggaaatgctgcttgggcgatggccacttccaaacctgatatcttgattatacttttacagaaattaatggaggaaggaaatgtgatgtacaaagtaagtggttccgcccttttctttgccattgaaactgcctgggagcaccctcttaattgggtacataatggctacagctgtgctactgcacagtctccatgtaatagaagtgcaaaaagtggctgggtggggtggctcacgcctgtaactccagcacttttggaggccgaggtgggcagatcacttgaggccaggaattccagaccaacctggccaatatggcaaaaccccatctttactaaaaatacaaaaatcagccaggtgcctgtaatcccagctactcgggaggctgaggcaggagaattgtttc

SEQ ID NO: 463746 - DNA, 459 bp, Homo sapiens
gaaaacggaactttcccttcctccctctctggctgtgcctcagagcgctgctaccctttagaacaaaactagacgggcttcccacaatcgtgtgtccaggctgcttctgactcctgtatttcttgtcgacaccaggactttggcatggcagaggaatttgcttccaaggctctcgaattgaagcccaagtcctatgaagccttttatgccagagcaagagcgaagagaaatagcaggtaccgtctgtggttatctttgtgtctagagctttttttcttgtgggatcaaacctgcctgttgaatttggggaggttttgctgcagaagtgttgctcaggtgcctctcatcctttttagtagtgaattagtattactacctgcttccaagaggcatagtagtggacattatcagtgatgagtaaacttctattttctcctgacgtctcaataatcattcctt

SEQ ID NO: 463747 - DNA, 7400 bp, Homo sapiens
agcggaggctttgctgtggcagctgctggagcggcggccgcctcgggagccggaggagaggcagccgcggagcgccgagctggcctcgccccgaggcccggccctgggtgtggggaaccgcgctgaggagctggaaactttcccggcagaaacaagtgttgaaaatgttaaaggctgtgctgaagaagagccgagagggaggaaagggaggcaagaaggaagcaggaagtgactttggtccagagacttctccagtcctgcaccttgaccacagtgctgactctcctgtgagcagtcttcccacagcagaggacacctatagggtgagcttggccaaaggtgtctcgatgtctctgccttcctcacctttgctgcctcgacagtctcacttggtgcaatcaagagtgaacaaaaaatccccaggtcccgtcaggaagcccaagtatgtggaaagccccagagtgcctggagatgcagttataatgccattcagagaagtagccaagccaacagagcctgatgagcatgaagcaaaggccgataatgaaccgagctgttcgccggcagctcaagaactgttgacaaggctgggatttttactgggagaagggatcccaagtgccacacacataaccattgaagacaaaaatgaaaccatgtgcacagctctgagtcaaggcatcagtccttgctccacactaacaagcagcaccgcatctcctagcaccgatagcccctgctcaaccttgaatagctgtgtcagcaagacggcagccaacaaaagtccctgtgagaccattagcagccctagttccaccctggaaagcaaggacagtggaattatagccacaattacaagttcatccgaaaatgatgaccggagtggctccagtttggaatggaataaagatggaagcctaagattaggggttcagaagggagtgcttcatgaccgcagggcagataactgctccccagtggcagaagaggagaccaccgggtcagcagagagcacgctgcccaaagcagaatcctcagctggagatggtccagtcccttattctcagggctccagctcactaataatgccacggcccaactcagttgcagcaacaagctcaaccaaattggaagatctgagttatttagacgggcagagaaatgctcctctacggacgtcaattagattaccatggcacaatacggccggaggtagggcacaggaagttaaagcacgatttgctccctacaagccacaagacattttgttgaaacccttgttgtttgaagtaccaagcataacaacagactctgtgtttgtgggaagggattggctctttcaccagatagaagaaaacttgaggaacacagaactggcagaaaacagaggcgcggtggtggttggcaatgtgggatttgggaagacggcaatcatttccaagttggtggccctgagctgccacggaagccgcatgaggcagattgcttccaacagcccgggttcatcacctaaaacctctgaccccactcaggatcttcatttcactccgttgctttcaccgagttcttccacaagtgcttccagcacagctaaaacacctcttgggtctatcagtgctgaaaaccagagaccaagagaggatgcagtgaaatatcttgcttctaaggtggtggcctaccactactgccaggctgacaacacgtacacttgcctggtgcccgagtttgtgcacagcatcgcagctttgctctgccggtcccatcagctggccgcctacagagaccttctgataaaggagccccaactacagagcatgctgagcctccgatcctgtgtgcaggacccggtggcagctttcaagaggggagtgctggagccactcacaaacctgagaaatgagcagaaaattcctgaagaagaatacattattttgatagatggcttaaatgaagctgagtttcataaacctgattatggagatacgctttcttcatttattaccaaaattatttctaaatttcctgcctggttgaagttgattgtgactgtaagagcaaattttcaggaaatcataagtgcgctgccatttgtcaagctttccttagatgacttcccagacaacaaagacatccacagtgacctgcacgcctacgtccagcacagggtgcacagcagccaggacatcctcagcaacatctccctgaacggcaaggccgatgccacactcattggaaaagtgagcagccacctggtgctgcggagcctcggctcctacctgtacctcaagctcaccctggaccttttccagaggggccacttggtcattaagagtgccagctacaaggtggtgcccgtgtctctctctgagctctatttgcttcagtgcaacatgaagttcatgacccagtccgcctttgagagggcacttccgattctcaacgtggccctcgcatccctccaccccatgacagacgagcagatctttcaggctattaatgctggccacatccagggggagcagggatgggaagactttcagcagaggatggacgccctctcctgcttcctcattaagaggcgagacaaaacccgcatgttctgccacccgtccttcagggagtggcttgtatggagagcagacggggaaaacacggccttcctgtgtgagcccaggaacgggcacgcgctcttggcattcatgttctcgcgtcaggagggcaagttgaaccgccagcagaccatggagcttggccaccacatcctgaaggcgcacattttcaagggcctcagtaagaagacgggaatttcttcaagccatctccaagccctgtggatcggctacagcaccgaggggctgtccgccgccctggcctctctcaggaatctctatactcccaacgtgaaggtgagccgtctcctgattttgggaggggccaacgtgaactacaggacagaagtgttaaataatgccccaatcctgtgcgtccagtctcaccttggccacgaggaagttgtcactctgctcctggaatttggtgcctgcctggacggaacgtcagagaacggcatgactgccctctgttacgcagcagctgctggccacatgaagctggtgtgtctgctgaccaagaagggagtgagagtggaccacttggataagaagggccagtgtgcgcttgtccacagtgccctacggggccacggtgacattctccagtacctgctgacttgtgagtggtcgccgggtcctccccagccaggcaccctgaggaagagccacgccctgcagcaggcgctgaccgcggcggccagcatgggccacagctcggtggtccagtgcttgctggggatggagaaggaacatgaagtagaagtcaatggcaccgacacattgtggggagaaacagccctgactgccgccgcaggaagagggaagctggaggtctgtgagctgctgctggggcatggagctgctgtgtcgcggacaaacaggagaggggttccacctttgttttgtgcagcacgccaggggcattggcagattgttagactgctgttggaacgcggctgtgatgtgaacctaagtgacaagcaaggccggacgcccctcatggtggctgcttgtgaagggcacttgagcaccgtggaattcctcctttcaaaaggtgcagccctttcttctctagacaaagagggtctgtcagcattaagctgggcttgtctgaaaggtcacagggcagtggtccagtatctggttgaagaaggagctgcaatagaccagacagacaagaatggccgcacacccttggacctggctgccttctatggcgatgccgagactgtgctgtacctggtggagaagggagccgtgatcgagcatgtggaccacagcgggatgcggcccttggacagagccatcggctgccggaacacatctgtagtggtggcgctactcagaaagggagccaagttaggaaatgctgcttgggcgatggccacttccaaacctgatatcttgattatacttttacagaaattaatggaggaaggaaatgtgatgtacaaaaaagggaaaatgaaagaggcagcccagaggtaccagtatgccttaagaaagtttcctcgagaaggattcggagaggacatgagacccttcaatgaattaagggtttccctctatctcaatttgtcgcgatgccgaagaaaaaccaatgactttggcatggcagaggaatttgcttccaaggctctcgaattgaagcccaagtcctatgaagccttttatgccagagcaagagcgaagagaaatagcaggcaattcgtggcagctctggctgacctgcaagaggctgtgaaactctgtcccaccaatcaggaagtcaagaggcttctggcccgcgtagaagaggagtgcaaacaactccagaggagtcaacagcaaaaacagcagggcccgctaccagctccactcaacgactccgagaacgaagaggacaccccaacccctggcttaagtgaccactttcactctgaggagactgaagaggaagaaacttctccccaggaagaatctgtttccccaactcccaggtcccagccatcctcatctgtcccttcctcatacatccgaaaccttcaagaagggttacagtccaaaggaaggccggtatcgccacagagcagggcaggaatcggcaagtccctgagagagcctgtggcccagccagggctgctcctgcagccctccaagcaggcccagatcgtgaaaaccagccagcacctgggctctggccagtcggcagtgagaaatggcagtatgaaagttcagatctcttctcagaaccctcctccaagtcccatgccagggagaatcgctgccactcctgctgggagcagaacccagcatttagagggaacaggtactttcactacaagagctggttgtggccactttggggatcggctgggccccagccagaatgtccgcctgcagtgtggtgagaatggccctgcacaccctttaccaagtaagacgaaaaccacagagaggcttctgtctcattcctccgtggctgtggacgcagcccctccaaaccaaggtgggctggcgacctgcagcgacgtgcgacacccagcttccctcaccagctcaggctcttctggttctccatccagcagcataaagatgtcaagttcaaccagtagtttgacttcgagcagcagtttttcagatggcttcaaggtccaaggaccagatactagaattaaagacaaggttgtaacccacgttcagagcggtacagctgagcacagaccccgcaacacgccgttcatgggcatcatggataagactgcgaggttccaacagcagagcaatcctccaagccgcagctggcactgtccggcaccagaggggctgctgacaaacacgtcttctgcagctggcctgcagtctgctaacactgagaagccctctctcatgcaagtgggaggatataataaccaagccaaaacctgttctgtttctaccctgagtgcaagtgtccacaatggggcacaagtgaaggagctagaagaaagcaagtgccaaattccagtccactctcaagagaacaggataactaagactgtttctcatctgtaccaggaaagtatctccaaacagcagcctcatattagtaatgaagcccacaggagccacctcactgcagccaaaccaaagcgatcatttatagagtcaaatgtgtgaaccttaagaaagccccatttgtggaatttggaaacgtgtgttgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaacttaaaattttaagacagcccagaagacattaatgactctcacttatgaaattgtttggcttttgccactttcctccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacctttttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaataga

SEQ ID NO: 463748 - DNA, 7170 bp, Homo sapiens
aaaagatttataggagatgaggcagagacaaaataagatgagatcaaatggtccatctatcaggaaagcacttcccctccaagggagcagcagcatgcaccctgccacctcccagatgtgatgtgtgcatctgaatagcaatgcaggatggagcttctaccctggtgaaggtctctgcactgcaagggagggtgtcatgcattgattgagactgagtggtcaccagtctccttcccctgattgcagagcccataaatcttgaggaattgaatcaggttgcagtgttcgtgaaacatcacaaaaacagagctcccaggtcttccgtacagaggtcaaataacccatttgtcttctgcagacttcaaatgaaaggaagtctgcctgtttgccatttctgttgtacaaatgtgcatcctcactaaattattgctaagactgaccttttaataaaaaggaaaatcacaaaggaggggaaccgaacaaagatactgctttctcaaaatttggaagaccacatatacatttatatagataaagctccatgaatccatatctatacacacatatctctttagattttttttttaaaacttccgttttcctgttcttagttttattgttttagcacaaaaacaaaagcatgtgtcgaagcatcctgtgtaagccgtgctaactcctccttccattcatcttgcagtgcacagctctgagtcaaggcatcagtccttgctccacactaacaagcagcaccgcatctcctagcaccgatagcccctgctcaaccttgaatagctgtgtcagcaagacggcagccaacaaaagtccctgtgagaccattagcagccctagttccaccctggaaagcaaggacagtggaattataggtaagaagcacactgctcggtaacataatggctcgaatctcatcaaccagagcattcaccaggcacttcctcagagggttttagcatggtctgtgaaggtcagtctgccagcgcctgctctgttctttgcaggcagcactgactccatgtgtagctgagagagtggagcattggcttttacattccttgatgtttactttataacagtcagctcatttgttaaaaaaaaaaaaaaaaggaattccagatcagatctggcctgtgaaacaaaaatcattgctcttctatattcagttccatttgttgggcatcaggtcccactggggcacacagcagagcaatgaaattcctgcatattaagacgtcgtcttatcccaatctcaaggtggtggcctaccactactgccaggctgacaacacgtacacttgcctggtgcccgagtttgtgcacagcatcgcagctttgctctgccggtcccatcagctggccgcctacagagaccttctgataaaggagccccaactacagagcatgctgagcctccgatcctgtgtgcaggacccggtggcagctttcaagaggggagtgctggagccactcacaaacctgagaaatgatgacttcccagacaacaaagacatccacagtgacctgcacgcctacgtccagcacagggtgcacagcagccaggacatcctcagcaacatctccctgaacggcaaggccgatgccacactcattggaaaagtgagcagccacctggtgctgcggagcctcggctcctacctgtacctcaagctcaccctggaccttttccagaggggccacttggtcattaagagtgccagctacaaggtggtgcccgtgtctctctctgagctctatttgcttcagtgcaacatgaagttcatgacccagtccgcctttgagagggcacttccgattctcaacgtggccctcgcatccctccaccccatgacagacgagcagatctttcaggctattaatgctggccacatccagggggagcagggatgggaagactttcagcagaggatggacgccctctcctgcttcctcattaagaggcgagacaaaacccgcatgttctgccacccgtccttcagggagtggcttgtatggagagcagacggggaaaacacggccttcctgtgtgagcccaggaacgggcacgcgctcttggcattcatgttctcgcgtcaggagggcaagttgaaccgccagcagaccatggagcttggccaccacatcctgaaggcgcacattttcaaggcattctttgtgtgtgaccccgtgccttctgcaggtatctgcaccctctgcggcagacccactttcagagtgaccctgcagggcctcagtaagaagacgggaatttcttcaagccatctccaagccctgtggatcggctacagcaccgaggggctgtccgccgccctggcctctctcaggaatctctatactcccaacgtgaaggtgagccgtctcctgattttgggaggggccaacgtgaactacaggacagaagtgttaaataatgccccaatcctgtgcgtccagtctcaccttggccacgaggaagttgtcactctgctcctggaatttggtgcctgcctggacggaacgtcagagaacggcatgactgccctctgttacgcagcagctgctggccacatgaagctggtgtgtctgctgaccaagaagggagtgagagtggaccacttggataagaagggccagtgtgcgcttgtccacagtgccctacggggccacggtgacattctccagtacctgctgacttgtgagtggtcgccgggtcctccccagccaggcaccctgaggaagagccacgccctgcagcaggcgctgaccgcggcggccagcatgggccacagctcggtggtccagtgcttgctggggatggagaaggaacatgaagtagaagtcaatggcaccgacacattgtggggagaaacaggtccacaagaccaggactgcctgctgcccacgcttactccctcactttccggtgacgaggccccagatagaacgcagagctcaggtgatccacgggagagatgtggctacctctctgtgacatgtgaagagacatgtagtgttctgctgattgactatgccactttcttgaagcttgctaatgatgatgatgatggttgtttggattgtttgcagcccggggtgcggctccctggcatggggaccacaccttttgaaggcctgttcttgtgttgccccattttcagcctgagagccctgactgccgccgcaggaagagggaagctggaggtctgtgagctgctgctggggcatggagctgctgtgtcgcggacaaacaggagaggggttccacctttgttttgtgcagcacgccaggggcattggcagattgttagactgctgttggaacgcggctgtgatgtgaacctaagtgacaagcaaggccggacgcccctcatggtggctgcttgtgaagggcacttgagcaccgtggaattcctcctttcaaaaggtgcagccctttcttctctagacaaagagggtctgtcagcattaagctgggcttgtctgaaaggtcacagggcagtggtccagtatctggttgaagaaggagctgcaatagaccagacagacaagaatggccgcacacccttggacctggctgccttctatggcgatgccgagactgtgctgtacctggtggagaagggagccgtgatcgagcatgtggaccacagcgggatgcggcccttggacagagccatcggctgccggaacacatctgtagtggtggcgctactcagaaagggagccaagttaggaaatgctgcttgggcgatggccacttccaaacctgatatcttgattatacttttacagaaattaatggaggaaggaaatgtgatgtacaaaaaagggaaaatgaaagaggcagcccagaggtaccagtatgccttaagaaagtttcctcgagaaggattcggagaggacatgagacccttcaatgaattaagggtttccctctatctcaatttgtcgcgatgccgaagaaaaaccaatgactttggcatggcagaggaatttgcttccaaggctctcgaattgaagcccaagtcctatgaagccttttatgccagagcaagagcgaagagaaatagcaggcaattcgtggcagctctggctgacctgcaagaggctgtgaaactctgtcccaccaatcaggaagtcaagaggcttctggcccgcgtagaagaggagtgcaaacaactccagaggagtcaacagcaaaaacagcagggcccgctaccagctccactcaacgactccgagaacgaagaggacaccccaacccctggcttaagtgaccactttcactctgaggagactgaagaggaagaaacttctccccaggaagaatctgtttccccaactcccaggtcccagccatcctcatctgtcccttcctcatacatccgaaaccttcaagaagggttacagtccaaaggaaggccggtatcgccacagagcagggcaggaatcggcaagtccctgagagagcctgtggcccagccagggctgctcctgcagccctccaagcaggcccagatcgtgaaaaccagccagcacctgggctctggccagtcggcagtgagaaatggcagtatgaaagttcagatctcttctcagaaccctcctccaagtcccatgccagggagaatcgctgccactcctgctgggagcagaacccagcatttagagggaacaggtactttcactacaagagctggttgtggccactttggggatcggctgggccccagccagaatgtccgcctgcagtgtggtgagaatggccctgcacaccctttaccaagtaagacgaaaaccacagagaggcttctgtctcattcctccgtggctgtggacgcagcccctccaaaccaaggtgggctggcgacctgcagcgacgtgcgacacccagcttccctcaccagctcaggctcttctggttctccatccagcagcataaagatgtcaagttcaaccagtagtttgacttcgagcagcagtttttcagatggcttcaaggtccaaggaccagatactagaattaaagacaaggttgtaacccacgttcagagcggtacagctgagcacagaccccgcaacacgccgttcatgggcatcatggataagactgcgaggttccaacagcagagcaatcctccaagccgcagctggcactgtccggcaccagaggggctgctgacaaacacgtcttctgcagctggcctgcagtctgctaacactgagaagccctctctcatgcaagtgggaggatataataaccaagccaaaacctgttctgtttctaccctgagtgcaagtgtccacaatggggcacaagtgaaggagctagaagaaagcaagtgccaaattccagtccactctcaagagaacaggataactaagactgtttctcatctgtaccaggaaagtatctccaaacagcagcctcatattagtaatgaagcccacaggagccacctcactgcagccaaaccaaagcgatcatttatagagtcaaatgtgtgaaccttaagaaagccccatttgtggaatttggaaacgtgtgttgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaacttaaaattttaagacagcccagaagacattaatgactctcacttatgaaattgtttggcttttgccactttcctccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacctttttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaataga

SEQ ID NO: 463749 - DNA, 8551 bp, Homo sapiens
caaaatgtgctttgaggtaggaagggacctcctgtagagcggctttggcatgaggtcgacccgccctggggtggctccttttccctgtgttggcttggggccactgccccttcatgtttggctcacatggtccagaagcatcagggctcttttaacccagaatagtcaagccttggtttccttacccctgcagttttccagagcagctaaaaaacatccaagctggcaaaccattcttcctactccaaacattaggagcttttaccagtaagcaaggggtgggaagcttttcctttcttgaagatgctgccagcgtagtttcccttgtagctgccatcctgggtgcatgacttgcaaaactgatatgtgagtgacaataagccagatggcctttgcaaaagctctgcttattttgatttttgtggttccttacaaaaggcgaagtgagcattgatctttgttggtgctgttgtagctcaacggcaacatcactgtgttgtttcctcattttatttttcctaaaacctttacccattatctgcagattttcacatctaagcaaaataggttcatatgagtccagttacctagacaattaataaaaaagagcaaaatgttgagtgactatgtcataggttacttattgttaagttacagctttgtaagcagcttgctttgtaaatttttcatcccctgatggatgctgattttagaaggtgagagacgtgttagaaggatgtgaatatcgttttatttattggccataattaagtgcctttgggctttttgggtacagggttaaactacagctcaacatttaaatcaaatccaaccataaaattctcttaagtacaaaaaaaccagatgaccaacctcagggagaacccaagaaaaggtgggctttcccagcattgctgtgcagcattctgagaatacagcttgatttttctacatctttgcatgggcaacagtggtactgggtcctgtctcttgggacaagtttcactgtgattttaaatttttgtttcaacttggattcttcacgattgaccgtcaagttgaaatcctggttttgactttcactactgtgggatgtgcacaggaagttttccaccaaattttccacgtcgttcccctggcttgtttaatgagagcttggatttcagttttactccaacacctaaatagcctgggtctctaccagcatgccactagggttttacttcatttcagcctcctgtgggcattggacacccggcactctgtgagggtaacatgaaagataggcccttttcttacccaagctgatgtctgaagtacccgttttcacatgactcggaattaggaattgccgtcagataacactgggctcttctcactcaccctttgcacttggagtttttgttttactgtttccttaacctgtcacagtcccttaattagaatgtattgctagaggacagggtgcgttgtccaactttgtgcgcattttatagaaacacacaaaatcaccagacaaagcagctgtagtgtgaactcatccagatgcgatactgaaattccccagaggggcatcttcattgttttctttctttgttccagaagcaaaggccgataatgaaccgagctgttcgccggcagctcaagaactgttgacaaggctgggatttttactgggagaagggatcccaagtgccacacacataaccattgaagacaaaaatgaaaccatgtgcacagctctgagtcaaggcatcagtccttgctccacactaacaagcagcaccgcatctcctagcaccgatagcccctgctcaaccttgaatagctgtgtcagcaagacggcagccaacaaaagtccctgtgagaccattagcagccctagttccaccctggaaagcaaggacagtggaattataggtaagaagcacactgctcggtaacataatggctcgaatctcatcaaccagagcattcaccaggcacttcctcagagggttttagcatggtctgtgaaggtcagtctgccagcgcctgctctgttctttgcaggcagcactgactccatgtgtagctgagagagtggagcattggcttttacattccttgatgtttactttataacagtcagctcatttgttaaaaaaaaaaaaaaaaggaattccagatcagatctggcctgtgaaacaaaaatcattgctcttctatattcagttccatttgttgggcatcaggtcccactggggcacacagcagagcaatgaaattcctgcatattaagacgtcgtcttatcccaatctcaaggtggtggcctaccactactgccaggctgacaacacgtacacttgcctggtgcccgagtttgtgcacagcatcgcagctttgctctgccggtcccatcagctggccgcctacagagaccttctgataaaggagccccaactacagagcatgctgagcctccgatcctgtgtgcaggacccggtggcagctttcaagaggggagtgctggagccactcacaaacctgagaaatgagcagaaaattcctgaagaagaatacattattttgatagatggcttaaatgaagctgagtttcataaacctgattatggagatacgctttcttcatttattaccaaaattatttctaaatttcctgcctggttgaagttgattgtgactgtaagagcaaattttcaggaaatcataagtgcgctgccatttgtcaagctttccttagatgacttcccagacaacaaagacatccacagtgacctgcacgcctacgtccagcacagggtgcacagcagccaggacatcctcagcaacatctccctgaacggcaaggccgatgccacactcattggaaaagtgagcagccacctggtgctgcggagcctcggctcctacctgtacctcaagctcaccctggaccttttccagaggggccacttggtcattaagagtgccagctacaaggtggtgcccgtgtctctctctgagctctatttgcttcagtgcaacatgaagttcatgacccagtccgcctttgagagggcacttccgattctcaacgtggccctcgcatccctccaccccatgacagacgagcagatctttcaggctattaatgctggccacatccagggggagcagggatgggaagactttcagcagaggatggacgccctctcctgcttcctcattaagaggcgagacaaaacccgcatgttctgccacccgtccttcagggagtggcttgtatggagagcagacggggaaaacacggccttcctgtgtgagcccaggaacgggcacgcgctcttggcattcatgttctcgcgtcaggagggcaagttgaaccgccagcagaccatggagcttggccaccacatcctgaaggcgcacattttcaaggcattctttgtgtgtgaccccgtgccttctgcaggtatctgcaccctctgcggcagacccactttcagagtgaccctgcagggcctcagtaagaagacgggaatttcttcaagccatctccaagccctgtggatcggctacagcaccgaggggctgtccgccgccctggcctctctcaggaatctctatactcccaacgtgaaggtgagccgtctcctgattttgggaggggccaacgtgaactacaggacagaagtgttaaataatgccccaatcctgtgcgtccagtctcaccttggccacgaggaagttgtcactctgctcctggaatttggtgcctgcctggacggaacgtcagagaacggcatgactgccctctgttacgcagcagctgctggccacatgaagctggtgtgtctgctgaccaagaagggagtgagagtggaccacttggataagaagggccagtgtgcgcttgtccacagtgccctacggggccacggtgacattctccagtacctgctgacttgtgagtggtcgccgggtcctccccagccaggcaccctgaggaagagccacgccctgcagcaggcgctgaccgcggcggccagcatgggccacagctcggtggtccagtgcttgctggggatggagaaggaacatgaagtagaagtcaatggcaccgacacattgtggggagaaacaggtccacaagaccaggactgcctgctgcccacgcttactccctcactttccggtgacgaggccccagatagaacgcagagctcaggtgatccacgggagagatgtggctacctctctgtgacatgtgaagagacatgtagtgttctgctgattgactatgccactttcttgaagcttgctaatgatgatgatgatggttgtttggattgtttgcagcccggggtgcggctccctggcatggggaccacaccttttgaaggcctgttcttgtgttgccccattttcagcctgagagccctgactgccgccgcaggaagagggaagctggaggtctgtgagctgctgctggggcatggagctgctgtgtcgcggacaaacaggagaggggttccacctttgttttgtgcagcacgccaggggcattggcagattgttagactgctgttggaacgcggctgtgatgtgaacctaagtgacaagcaaggccggacgcccctcatggtggctgcttgtgaagggcacttgagcaccgtggaattcctcctttcaaaaggtgcagccctttcttctctagacaaagagggtctgtcagcattaagctgggcttgtctgaaaggtcacagggcagtggtccagtatctggttgaagaaggagctgcaatagaccagacagacaagaatggccgcacacccttggacctggctgccttctatggcgatgccgagactgtgctgtacctggtggagaagggagccgtgatcgagcatgtggaccacagcgggatgcggcccttggacagagccatcggctgccggaacacatctgtagtggtggcgctactcagaaagggagccaagttaggaaatgctgcttgggcgatggccacttccaaacctgatatcttgattatacttttacagaaattaatggaggaaggaaatgtgatgtacaaaaaagggaaaatgaaagaggcagcccagaggtaccagtatgccttaagaaagtttcctcgagaaggattcggagaggacatgagacccttcaatgaattaagggtttccctctatctcaatttgtcgcgatgccgaagaaaaaccaatgactttggcatggcagaggaatttgcttccaaggctctcgaattgaagcccaagtcctatgaagccttttatgccagagcaagagcgaagagaaatagcaggcaattcgtggcagctctggctgacctgcaagaggctgtgaaactctgtcccaccaatcaggaagtcaagaggcttctggcccgcgtagaagaggagtgcaaacaactccagaggagtcaacagcaaaaacagcagggcccgctaccagctccactcaacgactccgagaacgaagaggacaccccaacccctggcttaagtgaccactttcactctgaggagactgaagaggaagaaacttctccccaggaagaatctgtttccccaactcccaggtcccagccatcctcatctgtcccttcctcatacatccgaaaccttcaagaagggttacagtccaaaggaaggccggtatcgccacagagcagggcaggaatcggcaagtccctgagagagcctgtggcccagccagggctgctcctgcagccctccaagcaggcccagatcgtgaaaaccagccagcacctgggctctggccagtcggcagtgagaaatggcagtatgaaagttcagatctcttctcagaaccctcctccaagtcccatgccagggagaatcgctgccactcctgctgggagcagaacccagcatttagagggaacaggtactttcactacaagagctggttgtggccactttggggatcggctgggccccagccagaatgtccgcctgcagtgtggtgagaatggccctgcacaccctttaccaagtaagacgaaaaccacagagaggcttctgtctcattcctccgtggctgtggacgcagcccctccaaaccaaggtgggctggcgacctgcagcgacgtgcgacacccagcttccctcaccagctcaggctcttctggttctccatccagcagcataaagatgtcaagttcaaccagtagtttgacttcgagcagcagtttttcagatggcttcaaggtccaaggaccagatactagaattaaagacaaggttgtaacccacgttcagagcggtacagctgagcacagaccccgcaacacgccgttcatgggcatcatggataagactgcgaggttccaacagcagagcaatcctccaagccgcagctggcactgtccggcaccagaggggctgctgacaaacacgtcttctgcagctggcctgcagtctgctaacactgagaagccctctctcatgcaagtgggaggatataataaccaagccaaaacctgttctgtttctaccctgagtgcaagtgtccacaatggggcacaagtgaaggagctagaagaaagcaagtgccaaattccagtccactctcaagagaacaggataactaagactgtttctcatctgtaccaggaaagtatctccaaacagcagcctcatattagtaatgaagcccacaggagccacctcactgcagccaaaccaaagcgatcatttatagagtcaaatgtgtgaaccttaagaaagccccatttgtggaatttggaaacgtgtgttgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaacttaaaattttaagacagcccagaagacattaatgactctcacttatgaaattgtttggcttttgccactttcctccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacctttttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaatagaatgtgttttgcactaaatgagtcaatggataagtagagaacagcctgatgacagctatctctgttgcttttaatctttgttaccctagagggaatagtgaaaagcatattttatattaacactacaaaatgcttatttaatttcgttttataatttcagaataagggtgacagctgctagaaattccacaat

SEQ ID NO: 463750 - DNA, 4818 bp, Homo sapiens
caaaatgtgctttgaggtaggaagggacctcctgtagagcggctttggcatgaggtcgacccgccctggggtggctccttttccctgtgttggcttggggccactgccccttcatgtttggctcacatggtccagaagcatcagggctcttttaacccagaatagtcaagccttggtttccttacccctgcagttttccagagcagctaaaaaacatccaagctggcaaaccattcttcctactccaaacattaggagcttttaccagtaagcaaggggtgggaagcttttcctttcttgaagatgctgccagcgtagtttcccttgtagctgccatcctgggtgcatgacttgcaaaactgatatgtgagtgacaataagccagatggcctttgcaaaagctctgcttattttgatttttgtggttccttacaaaaggcgaagtgagcattgatctttgttggtgctgttgtagctcaacggcaacatcactgtgttgtttcctcattttatttttcctaaaacctttacccattatctgcagattttcacatctaagcaaaataggttcatatgagtccagttacctagacaattaataaaaaagagcaaaatgttgagtgactatgtcataggttacttattgttaagttacagctttgtaagcagcttgctttgtaaatttttcatcccctgatggatgctgattttagaaggtgagagacgtgttagaaggatgtgaatatcgttttatttattggccataattaagtgcctttgggctttttgggtacagggttaaactacagctcaacatttaaatcaaatccaaccataaaattctcttaagtacaaaaaaaccagatgaccaacctcagggagaacccaagaaaaggtgggctttcccagcattgctgtgcagcattctgagaatacagcttgatttttctacatctttgcatgggcaacagtggtactgggtcctgtctcttgggacaagtttcactgtgattttaaatttttgtttcaacttggattcttcacgattgaccgtcaagttgaaatcctggttttgactttcactactgtgggatgtgcacaggaagttttccaccaaattttccacgtcgttcccctggcttgtttaatgagagcttggatttcagttttactccaacacctaaatagcctgggtctctaccagcatgccactagggttttacttcatttcagcctcctgtgggcattggacacccggcactctgtgagggtaacatgaaagataggcccttttcttacccaagctgatgtctgaagtacccgttttcacatgactcggaattaggaattgccgtcagataacactgggctcttctcactcaccctttgcacttggagtttttgttttactgtttccttaacctgtcacagtcccttaattagaatgtattgctagaggacagggtgcgttgtccaactttgtgcgcattttatagaaacacacaaaatcaccagacaaagcagctgtagtgtgaactcatccagatgcgatactgaaattccccagaggggcatcttcattgttttctttctttgttccagaagcaaaggccgataatgaaccgagctgttcgccggcagctcaagaactgttgacaaggctgggatttttactgggagaagggatcccaagtgccacacacataaccattgaagacaaaaatgaaaccatgtgcacagctctgagtcaaggcatcagtccttgctccacactaacaagcagcaccgcatctcctagcaccgatagcccctgctcaaccttgaatagctgtgtcagcaagacggcagccaacaaaagtccctgtgagaccattagcagccctagttccaccctggaaagcaaggacagtggaattataggtaagaagcacactgctcggtaacataatggctcgaatctcatcaaccagagcattcaccaggcacttcctcagagggttttagcatggtctgtgaaggtcagtctgccagcgcctgctctgttctttgcaggcagcactgactccatgtgtagctgagagagtggagcattggcttttacattccttgatgtttactttataacagtcagctcatttgttaaaaaaaaaaaaaaaaggaattccagatcagatctggcctgtgaaacaaaaatcattgctcttctatattcagttccatttgttgggcatcaggtcccactggggcacacagcagagcaatgaaattcctgcatattaagacgtcgtcttatcccaatctcaaggtggtggcctaccactactgccaggctgacaacacgtacacttgcctggtgcccgagtttgtgcacagcatcgcagctttgctctgccggtcccatcagctggccgcctacagagaccttctgataaaggagccccaactacagagcatgctgagcctccgatcctgtgtgcaggacccggtggcagctttcaagaggggagtgctggagccactcacaaacctgagaaatgagcagaaaattcctgaagaagaatacattattttgatagatggcttaaatgaagctgagtttcataaacctgattatggagatacgctttcttcatttattaccaaaattatttctaaatttcctgcctggttgaagttgattgtgactgtaagagcaaattttcaggaaatcataagtgcgctgccatttgtcaagctttccttagatgacttcccagacaacaaagacatccacagtgacctgcacgcctacgtccagcacagggtgcacagcagccaggacatcctcagcaacatctccctgaacggcaaggccgatgccacactcattggaaaagtgagcagccacctggtgctgcggagcctcggctcctacctgtacctcaagctcaccctggaccttttccagaggggccacttggtcattaagagtgccagctacaaggtggtgcccgtgtctctctctgagctctatttgcttcagtgcaacatgaagttcatgacccagtccgcctttgagagggcacttccgattctcaacgtggccctcgcatccctccaccccatgacagacgagcagatctttcaggctattaatgctggccacatccagggggagcagggatgggaagactttcagcagaggatggacgccctctcctgcttcctcattaagaggcgagacaaaacccgcatgttctgccacccgtccttcagggagtggcttgtatggagagcagacggggaaaacacggccttcctgtgtgagcccaggaacgggcacgcgctcttggcattcatgttctcgcgtcaggagggcaagttgaaccgccagcagaccatggagcttggccaccacatcctgaaggcgcacattttcaaggcattctttgtgtgtgaccccgtgccttctgcaggtatctgcaccctctgcggcagacccactttcagagtgaccctgcagggcctcagtaagaagacgggaatttcttcaagccatctccaagccctgtggatcggctacagcaccgaggggctgtccgccgccctggcctctctcaggaatctctatactcccaacgtgaaggtgagccgtctcctgattttgggaggggccaacgtgaactacaggacagaagtgttaaataatgccccaatcctgtgcgtccagtctcaccttggccacgaggaagttgtcactctgctcctggaatttggtgcctgcctggacggaacgtcagagaacggcatgactgccctctgttacgcagcagctgctggccacatgaagctggtgtgtctgctgaccaagaagggagtgagagtggaccacttggataagaagggccagtgtgcgcttgtccacagtgccctacggggccacggtgacattctccagtacctgctgacttgtgagtggtcgccgggtcctccccagccaggcaccctgaggaagagccacgccctgcagcaggcgctgaccgcggcggccagcatgggccacagctcggtggtccagtgcttgctggggatggagaaggaacatgaagtagaagtcaatggcaccgacacattgtggggagaaacaggtccacaagaccaggactgcctgctgcccacgcttactccctcactttccggtgacgaggccccagatagaacgcagagctcaggtgatccacgggagagatgtggctacctctctgtgacatgtgaagagacatgtagtgttctgctgattgactatgccactttcttgaagcttgctaatgatgatgatgatggttgtttggattgtttgcagcccggggtgcggctccctggcatggggaccacaccttttgaaggcctgttcttgtgttgccccattttcagcctgagagccctgactgccgccgcaggaagagggaagctggaggtctgtgagctgctgctggggcatggagctgctgtgtcgcggacaaacaggagaggggttccacctttgttttgtgcagcacgccaggggcattggcagattgttagactgctgttggaacgcggctgtgatgtgaacctaagtgacaagcaaggccggacgcccctcatggtggctgcttgtgaagggcacttgagcaccgtggaattcctcctttcaaaaggtagcagcgtgatgccctcaaaggtttcttttggacggacacagagagaacttcagcagacccattcagtgctttctgattcaaattctaagttttctgttaatggaaattttctaataaacagtagagagaataggca

SEQ ID NO: 463751 - DNA, 1438 bp, Homo sapiens
ttcatgaatgggttcagggtccttatgcaaggactggagggagtgggcttctcctgttttgcccttctgccttctgccatctgctttactgtcacacgtagcagctcaggtgaaaagcacttttaccgtggggactttcccttagtgctctgtgatgcacaagagcagacctatgtagaagcatttaagtattttgtctcccgggggtccggccctggaggacccgaagcccccactcccataacgccccttactacatccccactccagccgccactgcgactgccacagaacccccgccacgtgttgctgaacctgtttaaagcggccacagccggagttcgaagagcaaagcaggagtccgcctgggcaatgcgcatgcgggaggcacgagcccattctcccgtgacggtgactccaacggttggctgaggacgattccctgagccttgacaaagcaggagccctccgtggcggtgcgtcggtgtcgaggctccagtctgactaatccagggggtcgacaaaacagattcgggacactatgctacacggagggcctaccaggatgcagaaacagcagacggagtccagggaaagcagtgcggcatcccagcctcaggcctgcccgtacggtgttcgggaggggaggagaccaatgtgaaaggagatggttctatctcctcgcggctcttctctgagaaatgaagccacgatacgaaacaatcttcaagaagaagctgaaaaccggatatgacacggatgtccccagaacacagcaggcatcctgaagctccgcctcctgaagctccccctccctcggtggaagtcggctcagggaggtcctgaggacaggactcctgggggtttggctgcagaatgaattcattaggactttatataatttttcaaatcatgaaattgcgcaagcttttgaatatggaattgggagggctttcagttcattcagtagaaaactggaacatttttgaaaggtgatctgcttgacacctttcaaagagcacaaaaccttgtgaagtagcagatgcaatgattaccaatgtactttataaaatgactttcagagtttgagatgaaattggcttttctgaaatatgtaagtctctggaaaaactcaacatttctaatcttgctttggaaagcctttaagtatgtaaaaatcaatttcttatatcttctctgaaataaacatggaatatcctaaggttttgttcatgtttcatgaatttcacagcattcatcatattttaaagttatttttgatactttgcattgtattaaaatctgtcttggaatgagaggcctgaaaaacaatcataatatactgttgttgtctaacaatatatcaagtttttaatgactcttacgatgcaatatttttatcattcttgtagtttatccacgtgtatttaatattact

SEQ ID NO: 463752 - DNA, 960 bp, Homo sapiens
ttcatgaatgggttcagggtccttatgcaaggactggagggagtgggcttctcctgttttgcccttctgccttctgccatctgctttactgtcacacgtagcagctcaggtgaaaagcacttttaccgtggggactttcccttagtgctctgtgatgcacaagagcagacctatgtagaagcatttaagtattttgtctcccgggggtccggccctggaggacccgaagcccccactcccataacgccccttactacatccccactccagccgccactgcgactgccacagaacccccgccacgtgttgctgaacctgtttaaagcggccacagccggagttcgaagagcaaagcaggagtccgcctgggcaatgcgcatgcgggaggcacgagcccattctcccgtgacggtgactccaacggttggctgaggacgattccctgagccttgacaaagcaggagccctccgtggcggtgcgtcggtgtcgaggctccagtctgactaatccagggggtcgacaaaacagattcgggacactatgctacacggagggcctaccaggatgcagaaacagcagacggagtccagggaaagcagtgcggcatcccagcctcaggcctgcccgtacggtgttcgggcacctcctacgaaccaggatctgtacttgctgtcccagttataaagtaaaacagcctgtccttcctgcactcaaggagacagctccataagcggggagcttgttaaaaatgcagaatttggggaactattcacagagatttttactaagttacgtggaaaaaagcctgggactagctacgatctcccctctggtgatttggatgtgatagtctcttaaacatattttgaaatatactcgcccaaagaatggagaaagacccagccggccctcctcatgtggctgctgagggagatatatgtataattaaaaaactgcca

SEQ ID NO: 463753 - DNA, 1971 bp, Homo sapiens
actatgatgataccctgggtccacgggccttggttttaaagctgtggaaaactgtcccccagaaactagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcatgtgcgcaagctcaagctggaccagtgctttcagctgcggctcttcgagcaggatgctgagaaggtaggaagggaacaggccaaacctgagccgggatgggggtgagggagcagaggttgctcatccaactttctgattaatgatagtactttcctggaaagctttaaaacagtgtgcctactagttttagctaatgtaatttttttaagctcacccttatatagtgtgtattatgtgcccagtattgttctaagcactgtgtgtaaatttactcattttaatcctttcaagagtcctgagaggtagatgtactattataatcacattttacagatgaagaaactgaaaggttaaagaattcaccaagctgggaagtgcagtctggctccagggtccctgcttttacctactgttagaagctgccccgagtgcctgcaatgagtggctcaagccagctaaggaacaaaaacagtactgttaacagccactataatattaattagtgattatggccctgcaatgtattttaccattgacaaaccactttcacacagtcttatttaatctgcataatcctttgatccttatgggttgagtggtggcatctctcttgacatgcagggaaacggatgttctttgatcttgggtctacagtgacagagctgacatctgaatccagcatttttctgtttctaagtccagggctcttcctgccatacccacttgtttccaaaggtttctcttcagctgctaagcactttcttgagtaagacaccattttttccagcagtgaattttcaaagctttccccttatcagggaaaagtaagataagagaatgtaaaaaaggaaaattgcatatagtgcctctttgctgaggatacaaaggtatctttcctagattctctttaagctaaagagaagaaagaagagtttactattatatgtgctttaagaagaataaaataggctctcttcctatgagttttctggatataacttatatttaaatggccaatactgttcttagggatgccatgacatctctcagtaacctgtgaattttacaatgtctgatatcatggttttctgtcttttaagagctcatattgaaaaatgtctctaggtatttttaaatgatgaaatcgagatcttcagctctctgtataagtgtgatcccaatttatgtattaaatataactgcaagaaaatttatcagaatattaatagttttgcttccttggggcaggcttatggttgattttaatttctctgtataattttataatgttttctaattttttataacatatagtaaaaaaattagtatatgcagtttttttaatgcatatcactttttatagcatatcactttttatataccttttgaatatgatttaagcaaggtttgggaacttctgacctttcttggggctctttgcccagtggcctg

SEQ ID NO: 463754 - DNA, 1217 bp, Homo sapiens
ctggcggcccagttagggaagatgagtacttctgggtctgtgacgttgggaaggggcaaactcagttgtgtgtggggttcgggtggatggcaacatcgcacttgtaaacatacccagaccaaagtgttagaggtatctcattctaaggagatgcgagtgggaagctgggtcgttgaactgacccccacccccagtttattgtcaggacctgatcaacttggtttttactccaagagactccccagcgttaatctctgtgtcatgcacatcctaagccttacggctgcatcagaactcccttgtctcaatgatacaggaagagaattgatggccactgggcatctgttcctcactggagcccactgtgtgctcacacccagcttcaccttggaatgtggtagggagcaggagcatggggtaggtgaggagtgacctggaagaggtatcaggaccattccttaacatttctgataatcggtgcctgtgaagacattcccgcagtgtctgcggagtcctagaaagagagcagaggccacacaaaatgcttttctgaacccaagatcgccatactttgtggaatcttcccattggacatagcagtgagcacccgtttcctttcctgccctcacctgttcctgattcggaatgcttctgccaaataaatagtcactggctacccaaggagtttaaagtctaagcctggtcaatgcacacccagaagagttaagttcagtgataaagggaaatgtagatgaacatactaattcagcccatgtgaccactttgggcctcagctgttaggttgagaagtaagaggggattgaatgcgctccaaagatccgttcagttcctaatgttgcttaattctatacatgtggcaaaaggcttgtaacataaattaaatgaaattcccttattaaattaaaaagaaggttgagaacacattcaggttgtttttgccctggccagtagactctctttagcaggcagccgaaaagcttaactaagaagaatcagccctttattgttactctctttggggatgtttatctttgtatgtttagaaataaaaaaccttggtccttactttcagccctgaaataacctgctttcctttagtgaagctattttttcccttgggaaattgagattcaaagagtagagaagatgaccaggctcatagccttctgtggttcctcgcacagtgccctggggac

SEQ ID NO: 463755 - DNA, 1565 bp, Homo sapiens
tccagataaaactgggtttaaaatgaaggtggggggcgttaatggggagaaaaacggaatagcaggatcaaatgacttccagcttgatgtttccctgaattctaccatcaagcaaaactgtcattcattcacgctacaattagaaaacaatacaccaaccagccatcagtgtaagtatttcaggctcatcagcaatatgaatgtcactaatgcattgctctacataaaagagagtggagaagccctgggattatcaacaggtaatggtgatactgcagcagttggctgcatgagatttgtgattacagacttgagagtggctgtcacctttggtgctaccagaagtagctttcaaaactgcccttctgtaacagagaattctagaagggtggtccatggaccatctatattagaaggacttctggctctgcttcgcctgcggattactggtcctgctcaggcaaactgaatcagaatcactttctagtagagacttgagaggacccatagctcttgccaacacttgattgcagcattgtaagagaccctgagccaaaggactcagctacaccatgctggctcctcgcccatagagaccatgatataataaatgtttgttattttaagatgttaaacttggagtaatttgttacacagcaatagataactgatatgcttctaatcattgcatggtgtccatagcatatttttaccacattttacttgtccacttcctgcagatgggttgcttgctgcctgaatctaactcctgctactactgcaaataccactgccatgaatatcctcagcaagacccccttccagacctgcatgaacagttgtgtgaaatgtatatgcacaaagggactgcaagggaagacccagagactagggaagaacttggaacaataatctcagtttcttcaattcctaaacttgagagtattgctgtttttaaatgaaagtattttttccccctaagcattttgttctaaagttgagctgcctttgaggggaaataaagagactaccagattaatgggtttttttcaaatgggatggtggggtaaggaataatcggggtggtctgtggaacaacttggaggattggtgttatgtctcaagaagatattcaagtatgttcctccttttttacccagaccgactgcttcatgctgggcttcagacatgagaggctaggagtaggaggcatgccttgttcaaagatacccagttctcccaggaccatttgttgaaaaggcaggcacctcattttacagaagaggaaactgaggcccagaaagagaagtggcatgcccaaggctgtgccagaagcaaagtgtaaaatagatcctgagcctccgactcctgtaactcctccaggggacagcagcatctcttctgactctttgcttccatgtcttgaggaagcagcctcctgcctatggccatctgaggaagccatcttggaagcagacccctcagccccagtcaagccttcagatgactgaagtctcagctgacatcttgactttaatttaaaaaaaaaaaaaaaaaaaaaaaaa

SEQ ID NO: 463756 - DNA, 677 bp, Homo sapiens
tactactactaaattcgcggccgcgtcgactggggctgcgcctatgggtttgcgaggctgacagtttcctaggcgtcaccccaagccgtgaccaggcctttcctcctcaccaaagtgcgacattggccctggaaatcccccgggcaagagagggttgtaaattcagcttccttaacgtcgcagattagaatgttctacaccacagcacctgcataaataaaggtcttctagatgccagtgattttcttcatgccaaggaagaccacggatcgccagcaagcaccaggcgccagaagaaaggcatggaacggatgctctctctgagtcccctgaaaggaatcagtcctgctgacgccttgactttggccttccagtctttggaactgagaaacactataattctgttgtttcaaagccaccagtttgtggtcctttgttatgacatcgtgagagaactaacacagcagggagcacactggattgaagatcatgagagctgcaccccagtctccactctgccgttaactgctggttctgcacatgtagtcatgcctgtcttaccaggattacaagtgtgagccactgtgccctgcctctcctccatttcctttgtgtttttaaatatttattaatgtatgtatttatgtttcttctcccatgcccttcagggatgaata

SEQ ID NO: 463757 - DNA, 942 bp, Homo sapiens
  misc_feature (1)..(2): n is a, c, g, or t
  misc_feature (8)..(9): n is a, c, g, or t
  misc_feature (11)..(11): n is a, c, g, or t
  misc_feature (14)..(14): n is a, c, g, or t
  misc_feature (16)..(18): n is a, c, g, or t
  misc_feature (22)..(22): n is a, c, g, or t
nntatttnntngantnnnttcngaaggaatggtaccagctcctccttgtatctctggtagaattcgactgtgaatccatctggtcctggacttcttttggttgaatgttgaatattggcccccactctcttctggcttgtagagtttctgctgagagatcagctgttagtgtgatgggcttccctttgtggtcaggaccctcagctgcaggtctgttgcagtttactggaggtccactccagaccctgtttgcctgggtatcagcagcggtggctgcagaacagtggatattggtgaactgcaaatgctgccgcctgatcgttcctctggaagttttgtctcagaggagtacccggctgttgggaatattacagaggcgatgctgtgtccttctccatgcatcatatcaggagacacaggaaatgaaagtttattacaatattggtggtggtaactatgatcactttgttaatgtgatatccattggtttctccactgtcaaattataagagcagaaggtaactattgtgaaacacattttgatgctctttttaaatattttttgtttttatttattttaaaaaagtttttattttttttaatactttaagttgggatacatgtgcagaatgtgcaggattgttacatagcatatctgcatgttctgcacatgtattccagaacttaaagtaaaataaaaaaatttttttaaaagatgtaactggcattaattttagaaatgcaaaaatgaaagacctgataatgaaatcaggaagaagaagagttgaaggagaaggtgggtgtactaatatcctcatctgatgagggcaatcacaaagaagtatctatagcgaatgggacaaaaaaagaaaggtattatagttacaacagagaaactaaaaatagagataaaactaaataaaggatgggcatggtggctaa

SEQ ID NO: 463758 - DNA, 944 bp, Homo sapiens
aggcacagaagctggagccagcgggaggaggcaagcgggcaaccgaacagaatgatgagaaaaaccgaagctcagggaacatttccaagaccaagagctgagaacgctgcggagctgaaatttaaatccagtttgtcagacccccccaatccgacattgtcccctcgtcctgccatggcccatatcccaggaggacctgtcaccatcctccaccttggatcccccaaagccctgtttctctctttcacagcctctctctaccttattcctatcaccaagggattcttctctctttccctctttctactatttgttagaatggaaagcactgggccgggggagaaaaatttaaggcagagtgatgtgagaagtgtcgacaagacccaggaaagcccagggagaggggctggggctaaggcgtctgcccgcttggcagcagctgtgatgttcggaaatgatggatcaactctggaaaacctattaggaaagggctgggccatcctgcgtttccgccaggcctgtccaggtgactttgagaggccaaatcactgctgggtgagtgacccactgctaggaagatgcccagacgccaactgggaaaagcttggccaagccaatcaggtgctgccagagccttctttgtgatagcaatgccaacccatgaactaataccctcctttgggagagatgctgacacgccaaggaaactaatgtttttatctcagctgactcatttgctgagaacaacaggtttataaggcaactcttagcttgacccactctactcctccatcaaaataaagaaataaataaagttttcaaactaaagagcattaaagaatgataacttttctttttcttggtactatctattgacctatacctggttttcactgtaacacatttgtggtatgaaaaatgacaatatgatgtcagagaaaatg

SEQ ID NO: 463759 - DNA, 2790 bp, Homo sapiens
actgacacaaaagtgattgggcatgaaatacgccatctgcaaaactgaactcgtcctctttcccccgaatgtatctcccagatgtccagaatacgccatctgcaaaactgaactcgtcctctctccccagaatgtatctcccggatgtccagaatacgccatctgcaaaactgaactcgtcctctttccccagaatgtatctcccggatgtccagaatacgccatctgcaaaactgaactcgtcctctttcccccgaatgtatcatctcccagatgtccagaatacgccatctgcaaaactgaactcgtcctctctccccagaatgtatctcccagatgtccagaatacgccatctgcaaaactgaactcatcctctttccccagaatgtatctcccggatgtcgagaatacgccatctgcaaaactgaactcgtcctctttcccccgaatgtatctcccagatgtccagaatacgccatctgcaaaactgaactcgtcctctttcccccgaatgtatcatctcccagatgtccagaatacgccatctgcaaaactgaactcatcctctttccccagaatgtatctcgcggatgtccagaatacgccatctgcaaaactgaactcgtcctctttccccagaatgtatctcccggatgtccagaatacgccatctgcaaaactgaactcgtcctctttccccagaatgtatctcccggatgtccagaatacgccatctgcaaaactgaactcgtcctctttcccccgaatgtatctcccggatgtccagaatacaccatctgcaaaactgaactcgtcctctttcccccgaatgtatctcccggatgtccagaatacgccatctgcaaaactgaactcgtcctctttcccccgaatgtatctcccggatgtccagaatacgccatctgcaaaactgaactcgtcctctttcccccgaatgtatctcccggatgtccagaatacgccatctgcaaaactgaactcgtcctgtttcccccgaatgtatctcccggatgtccagaatacgccatctgcaaaactgaactcgtcctctttccccagaatgtatctcccggatgtccagaatactccatctgcaaaactgaactcatcctctttcccccgaatgtatctcccggatgtccagaatacgccatctgcaaaactgaactcgtcctctttcccccgaatgtatctcccggatgtacagaatacgccatctgcaaaactgaactcgtcctctttcccccgaatgtatctcccggatgtccagaatacgccatctgcaaaactgaactcgtcctctttccccagaatgtatctcccggatgtccagaatacgccatctgcaaaactgaactcgtcctctttcccccgaatgtatctcccggatgtccagaatacgccatctgcaaaactgaactcgtcctctttcccccgaatgtatctcccggatgtccagaatacgccatctgcaaaactgaactcgtcctgtttcccccgaatgtatctcccggatgtccagaatacgccatctgcaaaactgaactcgtcctctttccccagaatgtatctcccggatgtccagaatactccatctgcaaaactgaactcgtcctctttcccccgaatgtatctcccggatgtccagaatactccatctgcaaaactgaactcgtcctctttccccagaatgtatctcccggatgtccagaatacgccatctgcaaaactgaactcgtcctctttctcccgaatgtatctcccggatgtccagaatacgccatctgcaaaactgaactcgtcctctttcccccgaatgtatctcccggatgtccagaatacgccatctgcaaaactgaactcgtcctctttcccccgaatgtatctcccggatgtccagaatacgccatcggcaaaactgaactcgtcctctttccccagaatgtatctcccggatgtccagaatatgccatctgcaaaactgaactcgtcctctttcccccgaatgtatctcccggatgtccagaatacgccatcggcaaaactgaactcgtcctgtttcccccgaatgtatctcccggatgtccagaatacgccatctgcaaaacagaacttgtcctctttcccccaaatgtgtgtccactgcttgaaccaggaaactggatatcatcttaaatcctccctttcccaccaccaccaaatccaagctggggagcccctcttctttactgcctctgaaaaccgcactgtccccccacaccccatggatcctgcttgaacccaggcactcatcacttcttcgctggggtatgaccattcccctggccttcctatcttcccatctatgcccaacatggctgccaaggggatctgtcctaaatgcaaagttagccatgcctgccctccctcccctggcttgcctgaaatctttcaggaagctcagagcttttaagacaacattttgagaacaaggaccttttgcaattttacgtcttctgttttctggagtccccaaattcagctcagccttcatggcttctaagaaacttgccttgacctcatctttcctatgcgttctgtgcctagctagcaaaattcttagctgacattactttgatcatgaactttgttgcctgtgagttcccagagggcaggccaagtctgacttggctttgttgcaaagtctagcacatgatggacattcaataaagttttgatagagagaaaagcaaaatctcagacttcttagctcatgatgtcccagtgaa

SEQ ID NO: 463760 - DNA, 1284 bp, Homo sapiens
gattgtcaccatatttatgtccataagtacccaatgtttagctttcacttacaacgactaaaaaggagcaagtcaagaaaaaggaaagctataaaggagacaaaaagaagactaccagatgaaacaattaccctgaaaaactcatgtattttattaaaggagtacaaataccccacaaatgacaataaatctccaatccctctactttccactctgtttggcaacaatgggcttggaactttgcaaatcacacttcaacatcaccagctgctcacattcttccaagagataccagaagggaaactgggaagctggaggagaaggggagaggaccatgccttccctagacaaaagacaaagccttttgcttctgctataaataggacaccctcaggaaagctggagcttctaattcttccagtgatggaactcagcatatgtctgaggagcagagaattcagaagctcccatgggcctcccacagctggaatctaaaacaaccacagaagtctcagaaaagagaatataaaagcatacaacaaaataaaggactcataagagtacagggatcacatacatgaagttgaacaatgttcggttttaattcttcacaattatcatttgtaagattgtaggcattggccatggaaccccaagtctccagccatctccagttctctgcaggcactgaatgtatgtgctaaggcaagccatctgcagctgctgcttgaagggaggtacagatacaacagttggaaaccttggtcaccacagcagaggtgtggggccaatccacaatgcagttggagcatgttaacttatggatgaaatgacagagaagacacagctgcttcagcgctctctccatgcttgcaggaaaccatctaccaccactcaggtttccagcggagcccatccgagcagcacagctgccactgggtaccacaacccatgttgcagccacgtggctggcccagaagcagcagggaatgaaggctcactcacctcgggatcctcttcgtaatgccagttgtcggttctaactgaggtgcgaggggagttggtgggcaagtggcagaagactttctgcaatggttaatgtcattttccagcatacagtgctatatagtaaatatgtagccaaataaattctaaataaatgtaaaataacttagatgaacggattaactctataatattctctctgtatataagatttttaaaatattttgacaacttttatctcagaattttgtgtattttattttatttcatttttaaaaa

SEQ ID NO: 463761 - DNA, 864 bp, Homo sapiens
tgaggccactgcccacccaccaggtaccatctctcaagcgtgccctgaagttcagggaaagacgccagcgccccctgctggttgcgctctcccatagcagggctcacattttgggagaaagaaatcagctgttagcagctttcgttcttcaccatgttaagcaaagcacaacattttataactgggtgaaaagccagatattctgtcagctgatttgattgttctgtacgcatatccctaagccattgtttgacggatatttgtactgagttgactttcttcataagatgataggactaatgaagagaaaaggcaatggagtttttaaaaccagcgtgatgaaccaaatgctgccactgactagctatgtacatgtaatccaaaggttccctccgttgaaacaaaataacagtgcttacctaaccaggcaccatgggagcctgttgtcaccctggatatctagctccatgcccttgcccttccactctgcctcgacaagaatcatggcacccaaaatacatgagttcaaatctaagtttcacaggctcagggatgaacccaagctaccaaatgcacaggcccctcctgtatacggttacagcagcagtatatatgagtctttctttcacttcttgccaactcttaccaatctaatgaatgggaagtggtaactcattattatttcaatttgtattccctgtattaatccctgagaccttaacacttgtgtattgcacattctggttcctctttggcaaattgccttggcattaagatagtaaattttccttgccacctacgctggttgagtcaggatgcttaattacttggagatcctttcttggaaacgctgagcctggccag

SEQ ID NO: 463762 - DNA, 1228 bp, Homo sapiens
aggaaggacgctgtgcagagctgccatgttagaaaactcaggagccatggccgcatgtttggggcttgttttctccctgaaggagagtcaggaggacgtgctcattcccgctggcctcagctccatcctcaccatcccaggcgttctcacaggctcctcttccccagtctccctggccgcaatccactcagtaaataccctggccccgatggcggctttcactgatgaggaaaccaaggatcatagcggtggagacgtttgcaaggtcacacagctaagacgtagcagctgtggtctgtacccggatctgatgccattgcctgcctgctttctgctgccttccagggactctgccggtcagcaggtgtatgacagaagcatatatattagccaaaacatggtctctgtcatctgttttctaactcagataaaggtgatcttaaggacgtggacagcacagtttaggatcaaatgttctgcaaaatctgggtcaggtcaggaatttacctaatttgacatattgtttccgactcctttgacatttctcttcatttggttctgaatatacagtataggagatttttttcctattaaaccgtgtccggcggtgtaaaagctcttggggttgctgatctcatggagctctgcagtttgcctcaagcaattctttggacttcacagagcatcctgttattttgttacagacttaattccttgatctcatgcatcctggaagtttctagtggcaaaagcctctccccactctgcagctgtcacttatttataagccagaggcactttctgtatatgcaactttcatcatagagctctgagagaaaggtctggcatttctggatgattctggccaacccagagctgcacagagccctaacatttcatgagagagaaaatcaacaggagaatggccactgtgggcatgacacgtggcaatgtgatcgctaaccccacggaaccagccacttaccgctttctgaaacccagatcgtcatcccgcagtgtgatacaaaaggaagatcatcttgctagatgccaagaaccgtagttatgacactttttgtcattctgtttcctcttatttatacagtggagagtaggatgttttcaaataaaccttctaaatatgaaatcctgagaatgcattacttcaaaaatgctgcaccgttagcagccttttagttggttacattataaaacatgtagaccagta

SEQ ID NO: 463763 - DNA, 2608 bp, Homo sapiens
ccagctgcgggctggtgtcatggcaggtgggcggcgccgcaggaggcgcctggcggagctgacggtggacgagttcctagcttcgggctttgactctaagtccgaatactctccagaagcggagacgcgggaggcacgcgaggctgcccggagtccggatgagccgggcgggagcccctcggccagccggcgtaaaggccgtgcctctgagcacaaagatcagctctctcggctgaaggacagagacgccgagttctacaagttcctgcaggagaatgaccagagccagctaaacttcagcgactcggacagctctgaggaggaagaggagccgttccactccctgccatatgtgctggaggaagccagtgaggatgaggatggagcagaggagggggaagatggggacagagtccccagagggctgaaggggaagaagaattgtgttcctgtgaccctcgccatggttgagagatggaagcaggcagcaaagcaacgcctcactccaaagctgttccatgaagtggtacaggcgttccgagcagctgtggccaccacccaaggggaccaggaaagtgctgaggccaacaaattccaggtcacggacagtgctgtgttcaatgctctggtcgtgttcaatgctctggtcaccttctgcatcagagaccttactggctgtctccagaagctgctgattggaaaggtggcaaaggacagcagcaggatgctgcagccgtccagcagcctgctctgggggaagctccgtgtggacatcaaggcgtacctgggctcggtcatacagctggtgtcctgtgtggcagagacagtggtgttggcggccgtgctatggcacatcagcgtgctggtgccctgcttcctgaccttccccaagcagtgctcaagagaatgcagagtctgccggcacaagaaggacactttccttggccccatcctcaagcaaatgtacatcatgtatgtgaggaactgcaagttcacctcgcctggtgccctccccttcatcagttccatgcagcggaccctgacggagctgctggccttggagccgggtgtggcctaccagcacgccttcctctacatccgccagctcgccatacacctgcacaacgccatgaccacccgcaagaaggaaacgtctgtgtacaactggcagtacatgcactgcctcttcctgtggtgccgggtcctgagcactgtgggccccagcgaagccctccagcccttggtctactcccttgcccaggtcatcattggctgtatcaagctcatccccactgcccgcttctacccactgcgaatgcactgcatccgtgccctgacgctgctctcggggagctcgggggccttcatcccagtgctgcctttcatcctggagatgttccagcaggtcgacttcagcaggaagccggggcgcatgagctccaagcccatcaacttctccgtgatcctgaagctgtccaatgtcaacctgcaggagaaggcgtaccaggacggcctggtggagcagctgtacgacctcaccctggagtacctgcacagccaggcacactgcatcggcttcccggagctggcgctgcctgtggtcctgcagctgaagttgttcctccgggagcgcaaggtggccaactactgccggcaggtgcagcagctgctggggaaggcagtggaagcctggcagaagctgaccctggaagaggggacccccctgaccttgtactacagccactggcgcaagctgcatgaccgggagatccagctggagatcagtggcaaagagcggctggaagacctgaacttccctgagatcaaacgaaggaaggtggctgacaggaaggatgaggacaggaagcaatttaaagacctctttgacctgaacagctgtgaagaggacgacaccgagggattcttggaaagagggatactggggcccctgagcactcggcatggggtggaagaggataaagaggacaaggaggagggcgaggaggacagcagcaacttggaggatggagacccagacgcagaggcggggctggcccctggggagctgcagcggctggcccaggggccggaggatgagctggaggatctgcagctctcagaggaggactgaggcagcccatctggggggcctgtaggggctgccgggctggtggccagtgtttccacctctcaggcctagaggctggcgtctgtgcagttgggggaggcagtagacaggggacaggctttaatatttatttttcagcatgaacgaccaaacttaccgagagctaggctgggctggcgtggctgctgaagccccacagttgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtaaaa

SEQ ID NO: 463764 - DNA, 1748 bp, Homo sapiens
atgtaaatgccacaataggtattacagttctgtataatgagcatttatcaaattcccctagttctgtgcccctcaatctggcatatatgcaactatgacaggaggtactaaaagccttagataagcatggtgtatctttttttttccccacgtatattttttgttgtttttttttttttctgttattttgtccgtggttcttccataacttataaacttgatttataccgaggaggtgggaaattgggcggggcagggttggacttgacccgggattggggaagctcctctcgcttgccccctcggggcgggcctaggccctttggaggatggggacgccaggacacccctccctgaggttgtctggccgcctctgcccctagtgctcagaatcctgcgtgcccctcaattccggaatccctcctttccgatgtcccccccaacccctgaggggggagggaagggaggggggtcaggtctcccctctgtggcagggggaggtggaggtggaggtggaatcggaagggcgtggaaggcgggggccaggagggctcagccgatggtgagtccaaagccacactggaacttgttcttgcggtgattcaggaaggccccaagggccagcgtcaggggcaggagctggagcttcttctccagcgtggcacccacgatccagttgctatccacagagcctttgaagaggaggttggccttgggcaggtccagctggtacccgaaggagacgctggtatcctgcatccttgtgctggcctgaaaatccacacccacctgcaactggtcactggctttgtggtagtatgttgcgtgcatgcccgcctggctcaacgttaacgttgccaaccagttgttcaatgtgtatttcccagctagagacatgacagtgccctcgtccccaggccgccggttgtagaccagctctctgcccagggccaggcaaggcctgatgctctggaggtagtgggcttcgagaattcttgaacccacgaggacgtctgggttccccagggtgacggctgctgtgagtcagagccccgatactccccgtccacctgccagttcacaaacttcgactgctgggtctggatggccatcttggacctgagaccggggcccagctggtgaatgacctgagcgtggagactgccgctgttgtccatgtcacctaccagtacagggaacgcctctgtgggactcagctgctttgtccccacatacgtgaccccgaagtggtactccttacacctccggtggcactcctggaatgtgcccgggttgggcaggcagccgcaggccccatcctcggcggcccctgaggcgctggcggttgcagccccgggggtccgttccgaacctcgactcctaggggtgccggcgcccaggccgcctctcagcggcggcagcgtgaagcccggcggcgagggcggaggtggcggccctgcgggcggcgagctggcggccaacatgttccccatggtcgctggcggtggcgcctgctcccggcctggtctccgctcccacccggtgcgtcacgcgcaaccgaactcgctgccgccgccgccacccccattgtattactaatattctgtaacattaaaattacttgtctttaaatccatcaatagtatttctgattttaaaataacatttgattttaacttcatatttttagtgtaaaaaaaaatcttaggttgacctaagatttgaaatttaaaagtgattagcaaagg

SEQ ID NO: 463765 - DNA, 1432 bp, Homo sapiens
gctctggctggctgcagtgtccatcgctgccaccaaccacaaacagggctgcaaacaggaaggattttattcaccagcagaacgcagctccgccctcgcggtgccaccggcccgcccgcccgggtctctgctgaggagaacattgctctgccttcgctgtatctccgaagtctgtgcagaggagaactcagctccgccctcgcaatgctctccggctccgccctcgcaaaggcacacagcgctggcgccggcgaggcggagaggcggacagcggcggagaggcggccagcggcggcgcggcggagaggcggacagcggcggagaggcggccagcggcggcgcggcggacagcggcggcgcggcggacagcggcggcgcggcggagagacggacagcggcggcgcggcggcgcggcggagagacggacagcggcggagaggcagacagcggcagcgcagcggagaggcggccagcggcggagaggcggacagcggcggagaggcggacagcggcggcgcggcggagagacggacagtggcggagaggcagacagcggcggcgaggcgcggagaggcgctggcgccggctctggcgcggagaggcgcaggcccaggctccactccccagctgtgaaaggcttcaacattgctttatggcatgtgtggtcgtttttcactccattgttgttgtttacccagtttatgggggttgtaatgtttatcacactccttggatgatttccgaagatcaccccatcctgagatctgctgccttacacagtggaggctgttttctgagtgtcggataactctgttattaaataagtgcatattgagaatactcactccagatgcttagaggcatgttgagaaggacaaagatagtgcctcctgtcaggtcacttacatcagaacttgcaggaaacctgctttatacagcagttgacaggtgtggaaattgaagctcatggaaatgaaagttaatacactaaattttcaaggagttaatgaaaactgacatttctgctaaaaacagcatgttctccctgtgggattttaaaggaaggtcaatggtaactgtacaaagaagaaatggacatagtctcattgttagcagtctgaaaatagttgctagcacctccatgcccacgccaatgtctccagcctccttcaagcaccttgctgtgtcttggaaccattgggagccctcacaggaggcccttcgttcctgtatgcatgtggtgccacaagctgctttgggcccggaggaatcctacacatctcagaacacttcctcacctgaccctgtcacccatctctccccttctcatgtgctcagccccttctttgactcttgaattttgagtttttacagatgtttgggagctcttactctgacatgaatttataattgtaatggagactcagacaac

SEQ ID NO: 463766 - DNA, 1752 bp, Homo sapiens
ctgctaaactgtttttcaaagcagctgccccatcttacattcccacctgcgatgtgggagagttctgacttttccacttcctcacccacattgttcttgggcatctttttctgactgtgcccagcctgtcctttggcttcatcgtgccgctgcgatcatgctgttctgctacagattcaccctgcatacgctgtttaaggcccatatggggcagaagcactggaccatgtgggtcatctttgctgttgtcctcattttcctgctctgctggctgccctacaacctggtcctgctggcagacaccctcatgggaacccagatgaccaatgagacctgtgagcgccgcaacgacatcaaccaggccctggatgccactgagattctgggcatccttcacagctacctcaatcccctcatctacgccttcattggccagaagttttgccatggacttctcaagattatagccatacacggcttgatcagcaaggactccctgcccaaagacagcaggccttcctttgttggctcttcttcagggcacacttccactactctctaagacctcttgcctaagtgcagtcccgtggggttcctcccttctcttcacagtcacattccaagcctcatgtccactagctcttcttggtctcagtgtcagtgcagcccccactgtggtcgcaggaagcagaggaggccacgttcttactagtttcccttgcatgatttagaaagcctgccctggtacctcaccccttgccataattactacatcacttgctggagctctgtccctcctgcccttgagctcatggcactctatgttctaagaagtgaaaatctacactccagtgagacagctctgcatactcattaggatggttaatgtcagaagaaagaaaatcataaaatagaaggtgtccacaaaggtgcagagaaagtggaattctcgggcatcgtgagcgggaatgtaaaatgttgtggccactgcggaagacagtatggcatctttcctcaaaacatcagacatagaattaccacatgatcctgcaattccacttgtagtaattgacccacaagaagtgaaagcagggacttgaacacatatttgtacaccaatattcatagctgcttattcataagacccaaaaggcagaaacaacccaaatgttcatcaatgaatgaatgaatgaatggctaaacaagatgtgatgtgtacaatgttcatcaatgaatgcatggctaagcaaaatgtgatatgtacataacgaagtatccttcagcctgaaagaggaatgaagtactcatacttgttacaacacggacgaaccttgaaaacttcatgctaagtgaaataagccagacataaacagataaatagtttatgattccacttacatgaggtactgagagtgaacaaattcacagagacagaaagcagaacagtgattaccagggactgaggggaggggagtatggggagtgatggtttaatgggcacagagtttatgtttgggatgttgaaaaagttgtaaagataaacagtagtgatagttgtacaataatgtctgagtacttaatgccactaaactgtacacttaaatgtctaaaatggtaaaattttatgtatattttacctcaattaaaaagaaaacaccttggcccccaaaggtacttttgccaaagaaccaaggctgaaatttcttgctaaatgagataattaaatgtctttcattgcttaaaacacttttg

SEQ ID NO: 463767 - DNA, 947 bp, Homo sapiens
ctgctaaactgtttttcaaagcagctgccccatcttacattcccacctgcgatgtgggagagttctgacttttccacttcctcacccacattgttcttgggcatctttttctgactgtgcccagcctgtcctttggcttcatcgtgccgctgcgatcatgctgttctgctacagattcaccctgcatacgctgtttaaggcccatatggggcagaagcactggaccatgtgggtcatctttgctgttgtcctcattttcctgctctgctggctgccctacaacctggtcctgctggcagacaccctcatgggaacccagatgaccaatgagacctgtgagcgccgcaacgacatcaaccaggccctggatgccactgagattctgggcatccttcacagctacctcaatcccctcatctacgccttcattggccagaagttttgccatggacttctcaagattatagccatacacggcttgatcagcaaggactccctgcccaaagacagcaggccttcctttgttggctcttcttcagggcacacttccactactctctaagacctcttgcctaagtgcagtcccgtggggttcctcccttctcttcacagtcacattccaagcctcatgtccactagctcttcttggtctcagtgtcagtgcagcccccactgtggtcgcaggaagcagaggaggccacgttcttactagtttcccttgcatgatttagaaagcctgccctggtacctcaccccttgccataattactacatcacttgctggagctctgtccctcctgcccttgagctcatggcactctatgttctaagaagtgaaaatctacactccagtgagacagctctgcatactcattaggatggttaatgtcagaagaaagaaaatcaggctggccaacggggtgaaaccctgtctctactaaaaatac

SEQ ID NO: 463768 - DNA, 1861 bp, Homo sapiens
tgcgcatgcgcacccgcgtcccgctgctgtttagccgtttccaaggctacgaagcccatcggccggggataagagagcaagaaaatgaagctcaagagcctcctgctccggtattacccgccagtctttggtgagccaaatcatatgcaagtttccaagatactactgaatagcaggaattatgttggaatatgaaaaacatggagaattaaagactaagtccatagatttgcttgatcttggtcccagcactgatgtcagtgcgttagtagaagaaatccagaaggcagaacctctactcacagcttcacgaacagagcaagtcaaacttttgatacagaggttgcaagagaaactcggccagaacagcaatcacacgttctatctttttaaggttctcaaagcacatatattgccactgactaatgttgcacttaacaaatcgggctcatgctttatcacaggaagctatgatcggacgtgcaagctctgggacactgcgtctggagaggagctgaacacgctggagggccacaggaatgtggtttatgccatagcattcaacaatccttacggtgacaaaatcgccactgggtcctttgataaaacttgtaaactctggagtgtggaaacaggaaaatgttaccataccttcaggggtcatacagcagaaatagtgtgtttatcatttaaccctcaaagcacattggtggcgactggaagtatggacacaacagccaaattgtgggacattcagaatggcgaggaagtttacaccttaagaggacattctgccgaaatcatctccttgtcatttaacacctcaggagacagaatcatcacggggtcttttgatcataccgttgtagtgtgggacgctgatactggaaggaaggtaaatatcttaattggtcattgtgctgagattagcagtgcctcattcaattgggattgctctctaatattaactggctctatggacaaaacctgcaagctgtgggatgctacaaatggaaaatgtgtggcaaccttaacaggccatgatgatgaaatactagacagctgctttgattacactggaaagcttattgcaactgcttcagctgatggaacagcaagaattttcagtgctgccacaagaaaatgcattgccaaactggaaggtcatgaaggtgaaatttcaaagatttctttcaaccctcaagggaaccatcttctaactggcagctctgacaaaacggctagaatctgggatgctcagactggccagtgcctccaggttcttgaggggcacactgatgaaatcttttcatgtgctttcaactataaaggcaacatagtcattacaggcagcaaggataatacctgtaggatatggcgttgactgaaggaagctggtcagtgagcaaccttgctagcaatggtaatcaagaactggaacttcacagacagcagctctcttaatatttcttatactttctctttttctgcaagtcaactatttctacaactgtccttcatttcacagatatgaccattaaacatgacaaagttatgccactccaatattattatttgatggcgatggcaggacacagcataatgtttggctaatgccaccagttatttcagttgtgtttgttttttaaaagcattatgatactgaaaaaggagaccagaacaacttaacaacgtgtctcctggattttactttgaagcctattgttataatttctgttgaataaagtgtttggaggaaattccttgtacatgtgtatttatgatgtatgtttttagggtgaagtaagggaaataatgcggatctcatttaatggcaaatatcttctgtattgatacattg

SEQ ID NO: 463769 - DNA, 1809 bp, Homo sapiens
tgcgcatgcgcacccgcgtcccgctgctgtttagccgtttccaaggctacgaagcccatcggccggggataagagagcaagaaaatgaagctcaagagcctcctgctccggtattacccgccaggaattatgttggaatatgaaaaacatggagaattaaagactaagtccatagatttgcttgatcttggtcccagcactgatgtcagtgcgttagtagaagaaatccagaaggcagaacctctactcacagcttcacgaacagagcaagtcaaacttttgatacagaggttgcaagagaaactcggccagaacagcaatcacacgttctatctttttaaggttctcaaagcacatatattgccactgactaatgttgcacttaacaaatcgggctcatgctttatcacaggaagctatgatcggacgtgcaagctctgggacactgcgtctggagaggagctgaacacgctggagggccacaggaatgtggtttatgccatagcattcaacaatccttacggtgacaaaatcgccactgggtcctttgataaaacttgtaaactctggagtgtggaaacaggaaaatgttaccataccttcaggggtcatacagcagaaatagtgtgtttatcatttaaccctcaaagcacattggtggcgactggaagtatggacacaacagccaaattgtgggacattcagaatggcgaggaagtttacaccttaagaggacattctgccgaaatcatctccttgtcatttaacacctcaggagacagaatcatcacggggtcttttgatcataccgttgtagtgtgggacgctgatactggaaggaaggtaaatatcttaattggtcattgtgctgagattagcagtgcctcattcaattgggattgctctctaatattaactggctctatggacaaaacctgcaagctgtgggatgctacaaatggaaaatgtgtggcaaccttaacaggccatgatgatgaaatactagacagctgctttgattacactggaaagcttattgcaactgcttcagctgatggaacagcaagaattttcagtgctgccacaagaaaatgcattgccaaactggaaggtcatgaaggtgaaatttcaaagatttctttcaaccctcaagggaaccatcttctaactggcagctctgacaaaacggctagaatctgggatgctcagactggccagtgcctccaggttcttgaggggcacactgatgaaatcttttcatgtgctttcaactataaaggcaacatagtcattacaggcagcaaggataatacctgtaggatatggcgttgactgaaggaagctggtcagtgagcaaccttgctagcaatggtaatcaagaactggaacttcacagacagcagctctcttaatatttcttatactttctctttttctgcaagtcaactatttctacaactgtccttcatttcacagatatgaccattaaacatgacaaagttatgccactccaatattattatttgatggcgatggcaggacacagcataatgtttggctaatgccaccagttatttcagttgtgtttgttttttaaaagcattatgatactgaaaaaggagaccagaacaacttaacaacgtgtctcctggattttactttgaagcctattgttataatttctgttgaataaagtgtttggaggaaattccttgtacatgtgtatttatgatgtatgtttttagggtgaagtaagggaaataatgcggatctcatttaatggcaaatatcttctgtattgatacattg

SEQ ID NO: 463770 - DNA, 778 bp, Homo sapiens
ctgtgtcatctgctgtcaacaatatggaacagcaagaattttcagtgctgccacaagaaaatgcattgccaaactggaaggtcatgaaggtgaaatttcaaagatttctttcaaccctcaagggaaccatcttctaactggcagctctgacaaaacggctagaatctgggatgctcagactggccagtgcctccaggttcttgaggggcacactgatgaaatcttttcatgtgctttcaactataaaggcaacatagtcattacaggcagcaaggataatacctgtaggatatggcgttgactgaaggaagctggtcagtgagcaaccttgctagcaatggtaatcaagaactggaacttcacagacagcagctctcttaatatttcttatactttctctttttctgcaagtcaactatttctacaactgtccttcatttcacagatatgaccattaaacatgacaaagttatgccactccaatattattatttgatggcgatggcaggacacagcataatgtttggctaatgccaccagttatttcagttgtgtttgttttttaaaagcattatgatactgaaaaaggagaccagaacaacttaacaacgtgtctcctggattttactttgaagcctattgttataatttctgttgaataaagtgtttggaggaaattccttgtacatgtgtatttatgatgtatgtttttagggtgaagtaagggaaataatgcggatctcatttaatggcaaatatcttctgtattgatacattg

SEQ ID NO: 463771 - DNA, 2793 bp, Homo sapiens
gggaggagaagcgcgggttcctggctctccacgcgcactgctttaatcagacccgtgcagcctcgagctggagtggccagctgggcctggagcaatgcgagcgggccccagggagcgacagcggcgttggcgcagcggccgaaggagccccggccgggaagtgtggatgcgtctctcccgaggccgggccgcctcgcccgctctagtccagcggagcccgagcgcctcggaccaatccccagtgattatgcaagacagcggaccaatcagctccgccagctcatgaatatttatgaccttcgctgagtcaaagctttgaaccgagtttggggagctcagcagcatcatgcttagacttttcaaagagacaaactccattttcttatgaatggaaagtgaaaacccctgttccgcttaaattgggttccttcctgtcctgagaaacatagagacccccaaaagggaagcagaggagagaaagtcccacacccagaccccgcgagaagagatgaccatgaccaccatgccagaaagtctcaacagccccgtgtcgggcaaggcggtgtttatggagtttgggccgcccaaccagcaaatgtctccttctcccatgtcccacgggcactactccatgcactgtttacactcggcgggccattcgcagcccgacggcgcctacagctcagcctcgtccttctcccgaccgctgggctacccctacgtcaactcggtcagcagccacgcatccagcccctacatcagttcggtgcagtcctacccgggcagcgccagcctcgcccagagccgcctggaggacccaggggcggactcggagaagagcacggtggtggaaggcggtgaagtgcgcttcaatggcaagggaaaaaagatccgtaaacccaggacgatttattccagtttgcagttgcaggctttgaaccggaggttccagcaaactcagtacctagctctgccggagagggcggagctcgcggcctctttgggactcacacagactcaggtcaagatctggttccaaaacaagcgatccaagttcaagaagctgatgaagcagggtggggcggctctggagggtagtgcgttggccaacggtcgggccctgtctgctggctccccacccgtgccgcccggctggaaccctaactcttcatccgggaagggctcaggaggaaacgcgggctcctatatccccagctacacatcgtggtacccttcagcgcaccaagaagctatgcagcaaccccaacttatgtgaggttgcccgcccgtctccttcttgtctccccggcccaggtccctcccgcctccaggtccatccatcccgtccggaaaagaaggacccagagggaagaaggaacagtggaggcgggacgccctccatctcctcggagccccgcgaggtccggcccagcaacttcccggcatccgcgctctagcctgaaccctggcctgggccgagcagtggcagcagagagtggcctcggagggaagccactgccacctgagacagcccaagcagcaagataaacccgctccacccgacccgccgaccttcagctttgtgggactatcaggaaaaaacaaaacaaaaacaaaatgtagaaaaagcaaaagctcttttctgtcctgtcagtctcctgtctccttttgctctgtctgtgcgctggtaaagtccaggtcctcatccgtccgctgtcctcattctgcagcctcagcaaaaagccacaagatctgagcggcccgggtcctgccgggctgaccatctccggatcctgggacactctgcctgaccatctgtgtagctggtgtgggaatctgggggcattggagggagggggttttatttattgagaaatggacttcgcctgaggctgtttgccaattcagggttctgctgggcgcaaggaacgcactgttcaaacgcactgtttactttaagcgcacggggagaaacgaataaggaggacgtggtgatttttaatttatacagtaacttttgtacttctctggtatggagagtttggagccgaatgatttgcattttttacatgtccgacattatttaataaataatttttaaaagaaaagaacgataaatgaagccaacatgattttctcatttcgggaggaactctgttgcttcgcctggacaagaaggaaaatgctgatttcctccttgggtagaaagagggagcgagggcaaatggggagtagagagaaaacaggcgagaacaagcactctaatttcagtgggctttaaaataagacaaaatcagctttacaacaatccctagaggctcgaccacagaataatgccagtcaccaccctgaacgcacaatctccagtgcaggatctaatgactgtacatattattgttattattattattgttattattgttgttctgtaaacatgttgcacaagcttagcctttttgcgttctgttgtgtgtggctgtaaaaccccatgctttgtgaaatgagaatcttgacatttttcttgtgaaatttggaaaatgtgatcaattgaaatcaactgtgttttgtgttctctatgtcaaagtttagttttatattgagaatgttaacttattgctttgtatcttgggaaaaaaactttgtaaataagttataaagtttctttgagacagtaaaattatgatttcttgaaagaactgctctcttgtgctgtgtgaggctgtgccaggggtccaggccaggttcccgcctctggagacagttcatacagggtcagcgacttatcaacttatc

SEQ ID NO: 463772 - DNA, 679 bp, Homo sapiens
ggcgggaggccgatgagccgcgggccgcaggggccccggcgcagacgccgcagcccattgtgcttcctgcccggcgcgctctgttgcagaggagccccggccgggaagtgtggatgcgtctctcccgaggccgggccgcctcgcccgctctagtccagcggagcccgagcgcctcggaccaatccccagtgattatgcaagacagcggaccaatcagctccgccagctcatgaatatttatgaccttcgctgagtcaaagctttgaaccgagtttggggagctcagcagcatcatgcttagacttttcaaagagacaaactccattttcttatgaatggaaagtgaaaacccctgttccgcttaaattgggttccttcctgtcctgagaaacatagagacccccaaaagggaagcagaggagagaaagtcccacacccagaccccgcgagaagagatgaccatgaccaccatgccagaaagtctcaacagccccgtgtcgggcaaggcggtgtttatggagtttgggccgcccaaccagcaaatgtctccttctcccatgtcccacgggcactactccatgcactgtttacactcggcgggccattcgcagcccgacggcgcctacagctcagcctcgtccttctcccgaccgctgggctacccctacgtcaactcggt

SEQ ID NO: 463773 - DNA, 2690 bp, Homo sapiens
gggaggagaagcgcgggttcctggctctccacgcgcactgctttaatcagacccgtgcagcctcgagctggagtggccagctgggcctggagcaatgcgagcgggccccagggagcgacagcggcgttggcgcagcggccgaaggagccccggccgggaagtgtggatgcgtctctcccgaggccgggccgcctcgcccgctctagtccagcggagcccgagcgcctcggaccaatccccagtgattatgcaagacagcggaccaatcagctccgccagctcatgaatatttatgaccttcgctgagtcaaagctttgaaccgagtttggggagctcagcagcatcatgcttagacttttcaaagagacaaactccattttcttatgaatggaaagtgaaaacccctgttccgcttaaattgggttccttcctgtcctgagaaacatagagacccccaaaagggaagcagaggagagaaagtcccacacccagaccccgcgagaagagatgaccatgaccaccatgccagaaagtctcaacagccccgtgtcgggcaaggcggtgtttatggagtttgggccgcccaaccagcaaatgtctccttctcccatgtcccacgggcactactccatgcactgtttacactcggcgggccattcgcagcccgacggcgcctacagctcagcctcgtccttctcccgaccgctgggctacccctacgtcaactcggtcagcagccacgcatccagcccctacatcagttcggtgcagtcctacccgggcagcgccagcctcgcccagagccgcctggaggacccaggggcggactcggagaagagcacggtggtggaaggcggtgaagtgcgcttcaatggcaagggaaaaaagatccgtaaacccaggacgatttattccagtttgcagttgcaggctttgaaccggaggttccagcaaactcagtacctagctctgccggagagggcggagctcgcggcctctttgggactcacacagactcaggtcaagatctggttccaaaacaagcgatccaagttcaagaagctgatgaagcagggtggggcggctctggagggtagtgcgttggccaacggtcgggccctgtctgctggctccccacccgtgccgcccggctggaaccctaactcttcatccgggaagggctcaggaggaaacgcgggctcctatatccccagctacacatcgtggtacccttcagcgcaccaagaagctatgcagcaaccccaacttatgtgaggttgcccgcccgtctccttcttgtctccccggcccaggtccctcccgcctccaggtccatccatcccgtccggaaaagaaggacccagagggaagaaggaacagtggaggcgggacgccctccatctcctcggagccccgcgaggtccggcccagcaacttcccggcatccgcgctctagcctgaaccctggcctgggccgagcagtggcagcagagagtggcctcggagggaagccactgccacctgagacagcccaagcagcaagataaacccgctccacccgacccgccgaccttcagctttgtgggactatcaggaaaaaacaaaacaaaaacaaaatgtagaaaaagcaaaagctcttttctgtcctgtcagtctcctgtctccttttgctctgtctgtgcgctggtaaagtccaggtcctcatccgtccgctgtcctcattctgcagcctcagcaaaaagccacaagatctgagcggcccgggtcctgccgggctgaccatctccggatcctgggacactctgcctgaccatctgtgtagctggtgtgggaatctgggggcattggagggagggggttttatttattgagaaatggacttcgcctgaggctgtttgccaattcagggttctgctgggcgcaaggaacgcactgttcaaacgcactgtttactttaagcgcacggggagaaacgaataaggaggacgtggtgatttttaatttatacagtaacttttgtacttctctggtatggagagtttggagccgaatgatttgcattttttacatgtccgacattatttaataaataatttttaaaagaaaagaacgataaatgaagccaacatgattttctcatttcgggaggaactctgttgcttcgcctggacaagaaggaaaatgctgatttcctccttgggtagaaagagggagcgagggcaaatggggagtagagagaaaacaggcgagaacaagcactctaatttcagtgggctttaaaataagacaaaatcagctttacaacaatccctagaggctcgaccacagaataatgccagtcaccaccctgaacgcacaatctccagtgcaggatctaatgactgtacatattattgttattattattattgttattattgttgttctgtaaacatgttgcacaagcttagcctttttgcgttctgttgtgtgtggctgtaaaaccccatgctttgtgaaatgagaatcttgacatttttcttgtgaaatttggaaaatgtgatcaattgaaatcaactgtgttttgtgttctctatgtcaaagtttagttttatattgagaatgttaacttattgctttgtatcttgggaaaaaaactttgtaaataagttataaagtttctttgagacagtaaaattatgatttcttg

SEQ ID NO: 463774 - DNA, 1251 bp, Homo sapiens
ccccaatcgggctcctccggccaggtgggtatgccatgagctttcctccgccctccagagctgaagcttggactgtctcaagctctatgaagctgcaggacttgacttcaatggagtgggccatccacacagccaggattcttcccctgctaatacagcagcagtgggaccgccttgcagtaggcacagcggagatgtgccctgccaggtccccagggggttctcagagaggctgtgagcaggtggctacagctgctggcagttcacacacagtcctcctcatgctcagagaccaaagggagaagagtgggaaacgagtggaacagggccaaaccatcatgacctggataacaattcctaaaacctgtcgaaggcgtcccaggggagtggggagagcatggttctcatcagcctacgaactacatggccttgccaagtttctcaaccccgggatttctcgggtggacatcaattaccaggattctgattagaacaagcaaacaaaccaggcaatggaaagaaacaaagcaaatgaatttcaatttagtcatctgaaatgatgccaagaaactagcagctttcttaagactaccttcctagtaaaaagtgaattatgttgcttaaatcagttgctttagttaatcatttaaaatctatcaaacaggaattctgagtggtttatatgtgcaggttctgacaatcagaaacgtttgttctaacttgtaaacatttatcaaagtaaggccttgtgtctccaaaaaaaaaaaaaaaaaaaaaaaaaaaaagccggggggtggggggtggggtgactttgatttgctgtcttcttagaccacctcctcatttatctagagcctccaacattttttctgatttgtactcatttatcctttctttccctttcatactgtctatctaaagagcattttaaaacaatctctgccttctatttttaaaaatgacaagtttacaagacctaagaattatgggctatgctttttttcttctttttgaaatggagtctcactctgtccccaggctggagtgcagtggagcgatctcagctaactgcaacctctgcctcccgagttcaagagattctcctgcctcaccctcccgagtagctgggattacagatactccactttaaggacagtccacattttgtttttccattaaccagctgatggatatctcagttgtttccagttttttaactcttacaaataaagctgctatgaacacgcatgt

SEQ ID NO: 463775 - DNA, 1636 bp, Homo sapiens
ccccaatcgggctcctccggccaggtgggtatgccatgagctttcctccgccctccagagctgaagcttggactgtctcaagctctatgaagctgcaggacttgacttcaatggagtgggccatccacacagccaggattcttcccctgctaatacagcagcagtgggaccgccttgcagtaggcacagcggagatgtgccctgccaggtccccagggggttctcagagaggctgtgagcaggtggctacagctgctggcagttcacacacagtcctcctcatgctcagagaccaaagggagaagagtgggaaacgagtggaacagggccaaaccatcatgacctggataacaattcctaaaacctgtcgaaggcgtcccaggggagtggggagagcatggttctcatcagcctacgaactacatggccttgccaagtttctcaaccccgggatttctcgggtggacatcaattaccaggattctgattagaacaagcaaacaaaccaggcaatggaaagaaacaaagcaaatgaatttcaatttagtcatctgaaatgatgccaagaaactagcagctttcttaagactaccttcctagtaaaaagtgaattatgttgcttaaatcagttgctttagttaatcatttaaaatctatcaaacaggaattctgagtggtttatatgtgcaggttctgacaatcagaaacgtttgttctaacttgtaaacatttatcaaagtaaggccttgtgtctccaaaaaaaaaaaaaaaaaaaaaaaaaaaaagccggggggtggggggtggggtgactttgatttgctgtcttcttagaccacctcctcatttatctagagcctccaacattttttctgatttgtactcatttatcctttctttccctttcatactgtctatctaaagagcattttaaaacaatctctgccttctatttttaaaaatgacaagtttacaagacctaagaattatgggctatgctttttttcttctttttgaaatggagtctcactctgtccccaggctggagtgcagtggagcgatctcagctaactgcaacctctgcctcccgagttcaagagattctcctgcctcaccctcccgagtagctgggattacagatactccactttaaggacagtccacattttgtttttccattaaccagctgatggatatctcagttgtttccagttttttaactcttacaaataaagctgctatgaacacgcatgtgtgccatttctgcacgtcgtctccagactccacacgggaaagctcttataggttttatagttttagcttttatatttaggtctacgacccttttaagcgaggctcatttttttctctatatggaaacctagtcgttttagcatggtttgttgaaaagattttcctttctccattaaattgccttgtcaaaaacgaattgaccatgtatgtatgggtctatttctggactttatcctactctactgatttatatgtccagctcttctccaacaccacactgtcttgtagctttactgcaagccttaaaatcagctaatacaagaatctcaactttgttctttttaaaaattggtttgactattttggattgtttacattttcagag

SEQ ID NO: 463776 - DNA, 804 bp, Homo sapiens
cctggggtttgatgcctccctgcccagagcccttgctatagcatatgctggtgagggccgaggctctagctcacactccagaccggggtagggatccaatctggctttgaagacatcatgcagagcctctgctctggagatgggaacctgcagacaaatgcctccttatctcaatcctctgaaaacagtttgaccagggagacagcgttcactcatgaatttaagaaaaaaaaaatccctgatccctactttttgccaacttcaatgctgatttctagtggtaccaagaaaaatgcaactgagcctccatcctcaaggggctcacagtcttgtgtggagataaaaaatccaagtcctgtgaccggggtcctgcccaagggtcctgcttccctaggcatcccagaagttcagcctgcatctcgaccagagcctgagagtagacacctgccggtttatctgtcccttcatgtagcaggtgacagaggtgccaggggcatggcaggggtactctgacacagcactgccccacggagcccatgtcccagggcagaagacccacgatgcacagccagccaggtggcctcatccgatcagtcaaaggcctcaatagaaccaagactgacctctgccaaagagagaattctttcagcagacggccttcggacttgagctatgacggcaactcttccccgggcccacctgacggactgggtttctcagcctccacagtcgtgtgagccaattccgtaagataaatctctctctcttctctctcaatctctctctcaatctctctctctctcc

SEQ ID NO: 463777 - DNA, 762 bp, Homo sapiens
ttgccctgaagagcttgccctggataccacaaatatgctgccgtcgggagctctgtattaccagccatggtcaaccccaccgtgttcttccacatctctgtcgacggtgagtccttgggccgcatctcttttgagctgtttgcagacaagtttccaaagacagcagaaaacttttgtgctctgaatactggagagaaaggatttggttacaagggttgctgctttcacagaattattccagggtttatgtgtcatggtggtgacttcacacaccataatggcactggtggcaagtcaatctacggggagaaagttgatgatgacaacttcatcctgaagcatacaggtcctggcatattgtccatggcaaatgctggacccaacacaaatggttcccagtttttcatctgcactgccaagtctgagtggttggatagcaagcatgtggtcattggcaaggtgaaagaaggcatgaatattgtggaggccatggagcactttgggtccaggaatggcaagaccagcaagaaggtcaccattcctgactttggacaactcgaataagtttgacttgtgttttatcttaaccactggaccattccttctgcagctcaggagagcagccctccaccccatctgctcgcagtattctagaatctttgtgctctcgctgcagttccctttgggttccatgttttccttgttcccttccatgcctagttagatggcagagttaagtttgtgattatgaaatgaaaacta

SEQ ID NO: 463778 - DNA, 1486 bp, Homo sapiens
ccgtaaatgtatgaccccattaatgaagggaaagccggctccccaccagccgtttccaaggcaacccacaggctggacaagcaccgtctcttctgtttcccattatggagatcgcctctacagcccataagaggagagcaagcatggtcagaaactctttctcccagtgttgcccgcacagttcgcaaatgcaaagctgtgagcagggatgcttatagctccaagctacgcggttggaactatcagagcatttgtgcatgctggctattactggctgtgtgcacaaggagtggaaacactacagtgaactgcacttgcaagggatctaggttgtgtgctccttatgagaatctaatgcctgatgatctgaggtggaacagtttcatctgggaaccaaccctcaacccctgcattcatgaaaaaactgtcttctaggaaatcagttgctggtgccaaaaaggttggggaccactatcctagagggtctagggagctcttaatatggaccactgaagatggacaacatttagccagtcctgatccagggggtgatgaaatcaatcttctgagttgtgaccagacttccttagaatgaaataaaataaagtacaatagaagaaaagagagtgaaagagaaaatactagagtgtggtgcaagattgtgtgcgtgtgtgtgtgtgtgagtgtgtgtgtgtgtgtgtgtgtgcgagagagagaaatatttgtttgcatttgtggacagtaggttaaaatgtaaatgtgaaatgtgtcctagtctggatatgtcaaaatgagtttataatccaatgttctagaacacatggaggctaactccaaacgttaacaatgacaacaaggcagtcagagccctggagagagatgcactcctcaacattgcctgttgctgaagattcagaactagcagcaacaccaaaacaaaaagatcaagctggggtgacattgtaacgagaacttctcagctggagttaattgatttgaacaattcaagtccaccaggcaaatcagcccaggacagcttaccacgctggccgagttaatttttttttcacatagtttttgaacggctgcgatgttaagaggagaccaaaggctgtgagatggagaaaatagaattcactgaatgtcaagggacttgcccagggacacacagtgttgtgctttctccattacacagtcacctaattgaagattggccccaaatcttatttatcttggtgtcctattggctaatggccatgcctcacacataataagtattgagaaaatgattgttgattaaatgaatgaaggtaaattatgttaatcagtctgtgaacatatttaatatagaagtcaactaagatcaaattattagaggtacattaaaaatgcaaaaggaagagaaatagaatttattggtttgatatttcatatcagcttggactagaagaacactaagatttgttctgaatcagaaagtctatgg

SEQ ID NO: 463779 - DNA, 1721 bp, Homo sapiens
cgtggcagtgcttgtgtgtcggggctctgaggctccggcctgacctctcctcggggtcgacgggaaggtctccggatgccaggactcgcaaagggccgaccagaatgaggaaatcccaggcggagtccgggggaggcagcacggcatcccagcctcagggctgcccggacggtgttggttggggtaagattggggaagatgccaggtgatagaatccaccctgcctctgacagcatccaatctggagcaaaggcttctttcaaccttcccccaagctcccaatacaagcccaaattctggaacaagtcctttccaacacctccttcagagaagctccctggctccaggcagtgcttgctcccctcactgcagcaggaagcctaacttgcgaactgcaggtgtgctccaggtggtcactggatgcaagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctggctggctggagccacttgtgcggcgcagccctggcggaggttcaggcggccccggtgtcgcaagcggctgtgagtgatgcctccctggggccggagtggtcccaggaaggctgcagaccagggctgaccagcgggcagcatggtggccgcgatggaaggtgacggggttcgcagcgccaggggacccagcagagcccgagcccgggcatcccgcatctccagcagcatcgcaggtaggcctggtgctggtgaagtggcggccagtgcacaaggcctacgacccagtcccagaggccagcccattgtcagctaacttcaggaaccccgggccagctgaggccccgggccccatgggcaagacaaagggcagagggtccgcaggcggggccgagtgcaggcagtgcaggcctggctccaccgccgcggagctcgcagggcgcagcaggcatcgggcagtgaccagggcttccagaggaggctgtgcacccctgcaaaggctcctgccctgcgtccagcctatccgcggggactccacgtgcaccccctcctcattgtccttgtctagggccgcggcggcaaggtccttgctcccatggcgtgactccagggtgcaggagcctgggctgagcaggtggagtagggtgagctccgccaagaacccagcgagagtggcgccccagggcggcacaggaggccgcatttaacatgtcaatcatctgaaagattttatggcatcttttttttgacatcttataatatctataatgtttattatatcttgtgatataattattaacaccacttcagtgtgattattatgattatttttataccaacacatcttcaattattaatattcccagttgctagagaaaactgaaaactactagttttgaaagcctcacttctgccaatggaagcacattccagcatgtcgccaacgcaatccactttccaccactttcacaaaaaacgttactgcacaattatactatcctaccctt

SEQ ID NO: 463780 - DNA, 1238 bp, Homo sapiens
cgtggcagtgcttgtgtgtcggggctctgaggctccggcctgacctctcctcggggtcgacgggaaggtctccggatgccaggactcgcaaagggccgaccagaatgaggaaatcccaggcggagtccgggggaggcagcacggcatcccagcctcagggctgcccggacggtgttggttggggtaagattggggaagatgccaggtgatagaatccaccctgcctctgacagcatccaatctggagcaaaggcttctttcaaccttcccccaagctcccaatacaagcccaaattctggaacaagtcctttccaacacctccttcagagaagctccctggctccaggcagtgcttgctcccctcactgcagcaggaagcctaacttgcgaactgcaggtgtgctccaggtggtcactggatgcaaggtattgacagatggatcccattgatacccccactgcataaccatgtaagcctatcatcccccacttgcacatgaggaaacggaggtccacagggtggggaagggaagacataatttgtccttcaaatgcgataccggtgagatgtctctctatcccaaagcctgatgtgatttccttactggagcaagggaaagagtcctgcatggtttcaagggacgtaccaggaggatggtgcccaggtgtcctcaaggtggtgtgcaagtgggttgtggctttgagtggcaggcgccaatgggatgtacctctgggctgtgagaggctggtggagttgggacctccagacctagagattatgggcacagaaacctattactgccagacgctgaggcgttgccatgggatccaagggtgtttcgggtcagctcagagcctttctcagataattgtttcggtaactggggagctgctgtccagcacacgcccctatgaaggcttaatgtgccctcagattcctaagcctgtgactttgagtatcggtgtcttccttgcaatgtttcaatctgaggttcttggggagagtgcagaattggagcccgatggaagcctgatggggagagggttgggtggagggcacatggagaatgtgtcaggcctgtgcatccctcatctacaaaatgggaataataagaatatctgacaattagacgtgtagaaaatatatgtaaaggcctttgaaaagagcttgtgaaagctcaataattgtccccaataattgctctcaataattgtcagctatcattccataataagc

SEQ ID NO: 463781 - DNA, 692 bp, Homo sapiens
gggagtccggagtacttggccaggctggccccgagcggaactggagaaagctgaggctctaaccatggaatactgggaatgtccctttctgtgaaggaggtttgtcagccacaacaggaatattcatgaacatgaaggggttgggcatgttccaggatctgtctatcgacttctctcaggaggaatgggagggcctggacactgctcagaaggacttatagagagatgtaatgatggagaactatagcagcctggtctcactaggtctctctatcccaaagcctgatgtgatttccttactggagcaagggaaagagtcctgcatggtttcaagggacgtaccaggaggatggtgcccagttttcctttaatgcagccatttcatgcatcaatggatattcattcagcactcttttttttttttgggatacagagtctcactctgtagcccgggctggagtgcaggggtgtgatcttgtctcactggaagccaataagaaacgctgtggggatgacctccctacaagcacggaaaaccattcctgcgcatttctgcgcgtggaacgcctacctttagtgccgtttcctgcgctttcttgcagatttgtatcaggcctgagaacctcccacctggtccatgcccggctcccggtgagcaccgagacccaaccttgtgcacagccagtcttgtc

SEQ ID NO: 463782 - DNA, 1737 bp, Homo sapiens
tgcttgtgtgtcggagctctgaggctccggcctgacctctcctcggggtcgacgggaacgtctccggatgccaggactcgcaaagggctgacaagaatgaggaaatcccaggcggagtccgggggaggcagcacggcatcccagcctcagggctgcccggacggtgttggttggggtaagattggggaagatgccaggtgatagaatccaccctgcctctgacagcatccaatctggagcaaaggcttctttcaaccttcccccaagctcccaatacaagcccaaattctggaacaagtcctttccaacacctccttcagagaagctccctggctccaggcagtgcttgctcccctcactgcagcaggaagcctaacttgcgaactgcaggtgtgctccaggtggtcactggatgcaagtttcttttgatttctcctgcttagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctggctggctggagccacttgtgcggcgcagccctggcggaggttcaggcggccccggtgtcgcaagcggctgtgagtgatgcctccctggggccggagtggtcccaggaaggctgcagaccagggctgaccagcgggcagcatggtggccgcgatggaaggtgacggggttcgcagcgccaggggacccagcagagcccgagcccgggcatcccgcatctccagcagcatcgcaggtaggcctggtgctggtgaagtggcggccagtgcacaaggcctacgacccagtcccagaggccagcccattgtcagctaacttcaggaaccccgggccagctgaggccccgggccccatgggcaagacaaagggcagagggtccgcaggcggggccgagtgcaggcagtgcaggcctggctccaccgccgcggagctcgcagggcgcagcaggcatcgggcagtgaccagggcttccagaggaggctgtgcacccctgcaaaggctcctgccctgcgtccagcctatccgcggggactccacgtgcaccccctcctcattgtccttgtctagggccgcggcggcaaggtccttgctcccatggcgtgactccagggtgcaggagcctgggctgagcaggtggagtagggtgagctccgccaagaacccagcgagagtggcgccccagggcggcacaggaggccgcatttaacatgtcaatcatctgaaagattttatggcatcttttttttgacatcttataatatctataatgtttattatatcttgtgatataattattaacaccacttcagtgtgattattatgattatttttataccaacacatcttcaattattaatattcccagttgctagagaaaactgaaaactactagttttgaaagcctcacttctgccaatggaagcacattccagcatgtcgccaacgcaatccactttccaccactttcacaaaaaacgttactgcacaattatactatcctaccctt

SEQ ID NO: 463783 - DNA, 673 bp, Homo sapiens
aggcttggcaaagcaggagccctccttggcagtgcttgggtgtcggggctctgaggctccggcctgacctcttcacggggtcgacgggatcgtctccggatgccaggagtcccaaagggccgaccaggatgaggaaaccccaggcggagtccgggggaagcagcacggcatcccagcctcaggcctgcccggacggtgatggttggggtaagattggggaagatgccaggtgatagaatccaccctgcctctgacagcatccaatctggagcaaaggcttctttcaaccttcccccaagctcccaatacaagcccaaattctggaacaagtcctttccaacacctccttcagagaagctccctggctccaggcagtgcttgctcccctcactgcagcaggaagcctaacttgcgaactgcaggtgtgctccaggtggtcactggatgcaaggtaccactaccagttgttgggcagggagacctcctgctgctgcccatcctatgttgcatcctccaacatgggtgcactgtggttcagccagcacctataccacctgcagcccagggctcctgtggtgggcctgaggttcctccctatcaaatggagatatgctggggttgctgcctttgctgaagcccatgtccaggtcatcttgggggtggccaaggttac

SEQ ID NO: 463784 - DNA, 878 bp, Homo sapiens
aggcttggcaaagcaggagccctccttggcagtgcttgggtgtcggggctctgaggctccggcctgacctcttcacggggtcgacgggatcgtctccggatgccaggagtcccaaagggccgaccaggatgaggaaaccccaggcggagtccgggggaagcagcacggcatcccagcctcaggcctgcccggacggtgatggttggggtaagattggggaagatgccaggtgatagaatccaccctgcctctgacagcatccaatctggagcaaaggcttctttcaaccttcccccaagctcccaatacaagcccaaattctggaacaagtcctttccaacacctccttcagagaagctccctggctccaggcagtgcttgctcccctcactgcagcaggaagcctaacttgcgaactgcaggtgtgctccaggtggtcactggatgcaagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaagaacagaaaacgcctacaagttgcgggcccctgtagtgcaacttgtggtcagtctagggagagtggctttggagccaacaccaattgaggaaaatccatctgaggacatgagctcactcaggttctcatctacttccttgggggtttgcccggctcctcagaagtttggaccccatactgtcctgcgggggactctccactgctgcagaactgtctccagaagcg

SEQ ID NO: 463785 - DNA, 825 bp, Homo sapiens
cgtggcagtgcttgtgtgtcggggctctgaggctccggcctgacctctcctcggggtcgacgggaaggtctccggatgccaggactcgcaaagggccgaccagaatgaggaaatcccaggcggagtccgggggaggcagcacggcatcccagcctcagggctgcccggacggtgttggttggggggttgggcatgttccaggatctgtctatcgacttctctcaggaggaatgggagggcctggacactgctcagaaggacttatagagagatgtaatgatggagaactatagcagcctggtctcactaggtctctctatcccaaagcctgatgtgatttccttactggagcaagggaaagagtcctgcatggtttcaagggacgtaccaggaggatggtgcccagatatatatatatggaaaagagaaggtccaagaatatcaaagacattgaagaagaggaaagatttgtcctgccaaatatcagaacttttataaagctacagcaatttaaagaacacgaaagatactgactcaccgcaacacacataagacacaaaactgccggggcatgcaccgcttcccagagacgagcgacgcgcagtacgacggtctcacccactacaccgggcttacccgaacctagcacgagctctgcatatcgcgtaggaccggcaggtggcacgccaacaaagtttacgggcgccgtgctggcatatgccaccggcatagcagccatcagccgcgcccgtcattgttacaccgaggccgacgctgcggcaggaataaactgcggcaagccgttgagccctaccatcgcgcctc

SEQ ID NO: 463786 - DNA, 1840 bp, Homo sapiens
  misc_feature (1)..(1): n is a, c, g, or t
  misc_feature (3)..(4): n is a, c, g, or t
  misc_feature (10)..(10): n is a, c, g, or t
ntnnctcctnagctccatgtagttccagatcctttcctgtgagtggatttggcttggacagaagagggaagacttatgtggaggtgggcgcttggctgccgccaccattgtggccatctggaaagggtgaatcttcgagaggagagcccagtgactgtcgtgcattgcctgggacagcccagacacctaattctgatcagacagaagtccctgatcagatgaaaagaaaaagcaaagattctgtctgtcctgaccgccctgcaggttaagctgccctgcagccagcagagtgcctggcatacgggaggcaccctgtgcagcagccagggctactcgcccaactgggaggaggcggatggtgggtaaaagtgagcactgggccttcctgatgtgaggcgaggatgtggatctgggaggaaagacaaatgaagaagcaggtggacagccccagctgggctccaggtggggcctggggtaaagtgacccttctgcattgctttcctgctctggctgcccctctttctggatgggtaaaagcacttccatgttttcagaggcgtggagggagcccgagaagagcagatgttgacaccaccatcactgcctgcagcagtgagaccaggggcacagtttttgttgaaagggtcgaccaggaagcacttccttgactctgtcctaaagcctctggagagcccttaaatttgtggtccttgaagctattgtaaaggtgaggacacagcgaggagtaggctgtctatgaaccaggaagtgggccctcaccagacacagaatctgccagcacctcaatttggacttcccagactccagaactgcaagaaattaatttctattgctcacaagccacccagtctatggtattctgttacagcagctggagcaaactgagacagtacttgacagtgattttcatgaaggttctcccttgctcatttttaagcccactggttcagacagaagcctctgggagagccctccagagtccaccttgaaggcttcattccttctacccagagcatctccgtggagaggaagaaaaagcatcaatgaaatgaggtgccccagcgggcctgcacccaccaactgttcctagtatcattggttgatgataccatgaacgatgaaccgtggggctggccttctctccagctcagaacacacttgctttagctcaagactgtccaacccaagcccgcaggatgcacgtggcccaggacagctttgaatcctacgttggtcccccactcactcatcctctgggccagtcatttggcacacagtacacgttgtgtttctgtggaagccctatggggagagaatgggttgtgggggccaggatctggaagcttccagtggatgaagaggatgtcagtgctactaccagactcacacccactggctgcccttgcagacctgctgggtgccacagaaccagggcacactgcaaccagagcttccagaaactgggaatgctggaagtatccaggcaagaagccaatagctccagggaccctgtggctctgggatgcaggtggcctctgctcaccaagttcatgctggtagctggggacacagggagcccgacttgctccaagtctcccagccaggctgtaggagagctggattgcaccaaatcagacacaaattccagatggctcaaggacctaagtggaaacgtgaaactttccagtcacgagagaacacctttatgacctcatggtgagaaggagggacttcttggggaagactcaaaaagcacaaaccaagcgacaaaaggctgacacacttgaccacattacaattaagaatttctctctatctt

SEQ ID NO: 463787 - DNA, 1477 bp, Homo sapiens
caaatttttattattagctggctatgaaggaaagaaatgcacttaattgggtaaacagtttatttcttatcttcttttaagctttctgaacgaacagaatttggctagctggttttctacccttgaaagcataaagaagcttggactgtctgaaaatactcttttctgggagtatgttcgtagacaactgaaataaactgcaactcactggtgccaaatatatcacacatcagcccacctcctgccacggtgagcttgtagcagagaaaagaatgttctcaggttcagaaaggggcttccctgctgaggagccatgctctttccacgatgaagaactagagaccgtcttgtgcagtgggctggcagagaggagccacacagtgaagtgtaaattgctcaggatcacaattcagaggacatgggttctcaccttggctctatgactcattttgtgcctttcacccctacaatctctccgaacctcagtctctgaatgaatgaaatgagactgaccaaaccaatctggctaaatataaaggtataacatcctgatcaaacacaggaatttatcagatgtagtataagacagaaagaaaggagacaagaatgatgtcaagtggcctaagcaactggaaagatgaagttgccatcaacccagatggcgaaaggacagactgcctcctcagtgggtccctgaaccctgtgcctcctgaaagggagacacctcccagcaggggtcgacagatacctcaaacaggacacctccagctggcatatggctggtgcccctctgggacgaggcttccagaggaaggagaaagcagcaatctttgctgttctgcagcctccactggtgatactcacgcaaacagggtctggaatggaccccagcaaactccagcagacctgcagaagaggggaccgactggtagaaagaaaactaacaaacagaaagcaatagcaccaacatcaacaaaaaggatgaccacgcaaaaactcactgaaggtcaccaacagcaaagaacaaaggtagataaatccatgaagatgaggaaaactggcaaaaaaaggctgaagatttcagaaaccagaatgcctcctctcctccaaaggatcacaactccttggcagcaagggaaaaaaaactggatggagaatgagtttgataaattgacagaagtaggcttcagaaagtgggtaataacaaactcctccgagttacaggagcatgttctaatccaatgcaaggaagctaagaactttgataaaaggttagaggaattgctaactagaataaccagtttagagaaaaacataaatgacctgatggagctgaaaaacatagcacaagaactttgtgaagcatacacaagtatcaatagctgaattgataaatcagaagaaaggatatcagagattgaagatcaacttaatgaaataaagcgtaaagacaagattagagaaaaaagaatgaaac

SEQ ID NO: 463788 - DNA, 2180 bp, Homo sapiens
aagtggacggaggcagcaggactcatgtgctattaatcattttttaaaaatagacaatatggaactgctgaccttgggccaagtgctgtgtggagtcctggacccaggcaggggtgggacccagggacccagacaggaagtgacagattcctgggagtggacaaaatggaccgcgctgggccacaaagtggatatgggtggcgagaatgaaattggagttgaggtttctggtttggacaagaagaataaacacctgaggaacaagagtcctctgagcagccatgcctgggacagccacactgagagcagccacctgagatgccagagtcccccacgcagccatgcctgggacagccacacccagagcggccacctgagacgccggagtcccccacacagctgtcctcaggacagccacaccgagagcagccacctgagatgccggagtcccccacgcagccgtcctcaggacagtcatgccaagagcagccacctgagacgccagagttgcccatgtagccatgcctggcacaaccgtctcagaaacacatgattaaggggtaacaaaacaacaaacaccatgagaacaaaatgtgaaccatgttgtgaagaaacagtcaaaaactagaaaggatagcaagacaaatgaaaataaaagcggacattttttcacattatactaaagagatggcccgggagtggaaacctgtagattaacaaaaccacctttattattacctgaagtccacttttcttcaaccatggggcttccacgtcacatatggacattttaacagcaagaaaatcacatgtggggtgaaactaaagccccacacagtggtgtcttctcgaaagccaaagacgaggtttcataattgagctccatttcttcttattccctttctcagtgatatttctttttagtaaacattttaaagaatgaaacgtggttctttatcattaagcccccaaaagatcattcagaaagtgagaagaatttgaaaaaacgtgtgtatattttcccctcatgatatttttttcctggaatgtgtacgggaaggtatctcatttatatgtaacttggaggttgtcacaaaagcaggtactgataacctttgctatgtaaagttcaaagtataaaaatgttttaccttctgaataactagttcaaagtgaaaaggaaaaaaatccagggttcgctggtgacatggtttggctgtatgtcctcactcaaatctcatgtcgaattgtaatccccatgtgttggaggagggggccggtgggaggtgattgaatcatgggggtggtcttcccccttgctgttctcgtgatagtgagtgagtgctcccgagatccagttgtttaaaagtgtgtagcacttcccccttcactctctctctcctgctctgccatgtgaaaaagattcttgcttccccttcgcccttctgctatgatttcatatttaaagatggtgtggattgtttacctttatgttttggtaaaaatttatgtgctatcaacaagtttaaacattcacaatagaaacttaaatgtcttcatctccaaggcactgaacattgtcatattaaaagcttaaatatatttactgttatatttattgttacaatagttttaactattggcggcaagatcaatagttgcaacttatatttttgctgatgcttaaaagtgttttaaaagttgatctgccttacaatttatttttatttaactccaagtgttaactctagattgttctgaaacttatatggacttttgaaaatagccagattttatgtgttgtggggacccatttccaaaatctttaaagactttcaatagcttacaacctgtgttcatatattctaaatccagctagtcttctataaaaagttgaatgggagcttttttctcccgtaaagtaatttcatttgtcgggattgttcaggattgctgtgttagttcccaaaacctccagcagtgatgccgcagccccgacacagcagtgacgccgcagccccgacacagcagtaatgccgcagccccgacacaggttgaaatttcttttttaagcacactcaagtggcttaagatctcaagcacttgaaaatgctggaaggcttttaggaatgtttctgtaactttaaaatgtatcaatccccttttgtttctcttttaat

SEQ ID NO: 463789 - DNA, 496 bp, Homo sapiens
ctttaaaagtaaaagataatataacatattttaatacattgtgtgtaatgtacatatgcatattgtctatgtactatatacacattgtttataatattgttattacagtttgtcattcacctgaaaggagaaggaaaagtacgaaaggtttctctgcttgggaaaaggtgaatgttgttatatcaagaacgattacacacatggatctcatacatgtttttagaacattgttcttctgattgaagaagtctgatgctcctgaaaaatcttaaaatatctgacttgtattgaagaaaattatttaattaaatttttaaaggctggttgaaaaagtctgacagttctgagaattttttaaatgtctgaattgtaataaaaaaatggtttactttaaacttctaaaaactaatgaccttgtgactaaagaaaaatcatttgaagtgtattaaaaaatagcaaaacattaaaatcttttctctgtgcaaattttatcaga

SEQ ID NO: 463790 - DNA, 1447 bp, Homo sapiens
tctgcgcgggccatgtggggacccggggtcactgctgagggcctgtcggtggctccggcgccgccgcctctgctgccgctgctgctactgctggcgctggcgctggtggcgccctcgcggggcggcgggggctgcgctgagctggcgtgcggcgagcgggagcgctgctgcgacgcgaccaacgccacggcggtgcgctgctgcaagctgccgctgcacgccttcctggacaacgtgggctggttcgtccgcaagctctccgggctgctcatcctgctggtgctcttcgccatcggctatttcctgcagcgcatcatctgccccagtccacgcaggtacccgcgcggccaggcgcgcccgggacagcggcccgggcctccggggggcgccggaccgctggggggcgcggggccgcccgacgacgacgacgactcgcccgctctgctgcgcgacgaggcggcagccggctctcaggactcactgctggacagtggcggcggcggccggggccggggaggcggcgggcgctcggacccctcctgcgcctcagagcacgagatgcgtgtagtgtcgccggtcttcctgcagctgcccagctacgaggaggtcaagtatctgcccacctacgaggagtccatgcggctgcagcagctcagccccggggaggtcgtgctgccagtgtcggtgcttggccgccctcgaggcggggtcgccgcggagcccgacggcggcgagggccgctaccctcttatctgagcgctcggggatcggcggctggtgcagggctgggggctgcgggtggcaagcaacggccggggtgccgccgccaactgcctcagaccttatctggcaccctggcctaactgcccggcaccccgcgactgggttggggtcactcgtctccctcgcgttctcccgggatcttatgtttctctgcgtttcattccgttcaaagaaacgtggggcacgcgcggcgggtgcggctgcagcaggcgaccctccagcgcaccttcgaaggacgtccctgccctctgccttgcctcgtattgtggttcactatttgtcattcacctgaaaggagaaggaaaagtacgaaaggtttctctgcttgggaaaaggtgaatgttgttatatcaagaacgattacacacatggatctcatacatgtttttagaacattgttcttctgattgaagaagtctgatgctcctgaaaaatcttaaaatatctgacttgtattgaagaaaattatttaattaaatttttaaaggctggttgaaaaagtctgacagttctgagaattttttaaatgtctgaattgtaataaaaaaatggtttactttaaacttctaaaaactaatgaccttgtgactaaagaaaaatcatttgaagtgtattaaaaaatagcaaaacattaaaatcttttctctgtgcaaattttatcaga

SEQ ID NO: 463791 - DNA, 779 bp, Homo sapiens
agcagcctactgtgtacaagaaagccatcagcaatgagaattataagagtttcccatgattttggaatatatataccaataacatatttatacaaatatggcccaaagaaaaccaaacaccattttatatttgacaatgctccctgtatgatttttgtaccaaataagccaaatgtcactgttgcattagtgcattatcaatgtcaaacccaattcttaataaaaccttataaatatatcgatccaatcttaatcagtttgaccataagttcccctcgacaagaaaaacgaattcatagcacaaagtacaccagtttaagactagccttagaattcttttttgcattaatccaaacagaagagatttgttttaccattccttcaatcgttcccacagagagaagtcagaaatctgactgcgtatgtcaagcctctgagcccaagccggcctgtatacatccagatagcctgaagcaactgaagaatcacaaaagaagtgaaaatggccggttcctgacttaactgatgacattaccttgtgaaattccttctcctggcccaggagctccccaccaagcaccttgtgacccccgccctgccctcaagagaacaaccccctttgactgtaattttccactacccacacaaatcctataaaactgcctcacccctagttccctttgctgactcttttttcagattcagcccacctgcacccaggtgattaaaaagctttattgctcacacaaagcctgttggtggtctcttcacatggacac

SEQ ID NO: 463792 - DNA, 3772 bp, Homo sapiens
  misc_feature (3703)..(3703): n is a, c, g, or t
  misc_feature (3754)..(3755): n is a, c, g, or t
tttcccttgcctccataactgttcgggatctatgccttatcaaccaaattgttttgcctatccaccccacggtgccaaacccatatactctcctatcctcaatagctccctccacaatccattattctgcatagttggatactttcacctttggatacctggttttgccatcctaacaaaaccgttatataaactcacaaaaggaaacctagctgaccccatagatcctaaatcctttctccactcctctttccattccttgaagacagctttagagactgcccccaccctagctcttgctgactcatcccaacccttttcattacacacagcagaagtgcagggctgtgcagttggaattcttacacaaggactgggatcgcatcctgtaggctttttgtccaaacaacttgaccttactgttttaggatggccatcataattcaggcctgtcctcggaatgctacaagagaacaacccccctttttcctttacttacccaaatcccataaaacggccccacccctatctcctttcgctgactctcttctcagactcagcccacctgcacccaggtgaaataaacagctttattgctcacacaaagcctgtttggtggtctcttcacacagatgcaagtgaaagaaggagcctgcctgcaaccttccagagtaatcagtgtgagctgagctctttccctgaatgaatccaagtaaccctggccttctgaaatgaccagcagacacacaactgtccagaggctgcccaaagtataaactctggttctaaagtaccatgtccagccaaggaagtcctagtgttgcgctttctacgacgacagtcagttcagttgctgtgcaggctggggactccaaaatcgttatagctgtcataaaggtaagctaacaacttccttttttctgtgcggctgtgggcttctagctgtgtgttgaaaaccctaaagaacattccatgcaatcggcaggacacagcatagagaagacaacgcagcaagcactcttactgctttctaaaatgggctactaagagaaacctctacaagtttcagcagttaccagagattctctttcctttcagtcagccagaaagcatctatagcagcttgatttaaaaaaaaaaaaaaaaagaaaagaaagaaaaataaagaaaagaaaacctctagcatatactgtcaatttggtctttaaaagcaaggcattggtaactggaagttcatgattgcctgactaaagagtccaatggacctgtggaatgcttgtgatttttgagagtggatgtgatggaggtgggaggaggcaggtcccgacagacagggggagggcactgctttaagcacgatggaactcagaaaacaccaagtaaagggctccgacatgtgccctttgccacactggttttgacatggtaaagaaactactaaatccttgtccagtaacgaagaccatgcaaggaaaggtacaaaagctttgtgtcaaatttgctcttaacagcaggaagtagaagccacttagggtttacaattactgcatgttttatgacaacccatttgcccatttgcaaagatgaccacacatctttaggctgaagaagaactccatgattttattctccatggaaatgccctgtaaaaaaaagctttcaagcactaggcttgggctttagatgatattccacctaaataattcagtgtttaatgaagggaaagctggcaaacaagctgatggtcacaaaccagttactttcaggtccccaccaggtttaattgaatgacttttctggccttttgttagagcatggacagcaagccatgtttactttaacttaattgctgtgaattttatggtaatgtgaaaattcataccaggaaaagagcacttgatactgagcaaaacagttcactatagaaggacagaatggaaagtattcctgccgaggtggattttctggtgttgtgagacttctctcccacaggaaccaggcctctgctgacttcctcaccctcccatcttttcagagtcccagagaggagatgaaaagaagcctgatgcagaagtagggcaaacagatcatttgcacgggattaatgatactttgagttaactgcagatttcagcaatgagggaaaagaggcaaactcactatttttcaaaaagttaactttccatttcctcaaatatgaacattcttggagcaggatgaggaataatattagaggataaattacagaagaatcagaggtagattgaacacaaaaaaattacactggaaattacactggaaaattacactggaaactcttattttaactgaattgtgtttctaagaatgttcccccactaccctctcctcagccctcttaccttactgccatctccatacaaaatacaccccaagcaattcagagtataaagtccaccttaatggaatggaagtgcctgtgtgtgatttatagtgactgtccaaactgtctcaggggactgaatatattctaaaatagaaatacatttttctaatttctctttagtaattcaggtatctacatgcgtatgcgtgttagtggttcattttgcttaatgagttgttgcttcttagaaaagcaattcctcaggaaatgcaatgacaaattatatcttagagcagtgtaaatcttgtgtggaaagcaagttgactgtgctcaaatggcagttgtcacaggcatctaattttgttaatattttcctacacgctttaatgaatattcaacaactaaggttggaaaacagcatattttacctttgaaataagataaaaatcaatttcttcatctgatatttattattttcagctaaaccagcaaggccaatgtaaagacactaatcagcctaaattgcatttacaagaactttccccatggtgaaatttgcatcctacctgcccaagtggaatttcactatttttattgagttcagttttgtgagtgagagaggatacagttgtgtaaattattctgtaactttataatattcaataatacgtaatccattgtatgttttcctcacttgggaatttttaactcaaatccaatatgccaagagagaataatttatgctaagaataaaaaataaaagacagggcatggatttatattagatctgttgtgtttcaatttaagtaaaccccatctctatggaaagaatggaaaaaaatagaaaatagaaaaaagtgtttacagtataactggaaatttaaacgatatattaaaaatgagaagggtgaagaggaaggaacaagaggaactaaaagtgcattttatttaatttttatttttagtgtggcaaatgggtacaacttcaactggctgaatcacagcccaatcttctagaaattggcagcagtcaagatgaaaccaaaaaacttcttcatgatcatgaacttcttttggccaagctcaagctggagaatgctggaggagaccttaaggatggccaccaccactatgaaggagctgttgtcattctggatgctggtgctcagtacgggaaagtcatagaccgaagagtgagggaactgtcgtgcagtctgaaattttccccttggaaacaccagcatttgctataaaggaacaaggattccggctattatcatctctggaggacctaattctgggtatgctgaaaatgcttcctgggtttgatcccaccantattcactattggcaaagcctgttctttggaatttggctatgggattgccnnatgatgaaataagggga

SEQ ID NO: 463793 - DNA, 1339 bp, Homo sapiens
  misc_feature (1270)..(1270): n is a, c, g, or t
  misc_feature (1321)..(1322): n is a, c, g, or t
tttcccttgcctccataactgttcgggatctatgccttatcaaccaaattgttttgcctatccaccccacggtgccaaacccatatactctcctatcctcaatagctccctccacaatccattattctgcatagttggatactttcacctttggatacctggttttgccatcctaacaaaaccgttatataaactcacaaaaggaaacctagctgaccccatagatcctaaatcctttctccactcctctttccattccttgaagacagctttagagactgcccccaccctagctcttgctgactcatcccaacccttttcattacacacagcagaagtgcagggctgtgcagttggaattcttacacaaggactgggatcgcatcctgtaggctttttgtccaaacaacttgaccttactgttttaggatggccatcataattcaggcctgtcctcggaatgctacaagagaacaacccccctttttcctttacttacccaaatcccataaaacggccccacccctatctcctttcgctgactctcttctcagactcagcccacctgcacccaggtgaaataaacagctttattgctcacacaaagcctgtttggtggtctcttcacacagatgcaagtgaaagaaggagcctgcctgcaaccttccagagtaatcagtgtgagctgagctctttccctgaatgaatccaagtaaccctggccttctgaaatgaccagcagacacacaactgtccagaggctgcccaaagtataaactctggttctaaagtaccatgtccagccaaggaagtcctagtgttgcgctttctacgacgacagtcagttcagttgctgtgcaggctggggactccaaaatcgttatagctgtcataaagtgtggcaaatgggtacaacttcaactggctgaatcacagcccaatcttctagaaattggcagcagtcaagatgaaaccaaaaaacttcttcatgatcatgaacttcttttggccaagctcaagctggagaatgctggaggagaccttaaggatggccaccaccactatgaaggagctgttgtcattctggatgctggtgctcagtacgggaaagtcatagaccgaagagtgagggaactgtcgtgcagtctgaaattttccccttggaaacaccagcatttgctataaaggaacaaggattccggctattatcatctctggaggacctaattctgggtatgctgaaaatgcttcctgggtttgatcccaccantattcactattggcaaagcctgttctttggaatttggctatgggattgccnnatgatgaaataagggga

SEQ ID NO: 463794 - DNA, 1104 bp, Homo sapiens
  misc_feature (1)..(1): n is a, c, g, or t
  misc_feature (5)..(7): n is a, c, g, or t
nggtnnncagcgacccctgcctcctaccgacctgggctccccgcacccgccgcgcgagatccagtcccagcatcctgatggacgcaggcgttttcctggagccccgcggttggccacgccccgcgctctccgccccgtcggggacgcccaggccaccggcctgatgagggaagcaggggcagagcgctcaggccagggccggcgggggcactgcgcactggccgcctccctcctctggccaatcctcctgccgctgcgcgtctagtccacctcgtccctctctgcagcaggcatgttcctacgtgaagcatggagttacgcaatggcctgcctgtccatgaagttcctctggcctcctccgattctgtggctgcaaatccacacctaggagctccgcaggcctgctggagcacagcgcctgtaggtttctgcgcctggaacccacctcaggaccacaagccgcattcagtctctttttatagatctggaacccgaagcccagcgtggttaggaacttgtctaaggtcacttggtagtaaatactggaacagggattcaaacccacatctccagagagagctcagaagccttgtgctttccatgagtgcagctgtttccagaggcctccggccctgtctcaccttcccagactgccttgagaggctctagctggcctgtctctagtgtggccagattctatctggtcagtggcaagggaggaccccaggccacaatactgacatcagggaacagaacagatctgcagggccagtgagtggtgctacggaaaggctgggagtggcccctgcgtggttttccctagacccatcgtcaggggctccaggcctccatgtgttgtgctgcacgggctactggctccctctccaaaatcgaccctgggtgagctgtggaggcgagaaggcagtgtgcatttcagaaactaaccaaaatcagtgagaaaatcttggagaaactgaagttaccctgggcggctgtagctgggaatggaggatggggcagccaggagccagacttaagaaggctgttcacactctgctcttgttgcttgcctcccacacctcgtgacaaatgctgcctggtccc

SEQ ID NO: 463795 - DNA, 1339 bp, Homo sapiens
ggggtcctctgggcagaggaatcatcatggacacgagtctccgaggacaactgcccttggaaccatgttgtgaggaagctcgggccacatgccagaacaaaggccccgaggaatctaaaccccttaatgccaggagagacaaatgcaattcctgcagcaggtttgtggactttgtgggcactgacccttctgaaacccttctcctgaagaaaacagatagactctccaaaatctcagtggatttgtacaacagaagtttagttctcactcttgcaaagttcaaaaaaggtccagattggggcagttctcctccaagtgatttggaaacccaagcacctttcatctcctgcatcatcaatttatctatgaatctgcctaaagccagtggcagggaaagaacatggatgatcctgcatgggtcgttttggggggccagtcctggaagtaaatgctcattcattgtattgactagaaatcagtcacatggttacatctctttctgcaagaaaggctgggaaatgcaatccagctgtgtacccaggaaggctggagaaatgggtttcatgaacatctagctggtgtctaccatggagatgagaaaaaagtccaggtcaaaattgtagcctttgaataacaaaaccttagggccaaaatagaattttaaagtcatttagttcatcctccttattttgaatttagttcaatttcaaataaaggcaacaaagtttgaagacactgtgaagtctaaagtcagtagcagtaatggaaagttgggctaatgtggagatattccaaacagagcaagagcaaatgggattcttggcttgtctctcatcgtgatcctgattgaagaccactggacacatctgtcaagactctaaccgcaatccattggaaatcactggagagccaaaggaaatgaagtctcagacatattgtccaggctggaatgtagcggctattcacaggcatgatcatagtgcactacagcctcaaactcctgggctcaagcaatcctcccatctcaatgtccggagtagctgggactacagatgtgtgttagcggctatggcagccatcttgtgaccaggaggaagcttctgagaatcacagagatgcaacctctgaagctgccaaaccactgccagcagctgcctaaccactgccagcagctgcctatctccagacatcttggtaggtgagaaaaataaccccctattcatttcagttcccagaacttgggatttctgttactttcggctaaaggttttctggatacatcccagatcacgcatctgcctttgcatgggcacacataaatggtctttgctaaatttct

SEQ ID NO: 463796 - DNA, 1101 bp, Homo sapiens
ggggtcctctgggcagaggaatcatcatggacacgagtctccgaggacaactgcccttggaaccatgttgtgaggaagctcgggccacatgccagaacaaaggccccgaggaatctaaaccccttaatgccaggagagacaaatgcaattcctgcagcaggtttgtggactttgtgggcactgacccttctgaaacccttctcctgaagaaaacagatagactctccaaaatctcagtggatttgtacaacagaagtttagttctcactcttgcaaagttcaaaaaaggtccagattggggcagttctcctccaagtgatttggaaacccaagcacctttcatctcctgcatcatcaatttatctatgaatctgcctaaagccagtggcagggaaagaacatggatgatcctgcatgggtcgttttggggggccagtcctggaagtaaatgctcattcattgtattgactagaaatcagtcacatggttacatctctttctgcaagaaaggctgggaaatgcaatccagctgtgtacccaggaaggctggagaaatgggtttcatgaacatctagctggtgtctaccatggagatgagaaaaaagtccaggtcaaaattgtagcctttgaataacaaaaccttagggccaaaatagaattttaaagtcatttagttcatcctccttattttgaatttagttcaatttcaaataaaggcaacaaagtttgaagacactgtgaagtctaaagtcagtagcagtaatggaaagttgggctaatgtggagatattccaaacagagcaagagcaaatgggattcttggcttgtctctcatcgtgatcctgattgaagaccactggacacatctgtcaagactctaaccgcaatccattggaaatcactggagagccaaagaactctctttcattgtcctggctggaagcactggattcctcctttcaaatgaactaaaatattttccaagatgtcaagtcaatctgggcaaactttctcaacataaccatccctacattccaatatccctctttttcatttttcctttaaaaataaacgtgcatttttttctcaaaagtgactgag

SEQ ID NO: 463797 - DNA, 909 bp, Homo sapiens
agctattatcaaaaagatcaaaagtaacagatgctagcaaagatgtgtatttatccaaaggaaaggaaatcactgtgtcaaaaggatacatgcactcttatgtttattataacactattcacaattgccaaaatacggaatcaatctaagtgtccatcagttgatgaatggagaaagaaaatgtggtttatttacatagtagaatattacctgaccattaaaaagcaaaatcattgttacatgaatatactgcaaaaaaatatgtcatttgcagcaacatggatgaaactgaaagtcatcatgttaagtgaaataagccagacacagaaagacaaatattgcatgtactcatatgaggtctcatgtttcactatactctcccacaacacacagagagaaaatgtagcagctattcaaagaaaagaacaccttggtgaaaacccccagaactggaaataagcctgagacacctgcatgattcatagaacaaaataaaaactgtatggaaaaggctcaacaaggacagagcatcccaggggtgaccattcctctgatctctgcctcacaactcacctcagggtaaccagtcttctgcccaagctaaagcacccaacacacccccatcggacttcagtcaatccgaagtggttcacttctcatctctgcctctttcttcccaaatgtcctgcactagaatggtatgctccccactcctttcaacatgaaccccatcatgttataaccttcttctacctgtgcaaatgattaccatgtctcctcctattaatgatggaagggctatcttttctgtgttatggaagaaagtaatctacatggtcagtcctggcttttaatgttaatagacaattatcagctgaaatagtttcagctataattaacagaaaataa

SEQ ID NO: 463798 - DNA, 546 bp, Homo sapiens
acagccaaatactatactacagtttacaatagagaaaatgtagcagctattcaaagaaaagaacaccttggtgaaaacccccagaactggaaataagcctgagacacctgcatgattcatagaacaaaataaaaactgtatggaaaaggctcaacaaggacagagcatcccaggggtgaccattcctctgatctctgcctcacaactcacctcagggtaaccagtcttctgcccaagctaaagcacccaacacacccccatcggacttcagtcaatccgaagtggttcacttctcatctctgcctctttcttcccaaatgtcctgcactagaatggtatgctccccactcctttcaacatgaaccccatcatgttataaccttcttctacctgtgcaaatgattaccatgtctcctcctattaatgatggaagggctatcttttctgtgttatggaagaaagtaatctacatggtcagtcctggcttttaatgttaatagacaattatcagctgaaatagtttcagctataattaacagaaaataa

SEQ ID NO: 463799 - DNA, 1802 bp, Homo sapiens
gcccacgacggtggccggcggcggcctctgcttcccggacccatgaacaaagctggagatgcggctttggagtcggccctgggacctgcttcttctcttggcttcggggaccgcagcccagggcgttccctccggatcggtggccagggcttgcggggcgtgtgcgactcgggacccccagccgggcagcagcggccgccaagcatggcaaggagcagcgccagcttctccccaccgcgtcccgggatggcgggcttcgggtgggagccggcccgggacatccaggtgggatcagccaccgctcaggccttgtcccaagcggacgcggccagaggcagtctcagcaccacgcaggccgcgggctcagtgggcaaagagaggggcccccggtgtctgggaccggtgacttggcccctgttatccccgagctcagccgcaggcttcagggacctgggcaaagtgtggataaccctgcccgccttttggggaggaaagccagttgctcccctagcctctactgtggcactacgaagcaagggcagccaagctgatcgctggtttcatctgcaccaccccactccctctggcaggtgatgagatggccagtgacggctctccaaactgttccaacctctgcccattacccacttccaaagctgcttccacattttcaggtatcttcatagcaatgctctacttcccagtaccaattttctgtattagtctgttcttgcactgctatgaagaactacctgagactgggtaattttataaagaaaagtggtttaattggatcacgattctgcaggctgaacaagaagcatggctgaggaagcctcaagaaatttacaatcatggcaggaggtgaagagggaggtgacacgccttacatggctgaagcaggaggaagagagagcaaaagggaagatgctacgtacttttaaacaatcagatctgatactgtcttcatgcgaacttggtatcctgtttccatcccagccttctataacccagtaacatcttttttgaaaccagtgggtgagaaagacacctggtcaggaacgcggaccacaggacaactcaggctcacccacggcatcagactaaaggcaaacaaggactctgtataaagtaccggtggcatgtgtattagtggagatgcagcctgtgctctgcagacagggagtcacacagacacttttctataatttcttaagtgctttgaatgttcaagtagaaagtctaacattaaatttgattgaacaattgtatattcatggaatattttggaacggaataccaaaaaatggcaatagtggttctttctggatggaagacaaacttttcttgtttaaaataaattttattttatatatttgaggttgaccacatgaccttaaggatacatatagacagtaaactggttactacagtgaagcaaattaacatatctaccatcgtacatagttacatttttttgtgtgacaggaacagctaaaatctacgtatttaacaaaaatcctaaagacaatacatttttattaactatagccctcatgatgtacattagatctctaacttgatcatcctatatgtctgctttgtattttcttaatgtacgtctccccatttgctattggtcatttcctatttggctcatttttcaactgggttgttttcctgttattaaaagagttctttactgatttttggacattaactctttatcagatatgtgatctgcaaatatttcctccagtctattgctcttgcaagtactatgttcaataaaagtgatgaga

SEQ ID NO: 463800 - DNA, 1145 bp, Homo sapiens
gagacactgctagtttaattttagcatggtgactactgaggccatgttttcttaagcattcaggtgatgaaaatgaggaaatggtgttgcaatatcaatgcccgcgtgacccaaatggccatgttattttaacgacaggaggagtgacacagacaactggatgagggaggctgtaactgaaatatcacgtgggtgaacaaagggagaaatgtcgatggcagctgtgttgaccctttacaacatgcagcggattctgccagatcccaccaacaatcatgctttctacagtaaccaagtgctgcatccaatcatggcaatgaaaaacagttctcctaacttgtaaatactttgatttgaaaaaatggagtttcaaatcatcctttttatttctatgaagattttaatccacctgcagaaaaaaaaaaagaatgttgatgctatcttgtccaaatacaaacatgactttgcccatctgtctgcctatttggcagaccgtgcaaatgtaaatttttgcaaattccatgcagtctatgaacgctttaccaaagaaaagttaaaaatattagccacgaagtgtcctgcacattttgtacacatcagtaaaaaggggtggagtttccttccctgtgatattgatgctttcaaaatgaaagcttttatttacttttcagtttcctcaaagcatgaaaaagcacttaatgagatttttcacattccagaaatggaaggagatggcctcctttggacatgtgcctacacgagggctgtcactgttgccagggtaaaaaggcagcctgccatacaaccatattttcaaagcatgggacaagaagaatgtccttgtctaatttggaaatatattaagaatgaaaatagagaaaaagattatggttaaacagtcaaactgaaatttataagttcttcctccaaaactgcctgatgatctttgaggagcccataaggcgtctggaaaagcatgaactgactgtccctgagttgtcgatgttatagaaaaggacagccaatttaaacaagactttctcacttctttactaaaactgtaacttatttggaattcaacttcaacttcaacttcacaagttcaaagtatctttgtgctttaaaactatttttcctgagagaaa

SEQ ID NO: 463801 - DNA, 1163 bp, Homo sapiens
agtcctcagtgagataggcaagtatgtccacattaaccaaaaagctttttgtctccacaaaagacaccaattgaaaatagtggctgctgaattagctagggcaaactacaaaaatgaatttgtgtgattgtgctgctcctttgattgttttttgaaactgagtaggggcacatttcctcatttacaggctgtaactgaaatatcacgtgggtgaacaaagggagaaatgtcgatggcagctgtgttgaccctttacaacatgcagcggattctgccagatcccaccaacaatcatgctttctacagtaaccaagtgctgcatccaatcatggcaatgaaaaacagttctcctaacttgtaaatactttgatttgaaaaaatggagtttcaaatcatcctttttatttctatgaagattttaatccacctgcagaaaaaaaaaaagaatgttgatgctatcttgtccaaatacaaacatgactttgcccatctgtctgcctatttggcagaccgtgcaaatgtaaatttttgcaaattccatgcagtctatgaacgctttaccaaagaaaagttaaaaatattagccacgaagtgtcctgcacattttgtacacatcagtaaaaaggggtggagtttccttccctgtgatattgatgctttcaaaatgaaagcttttatttacttttcagtttcctcaaagcatgaaaaagcacttaatgagatttttcacattccagaaatggaaggagatggcctcctttggacatgtgcctacacgagggctgtcactgttgccagggtaaaaaggcagcctgccatacaaccatattttcaaagcatgggacaagaagaatgtccttgtctaatttggaaatatattaagaatgaaaatagagaaaaagattatggttaaacagtcaaactgaaatttataagttcttcctccaaaactgcctgatgatctttgaggagcccataaggcgtctggaaaagcatgaactgactgtccctgagttgtcgatgttatagaaaaggacagccaatttaaacaagactttctcacttctttactaaaactgtaacttatttggaattcaacttcaacttcaacttcacaagttcaaagtatctttgtgctttaaaactatttttcctgagagaaa

SEQ ID NO: 463802 - DNA, 1059 bp, Homo sapiens
ttctgaataggacactcctctgcttcaaagatttccgtggctccccattgcctagagaataaaattcaaattcttgtagttcttaacgtcctggctatgttcgcagctccctcttccacctccgtcctccctctaagactcactattttcttctgctgcttcagcaaatccaggactccaaatgtcccatggccgtctccatctcagggcctttgctcatctgggttcctgctgcagggaattctgtcccttccagatgtggttgtctatcctggagttatagcagcgatttaccttgaagaaagcctggtccctggagaacttccatccactgcacgaatgcatgctgcaaatgacattcacattcgtgatttccagaaaaggacaaagaagtacgacttacactgtgcaagcaaacaaaacaataacactggtcaaacattatttcccattgattctgggatggaattacaggctgatttgaagcacaaagtccagttgcatcccagacccttgtctctaaacagccagtgccacaggatgtttcgtgaccacagcatgtccatcatcttactttccaaatgcagtgatgaaggttgaatgggtggagctttttatctggagctcaagaaaaatatagtgacaaggtgtgttagactgcctctcgtccacaggagaaaagacagaccaacctggatttccactttatatctaccactgatgagctgtgtgaccttgggcaagtgaactaacctctctggtcctgttttctcatctgcaaaaagcaaacaagacttgagctcctcaccctcaccacctcacaatctatggagatgccaggcagtgcacaaaccactcagccatatgcagcactctgcaggcatgaagactcagaggcaaaaaaacaagaagtgaaaaactccatttggctagagtggaggctttctgaagcagatataaaagtctaagacttgtgctgtccaatataatagccccttaccacacgtggctatttaaatttcaatgaattaaaattcaatacaattgaaatatctgttc

SEQ ID NO: 463803 - DNA, 2105 bp, Homo sapiens
caacagcaggaagctggtgtatatggcttgttagtctactcaatgtgttgagatcctgaaatggatctcaatggattgtgtagacaatgaaaaagaatggaattctgctgttgagaagctgaagagtgaggcactgagaattctgctgtcaaaggactacgtggagaaagaacacctccagctctctcaccagaaactcagtcagcttcaagaagaatttggtcaactcatggtggaaaggaatacctggttaaagaaggcgaatgaattttttaacagtgctaacaaggaagttatcaaatgtacatatgagcatcttatatggcataccagcaccaggcctcagggacaatcaaagccatataaaactgaccccaaatccccagaacctgtcccgcgtccagtcagggagctgcacatcaaggaagtgtgctccaggcacgaggggcccatgagtacagtggatgttgcggtcacttcttcagagaagggagacacaatccgaaagtctgagatcaagacaggccaaatgaaaggctctcaggtgtccggcatccatgagatgatggggtgcattaagagacgagtggatcatctgaccgaacagtgttcagcgcacaaggaatatgctcttaagaaacaacaactaacagcctcagtggagggttacctacggaaggtagagatgcagtttcagagcttaaaagaattttatgaaaccgaaatccctcagaaggagcaggatgatgctaaagccaagcattgttctgactcggctgagaagcagtggcagctatttttaaagaagagttttataacacaagatctagggcttgagttccttaatttaataaatatggcaaaagagaacgagatattagatgtgaaaaatgaagtgtacctcatgaagaacaccatggaaaaccagaaagcagaacgggaagaacttagcctccttcggctggcatggcagcttaaagccacggaaagcaagcctggaaaacagcagtgggcggcattcaaagagcaacttaaaaagacttctcacaacttaaaacttcttcaggaagcacttatgcctgtgtctgcacttgacctcggagggagcctccagttcattttagatctacgacaaaaatggaatgacatgaagcctcagttccagcaattgaatgatgaggttcagtacattatgaaagaatcagaggagttaactggcagaggagcccctgtaaaagaaaagtctcaacaactgaaggaccttattcacttccatcaaaaacagaaagagagaatccaggattacgaggatatcctgtacaaggtggtccagttccatcaagtcaaggaagagctgggacgtctcatcaaatcaagagagctggagtttgtagagcagccgaaggaactgggtgatgcccatgatgtgcagattcacctccggtgctctcaggaaaagcaagcccgtgtagaccatctccacagactggccctttccttaggagtcgacatcatctcatcagtgcagcggcctcactgctctaatgtttctgcaaagaacctacagcagcagctggagctccttgaggaggacagcatgaagtggcgtgccaaagctgaggagtatggacggaccctgtcccgtagtgtggagtactgcgccatgagagacgagataaatgagctcaaagactcattcaaagatatcaaaaagaaattcaataatttgaagtttaattacactaagaaaaatgaaaaatctcggaatctgaaggcgcttaaatatcaaattcagcaagttgatatgtatgctgaaaaaatgcaggctttgaaaaggaaaatggaaaaagttagtaataaaacctctgattctttcttaaattatccaagtgataaagttaatgtccttttggaagtcatgaaggatttgcaaaaacatgtggatgactttgacaaagttgtgacagattacaagaagaatttggacctgactgagcatttccaggaggtgatagaagagtgtcatttttggtacgaagatgcaagtgccacagttgtaagaagattggagtaatgcagctgctataagccaaggtgcaccagag

SEQ ID NO: 463804 - DNA, 3676 bp, Homo sapiens
caacagcaggaagctggtgtatatggcttgttagtctactcaatgtgttgagatcctgaaatggatctcaatggattgtgtagacaatgaaaaagaatggaattctgctgttgagaagctgaagagtgaggcactgagaattctgctgtcaaaggactacgtggagaaagaacacctccagctctctcaccagaaactcagtcagcttcaagaagaatttggtcaactcatggtggaaaggaatacctggttaaagaaggcgaatgaattttttaacagtgctaacaaggaagttatcaaatgtacatatgagcatcttatatggcataccagcaccaggcctcagggacaatcaaagccatataaaactgaccccaaatccccagaacctgtcccgcgtccagtcagggagctgcacatcaaggaagtgtgctccaggcacgaggggcccatgagtacagtggatgttgcggtcacttcttcagagaagggagacacaatccgaaagtctgagatcaagacaggccaaatgaaaggctctcaggtgtccggcatccatgagatgatggggtgcattaagagacgagtggatcatctgaccgaacagtgttcagcgcacaaggaatatgctcttaagaaacaacaactaacagcctcagtggagggttacctacggaaggtagagatgcagtttcagagcttaaaagaattttatgaaaccgaaatccctcagaaggagcaggatgatgctaaagccaagcattgttctgactcggctgagaagcagtggcagctatttttaaagaagagttttataacacaagatctagggcttgagttccttaatttaataaatatggcaaaagagaacgagatattagatgtgaaaaatgaagtgtacctcatgaagaacaccatggaaaaccagaaagcagaacgggaagaacttagcctccttcggctggcatggcagcttaaagccacggaaagcaagcctggaaaacagcagtgggcggcattcaaagagcaacttaaaaagacttctcacaacttaaaacttcttcaggaagcacttatgcctgtgtctgcacttgacctcggagggagcctccagttcattttagatctacgacaaaaatggaatgacatgaagcctcagttccagcaattgaatgatgaggttcagtacattatgaaagaatcagaggagttaactggcagaggagcccctgtaaaagaaaagtctcaacaactgaaggaccttattcacttccatcaaaaacagaaagagagaatccaggattacgaggatatcctgtacaaggtggtccagttccatcaagtcaaggaagagctgggacgtctcatcaaatcaagagagctggagtttgtagagcagccgaaggaactgggtgatgcccatgatgtgcagattcacctccggtgctctcaggaaaagcaagcccgtgtagaccatctccacagactggccctttccttaggagtcgacatcatctcatcagtgcagcggcctcactgctctaatgtttctgcaaagaacctacagcagcagctggagctccttgaggaggacagcatgaagtggcgtgccaaagctgaggagtatggacggaccctgtcccgtagtgtggagtactgcgccatgagagacgagataaatgagctcaaagactcattcaaagatatcaaaaagaaattcaataatttgaagtttaattacactaagaaaaatgaaaaatctcggaatctgaaggcgcttaaatatcaaattcagcaagttgatatgtatgctgaaaaaatgcaggctttgaaaaggaaaatggaaaaagttagtaataaaacctctgattctttcttaaattatccaagtgataaagttaatgtccttttggaagtcatgaaggatttgcaaaaacatgtggatgactttgacaaagttgtgacagattacaagaagaatttggacctgactgagcatttccaggaggtgatagaagagtgtcatttttggtacgaagatgcaagtgccacagttgtaagagttggaaaatattccacagagtgcaagacaaaggaagctgtgaaaattctccaccagcagtttaataagtttattgcaccctcagtgccgcagcaagaagaaaggattcaggaggccactgaccttgctcagcacttatatggtttggaagaaggacagaaatatattgagaaaatagtgacaaaacacaaagaggttcttgaatctgtgactgaattatgtgagtccctcacagagctcgaagaaaaactgaagcagggagatgttttaaagatgaatccgaatttggaagacttccattatgattacattgacttgctaaaggaaccagcaaaaaataagcagacaatattcaatgaagaaaggaataaggggcaggtgcaggtggcagatcttttgggcatcaatggaacaggggaagagcgactaccacaagacctgaaggtgtccactgacaaggagggtggcgtccaggacctgctcctgcctgaagacatgctctcaggggaagaatatgagtgtgtctcacctgatgacatctccttgcctcctctcccaggaagccctgagtcccctcttgcaccatctgacatggaggtggaagagcctgtcagctcctccctcagccttcacataagcagctatggggtgcaggctgggaccagcagcccaggggatgcccaggaatctgttcttccaccacctgttgcctttgcggatgcatgcaatgataagagagaaacattttcaagtcattttgagaggccttacctccagttcaaagctgagcccccactaacctccagaggattcgtggaaaagagtactgccttacacagaatcagtgctgaacatccagagagcatgatgagtgaagtgcatgagagagctttacagcagcaccctcaggctcagggtggtttgctagaaacacgggagaaaatgcatgctgataataacttcactaaaacccaagataggctgcatgcttcctctgatgcattctcgggcctcaggtttcaatcaggcaccagcaggggctatcagaggcaaatggttcctcgagaagagattaaaagcacatcagcaaagagcagcgtggtcagcctagctgaccaggcacctaatttctccaggctcctgtctaatgtaactgtcatggaaggttctccagtgactttggaagttgaagtaacaggatttccagagcctacactgacatggtacaagaagggccagaaattgtctgcagatgggcacttacaggttttacacaaggagacaaggcattcggtgttcattccaaaggtatgcaaggcagacgcaggcctctatgtggctcgggcccaaaactctagcggcgctctctcttccaatgtcatcctccacgtgacagaatttgtctagcaggttttctggtgaaaattaaactcaagattttcaccagaaaacgttttaaaacttctaaactcttaaacaaattataaatacttgatactttgaagaactgcaaaacaaaatgtttttaagttttcataaggcaaaatcattgagttttccagctttgattttccaataaaaggatgtataaatatttggtggtagtttttcaca

SEQ ID NO: 463805 - DNA, 1109 bp, Homo sapiens
ccggggtcctcatggattccgggtcccatggatgaaggaccagatcttgatctaggcccacctgtagatccagatgaagactctgacaacagtgcaatttatgtacaaggattaaatgacaatgtgactctagatgatctggtagacttctttaagcagtgtggggttgttaagatgaacaagagaactgagcaacccatgatccacacctacctggacaaggaaacaagaaagcccaaaggtgatgccacagtgtcctgtgaagactcacctactgccaaagctgccgtggaatggtttgatgggaaagattttcaagggagcaaacttaaagtctctcttgctcggaagaggcctccagtgaacagtatgcagggtggtatgccaccccatgagggcagagggatgccaccaccactctgcggaggtccaggaggcccaggaagtcctgggggacccatgggtcacatgggaggccgtggaggagatagaggaggcctccctccaagaggaccccagggttcccgagggaacacctctggaggaggaaacgtccagcaccaagctggagacaggcagtgtcccaatccgggttgtggaaaccagaacttcgcctggagaacagagagcaacaagtgtaaggctccaaagcctgaaggcttcctcccgccacccttcccacccccgggtggtgatcatggcagaggtggccctggtggcatgtggggaggaagaggtggcctcatggatcatggtggtcccggtggaatgttcagaggtggctgtggtagagacagaagtggcttctgtggtggctgggcatggaccgaggtggctttggtggaggaagacaaggtggccctggggggcccccggacctttgattcaaatccagagatagaaagcagaatggtgactgccaggggccggaggaaggaaagaatgaagaattgttcagtgtacgtagagtttcagtttcacaagatggaaaggttcaggaggttggttgcataaggaatatatttaacactactgaactgtacacttaaaaatggttaaaatagtacttttatgttagtgtatttcattgcaataatttgttttagaaa

SEQ ID NO: 463806 - DNA, 1318 bp, Homo sapiens
acgggcagcagagttcattctgacaggaccaccccagtagcatgggtgtttatgggcaggagtctggaggattttccggactaggagagaaccggagcatgagtggccctgataactggggcaggggaagagggggatttgatcgtggaggcatgagcagaggtgggcggggaggaggatgcggtggaatgggcagcgctggagagcaagttggcttcaataagcctggtggacccatggatgaaggaccagatcttgatctaggcccacctgtagatccagatgaagactctgacaacagtgcaatttatgtacaaggattaaatgacaatgtgactctagatgatctggtagacttctttaagcagtgtggggttgttaagatgaacaagagaactgagcaacccatgatccacacctacctggacaaggaaacaagaaagcccaaaggtgatgccacagtgtcctgtgaagactcacctactgccaaagctgccgtggaatggtttgatgggaaagattttcaagggagcaaacttaaagtctctcttgctcggaagaggcctccagtgaacagtatgcagggtggtatgccaccccatgagggcagagggatgccaccaccactctgcggaggtccaggaggcccaggaagtcctgggggacccatgggtcacatgggaggccgtggaggagatagaggaggcctccctccaagaggaccccagggttcccgagggaacacctctggaggaggaaacgtccagcaccaagctggagacaggcagtgtcccaatccgggttgtggaaaccagaacttcgcctggagaacagagagcaacaagtgtaaggctccaaagcctgaaggcttcctcccgccacccttcccacccccgggtggtgatcatggcagaggtggccctggtggcatgtggggaggaagaggtggcctcatggatcatggtggtcccggtggaatgttcagaggtggctgtggtagagacagaagtggcttctgtggtggctgggcatggaccgaggtggctttggtggaggaagacaaggtggccctggggggcccccggacctttgattcaaatccagagatagaaagcagaatggtgactgccaggggccggaggaaggaaagaatgaagaattgttcagtgtacgtagagtttcagtttcacaagatggaaaggttcaggaggttggttgcataaggaatatatttaacactactgaactgtacacttaaaaatggttaaaatagtacttttatgttagtgtatttcattgcaataatttgttttagaaa

SEQ ID NO: 463807 - DNA, 2423 bp, Homo sapiens
ccgcccgagctcctcctcctgtcagatcagcggtggcattagattgtcctgagtgtgacctgaaccctgttgttcctggaaaaattatcttccacaaaaccagtccctggtgccagcatggttggggacacctgtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacttcttgcatgaaaatagtacgttgcgggaagaaattgccatgctaagactggagctagacacaatgaaacatcagagccagctaagaaaaaagaaatatttggaggatattgaaagtgtgaaaaaaaagaatgataatcttttaaaggctctacaattgaatgagctcaccatggatgatgataccgccgtgctcgtcattgacaacggctctggcatgtgcaaggccggctttgcgggcgacgatgccccccgggctgtcttcccttccatcgtggggcgccccaggcagcagggcatgatggggggcatgcatcagaaagagtcctatgtgggcaaggaggcccagagcaagagaggcatcctgaccctgaagtaccccatggaacacggcatcatcaccaactgggatgacatggagaagatctggcaccacaccttctacaacgagctgcgtgtggcccctgaggagcaccccatcctgctgaccgaggcccccctgaaccccaaggccaaccgcgagaagatgacccagatcatgtttgagaccttcaacaccccagccatgtacgtggccatccaggccatgctgtccctgtacacctctggccgtactactggcatcgtgatggactctggtgacggggtcacccacactgtgcccatctatgatgggaatgccctcccccatgccaccctgcgcctagacctggctgggcgggaactgactgactacctcatgaagatcctcaccgagcgtggctataggttcaccaccatggccgagcgggaaatcgtgcgtgacatcaaagagaagctgtgctatgttgccctggacttcgagcaggagatggccatggcggcctccagctcctccctagagaagagctacgagctgcccgatggccaggtcatcaccatcggcaacgagtggttccgctgccccgaggcgctcttccagccttgcttcctgggcatggaatcctgtggcatccatgaaactaccttcaactccatcatgaagtctgatgtggacatccgcaaagacctgtacaccaacacagtgctgtctggcggcaccaccatgtaccctggcatggcccacagaatgcagaaggagatcgctgccctggcgcctagcatgttgaagatcaggatcattgctcctcccaagcgcaagtactccgtgtgggtcggtggctccatcctggcctcgctgtccaccttccagcagatgtggatcagcaagcaggagtatgatgagtcaggcccctccattgtccaccgcaaatgcttctaggtggactctgacttagttgcgttacaccctttcttgacaaaaccaaacttctcagaaaacaacatgagattggcatggctttatttgttttcttgtttcattttttgttttgttttttattggcttgactcaggatttaaaaaccggaatggtgaaggtgacagcagtcggttggaggaagcttcctccaaagttctacaatgtggccaaggactttgattgtacattgttcttcttttcaatagtcattccaaatattgtgagacgcattgtttcaggaagccccttgccctgctaaaagccaccccacttctctctaaggagaatggcccagtcctctccctagttcacacaggggaggtgatagcattgcttttgtgcagattacataatgcaaaattttttgaatcttcgccttaatactttttaattttgttttattttgaatgatcagccttcgtggcccccctcttttgtaccccaacttggggtgtatgaaggcttttggtctccctgagagtggctggaggcagccagggcttacctgtactctgacttgaggagagttggataaaagtgcacaccttaaaaaaaattgaggaagcacagtatttcagtacagtggacagcttagcatgttgacaactgagaataaaatgctcagttctgaactggacaatgtaagacacaacgaggaaacaccggaaatggaaattcaattacgtcattgtagactggctgctgctctacatgattgtgaccaaagtcagatagctgaaagagacttctttccagagaacaagacatgaacaggtttatttacagaagacaatgaattc

SEQ ID NO: 463808 - DNA, 770 bp, Homo sapiens
ccaaatggatatggaggtcttgggccaggaacaaagctccgaacagctggatttagaggagatctcaaggaaaatttcattccttgacaaatggagggaaatctttagttatcacagagagaaaaagagaaaatttaaaacaaggtcatcaccagctctgtttgctttgtcttttgtgggggtgatatttgcacagaatcatgaaggcaaccatacatctgctgatgaaaatgaagatggaacaggactatctcagcccaaaggacaaggacatttgccatcaagtggcctttgttctattcccaacccctctatcatctcttcaaaattgggtggctttcctatctccctagcaatggccacgatgcctgaagccacaggaagatgggcaggtatgcagagctcccggaacactgcactcagctcactggccttcaagcctctggatggagccttaacttgtatcttatatagatacttaatcgctgtcctttcaagcaacgaagatagataatatgtaatccttgccagggcccccagccctcagtgattctgctgcctacactgtggtatagaccagaagttagagcaactatctgcattttacttgacaaggaaatgtttttaatgaaaaactttaataaaaatgtattcttggcttctgcaatgaatttctttagagaatgtcattttaaaatttacacgtatctgaaaaataggctaccttttatgtgaaaatgagagacaattatgattctatattgatactt

SEQ ID NO: 463809 - DNA, 1734 bp, Homo sapiens
gctaaagggaagccaacatgcattttctgcacacctggcttctgggtctaagatttttgtctgctcctaaaatgcaagccttgttgaattggtgtgggcttctccttaatcgctgggtaaagcagagggctggggcacagccatatgcagtaatcagcctgcccttaaccaaagggcccgaggaagaggtgagaccaaagaaggtgaatcacaggttcaaaagcgaagcaaataaaagcagtggggagagacggggtatgaatatggagcacactttgagacacagacacttcccaggaccctgcagccctctgagcatccctccaccctactcagaggcatttttcccatatcgaactcctcggggttggggattctggatcctcctatgtaaccactccttcctgcttcatctcaacatctgtgttgtttgcaaagaaagtgggctccataaggtcaagggttgccccaggtgcatttgggtgtttaacagggttttgggtgatgactgtgtaaaaggaacaatattagagtttttgaccagagtgactgaggagctcacaggagtacagggtgtataagtcccaccaaagattccatgtgccttgggactgccccatcccattgggaattccagtctggcttcttggcaatgggtgcctgggcaacagagcaacagagcaacagagcaaggtggaggagagaagccctcctggtacccatccccacaccagcaagagggagcgccagactcacagcctcccatcccctccagccccagcccacctgacctacatcagccaccttctgattgattctgttttttcctggggaaaaggccaaaaagccatctaggcctcaaccccagcatctctgaacctctgacccagccctggacttccaaatttcagacttctttcagctcctgcttcttcgtcacaggtacaccagggcatccagcacattgatttgtccccactcgccttagcctgtctcctgccacagttgtctcattttggtgaagtgcgtgtccagatttccccatgctcccagctgcaacatggatctgtgaaagacagtacagcagaaaagtattcacatcctggctctctctgcccttcattgtctttaagctctttaacaacttttacttggagaggaaaacaactatctagacaggaacacggagcagcagagggagaaattgtgtctttactgatttcagtcaattattgcagtgaccacatgtctcaggagtgttgatgtccagatgagggctgacccatgaaaggtcagcaaggaaaaaggaggacctaaactttcctcggtttgcaagttgtaaaagacccatggaatgccaactatccttgtccatggacatgtggacagactgtccagtggctatcatcaattttgcatctatttgtaaattctatgtcagcattcctattgtcctagctatgcgtggcatttttaattctcctttgggctggttgtagcatcttactggttccctcattaattaatgaactaaataaaatctttgacatgtgttcattttacatttgtgtaagagtcatgattttacctttaaaaaaaaaagtcattttacaggtctcaggagagaggcagctgcatcaacaaacacaaggactagctctcctctagagaattcacagctgaagggtagattaaacgcaccctttgcctttcccacctttcattccctttacc

SEQ ID NO: 463810 - DNA, 1508 bp, Homo sapiens
atagtgctgcagcggcaattagctttaatctccgcccacgtccagtggctgagctacaacgaactgccccacctcttttaaagcgtctttctctgaactgtgcaaggaagagagcatcgcctgacagtggcgcaaggggcaacgccactcgccctgtccctctagcgtggcctctgtttgggggtctggggtggaggtcgtcccggcccgggtggttccggacgccggctttccgcacctggctcggtgacggcctcggcgccccgccctcttggccacggtccgcagccatcgccccagtgagggcgcggtctgtgggcggggccggctccaggagccgcgctgtgattggccgtgtccaggcaaccgcggagacgccgtcgtcaacagaccgcgctcggaaccagaggcgcgggtcacagagacctagaacatctggaatccttcgcccccggcgcgcagccttcgcccgccggaatcgctgccttatccaccagcgggatgcttacctcgcccgccctctcgggtcaggcgggcccgggaggatgggagggtggctgctgagcgggagccgccacgtcttccacccgacatattgcctagagtttgctgtgacttagatcttgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagattatgtggcgtctctggggagacctgtggcttctcggtatgctgatggtctgtttccacagctctacagagcagaagatggcagagtatacaatctgacagctaaatcagaactgatttatcagtttgtggaacatttaacacaagctgtggagagctacaagcagcgaatggactggctcaccagcaagagccggcagattttggtgtcatcttggaacagtgcgtcaccatagtgctggattttggcggcattctggagggggagcttgatctgtgccgagaggctctaacaatggttctccaggagcaggtggctcacataaccgagttcaatatcatacgggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactttactcttcttcacagatggatctgtcatctgtcacacactttccaaggtgaagtacgcgcaagctgatgactccatccatttttggatgtcaatgtattgacatgaattttgatagggacatttttggaaataaagctttacctggaagaagtgattagatggtggtgtgtt

SEQ ID NO: 463811 - DNA, 1625 bp, Homo sapiens
atagtgctgcagcggcaattagctttaatctccgcccacgtccagtggctgagctacaacgaactgccccacctcttttaaagcgtctttctctgaactgtgcaaggaagagagcatcgcctgacagtggcgcaaggggcaacgccactcgccctgtccctctagcgtggcctctgtttgggggtctggggtggaggtcgtcccggcccgggtggttccggacgccggctttccgcacctggctcggtgacggcctcggcgccccgccctcttggccacggtccgcagccatcgccccagtgagggcgcggtctgtgggcggggccggctccaggagccgcgctgtgattggccgtgtccaggcaaccgcggagacgccgtcgtcaacagaccgcgctcggaaccagaggcgcgggtcacagagacctagaacatctggaatccttcgcccccggcgcgcagccttcgcccgccggaatcgctgccttatccaccagcgggatgcttacctcgcccgccctctcgggtcaggcgggcccgggaggatgggagggtggctgctgagcgggagccgccacgtcttccacccgacatattgcctagagtttgctgtgacttagatcttgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagcttgaagaattccctttagcatttcttataaggcaggtctggtagtgatgaactccctcggcttttgtttatctgtgaaagtctttatctctccttcatttgggaaggacagctttgattatgtggcgtctctggggagacctgtggcttctcggtatgctgatggtctgtttccacagctctacagagcagaagatggcagagtatacaatctgacagctaaatcagaactgatttatcagtttgtggaacatttaacacaagctgtggagagctacaagcagcgaatggactggctcaccagcaagagccggcagattttggtgtcatcttggaacagtgcgtcaccatagtgctggattttggcggcattctggagggggagcttgatctgtgccgagaggctctaacaatggttctccaggagcaggtggctcacataaccgagttcaatatcatacgggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactttactcttcttcacagatggatctgtcatctgtcacacactttccaaggtgaagtacgcgcaagctgatgactccatccatttttggatgtcaatgtattgacatgaattttgatagggacatttttggaaataaagctttacctggaagaagtgattagatggtggtgtgtt

SEQ ID NO: 463812 - DNA, 692 bp, Homo sapiens
actgctaccaacagttctgatgctcaaaccacacccatctggagccacctgctgcctgggcccaaggagcctctgtaccctgctgggcaactttgaggaatcattgctgcaaggacgctttgcaccatctggccacattgagggcttcacagcagagactggagctagtgggtcctactgcccccaccatgtcacactgcctgtcactgtcaccttctttgaggtttctgagcaaaatgcccccacccacttcctgggctttgtggatctgaacctcctggggaggaagagttacagcgtgcccaaagtgggcaccacacaagtaacatttaaccccaaccagactgtggtgaagatgttcctggtgacctttgacttcttggacatggctgctgccacatgcccttattgtgccattgcctctttttggtgcctgtgggtgaggagaaaaatgctaaccccacctactgcctcctctgctactcgctgcaccttgggttctggagctcccgctcaggcctcttaagcctgaatggagatctctgccagcttttttcctgctagagcctggagctggacgcagggctcccctgcgaacttcaggctgtgactggggcccctcttaacccacgttattcacttttgccctgattgccattactctgaaccaatgtggatcaatgacctgccca

SEQ ID NO: 463813 - DNA, 886 bp, Homo sapiens
agacgatgtttcccacatataattcagagacccctgaaattaggtatccctcttgtagatgtccttgagatgctgctggacctgggaaagaggaaactgggatatgggtctatgccaaaaggtgcttctagttacaggacagagaggaaaggggcagagggagaaaaacctgaagtctgagaatctggattgcagaagactaccgaggtcgtgggagaagggagagaaaacaaggatgaaaaccgaaaggggaagaggcatgaaatgttgccagatgtcaaaaggcatttggagagaagggactggcagactattgcaaaaagggcacggggcagagggactatgttgtgagcctgcgaaagaagtttgtgtggggactgtgggcagtgaatgcgttgggaacaatatggaaaactgggagctgccttggaatctacagggccgggctgaagaaaagaagaatggtattcatgcagttcccattttacagatgaaaacaagaggactttttctgtgaagtcaagaaagtggttacaatggtactttcagcctgtccgaattatgtattgcccctcccctttttattaataacattgaagtgtgatgggacaaccactgaagccgtctgttgaaacctgctgggactttttagccattctcttcaacataaagaatgggtgtttttggagggggtgagaggaatggggaaatgttgtcaaagagtacaatgttttagttgagacaggaggaatatattttgttgagatctacagcacagcatggtgactgtagttaacaatgaagtattgtgtatttccaaattgctaagacaataaatttcaaatgttctcaccacaaaaaagataggttttgaggtgatgaatct

SEQ ID NO: 463814 - DNA, 712 bp, Homo sapiens
tgcggccgcgttgccgacctccagcagcagtcggcttctctacgcagaacccgggagtaggagactcagaatcgaatctcttctccctccccttcttgttttcggctttgtgagaaaccttaccatcaaacacaatggccagcaacgttaccaacaagacagatcctcgttccatgaactcccgtgtattcattgggaatctcaacactcttgtggtcaagaaatctgatgtggaggcaatcttttcgaagtatggcaaaattgtgggctgctctgttcataagggctttgccttctttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggattgtgactttcaacgggactattatgataggatgtacagttacccagcacgtgtacctcctcctcctcctattgctcgggctgtagtgccctcgaaacagaaaaacagtgcctctcatactttgatatatgtatgatttacctaggaccttgttaaaatctagattctaagtcaatagttctagggatcaggtagtaatattttaatattttaggctttgcaggacaagaagcaaaatcaagg

SEQ ID NO: 463815 - DNA, 3460 bp, Homo sapiens
agcggaagaatcctgatgcccaagccatgctgcacacatattaagtcaaattctggagagtgggcagctggatccacgtctaccctaatggatccctgtttattggatcagtaacagaaaaagacagtggtgtctacttgtgtgtggcaagaaacaaaatgggggatgatctgatactgatgcatgttagcctaagactgaaacctgccaaaattgaccacaagcagtattttagaaagcaagtgctccatgggaaagatttccaagtagattgcaaagcttccggctccccagtgccagagatatcttggagtttgcctgatggaaccatgatcaacaatgcaatgcaagccgatgacagtggccacaggactaggagatatacccttttcaacaatggaactttatacttcaacaaagttggggtagcggaggaaggagattatacttgctatgcccagaacaccctagggaaagatgaaatgaaggtccacttaacagttataacagctgctccccggataaggcagagtaacaaaaccaacaagagaatcaaagctggagacacagctgtccttgactgtgaggtcactggggatcccaaaccaaaaatattttggttgctgccttccaatgacatgatttccttctccattgataggtacacatttcatgccaatgggtctttgaccatcaacaaagtgaaactgctcgattctggagagtacgtatgtgtagcccgaaatcccagtggggatgacaccaaaatgtacaaactggatgtggtctctaaacctccattaatcaatggtctgtatacaaacagaactgttattaaagccacagctgtgagacattccaaaaaacactttgactgcagagctgaagggacaccatctcctgaagtcatgtggatcatgccagacaatattttcctcacagccccatactatggaagcagaatcacagtccataaaaatggaaccttggaaattaggaatgtgaggctttcagattcagccgactttatctgtgtggcccgaaatgaaggtggagagagcgtgttggtagtacagttagaagtactggaaatgctgagaagaccgacatttagaaatccatttaatgaaaaaatagttgcccagctgggaaagtccacagcattgaattgctctgttgatggtaacccaccacctgaaataatctggattttaccaaatggcacacgattttccaatggaccacaaagttatcagtatctgatagcaagcaatggttcttttatcatttctaaaacaactcgggaggatgcaggaaaatatcgctgtgcagctaggaataaagttggctatattgagaaattagtcatattagaaattggccagaagccagttattcttacctatgcaccagggacagtaaaaggcatcagtggagaatctctatcactgcattgtgtgtctgatggaatccctaagccaaatatcaaatggactatgccaagtggttatgtagtagacaggcctcaaattaatgggaaatacatattgcatgacaatggcaccttagtcattaaagaagcaacagcttatgacagaggaaactatatctgtaaggctcaaaatagtgttggtcatacactgattactgttccagtaatgattgtagcctaccctccccgaattacaaatcgtccacccaggagtattgtcaccaggacaggggcagcctttcagctccactgtgtggccttgggagttcccaagccagaaatcacgtgggagatgcctgaccactcccttctctcaacggcaagtaaagagaggacacatggaagtgagcagcttcacttacaaggtaccctagtcattcagaatccccaaacctccgattctgggatatacaaatgcacagcaaagaacccacttggtagtgattatgcagcaacgtatattcaagtaatctgacatgaaataataaagtcaacaacatctgggcagaatttattttttggaagaagtttaatcaaaggcagccataggcatgtaaatgaatttgaatacatttacagtattaaatttacaatgaacatgcaaaataaaaggacttgtaaataaatgcattatgaactgatgatactgatttatttaatggatctcaaaacaaacttttaacttaaggcacttttattttgccaacaaataacaataaacaaacattgaaacggttcactataaaataacaaatggctaatgtacctgaatttttcagtaaaaaaatgaacttctaataccagttgcctagtgtccacctcctatcaatgttacaagcatggcactcagaacagagacaatggaaaatattaaatctgcaatctttatgatgtaaatttaccatcctgatgtataaatattttgtggtttataaatttttttgctaaaacctacagaaaataagcactgaactgtcttatgattcaccatttgttcacactgaaaattttcattgatggggaatacaaaaatgttttaataactgcatttaaaaataaatgcaggctcacttttccacatgtaaaaagcaatgtaatacctgcacatcataaaatgtgaaaagggggttatttttgtccaaatacacccattaaaaaggttttaaaaatacaatgaaacttctttataactttaaaatctagctcaggcacccctggtttggagctgtttataaggaaatttttctgagcaggaatcgttgctctataagcatttcatttcattaattctttatgggatgggaaaatgcttgggagggtctaggtctattatatataatgaagtttcactgtatttaaaatctgatcaatcctacacaaaatgtgtttttgtaattcactgaatttatattacatgcttaattcaacctgaattaatttggggaatattaaatgattgatcttatctaaatctaggggtggggttttccagtgtaatttctccagcatctattcaaacattcacctagtacttacttaagaattataggagctttataaatgggaaaaaaatgccataggtcttagatatctcagtgcacaaaaccgagaattactaataagttagcccctgccaatcatttgagacatgtggaatagcgcccttgggttttcatcacactgactttcagttagccccatctcagcctaaaatgtgacctggttgcaacttatgtctgatgttagtaccctgtggctggaagtggtcaaagctacgcattgatctcctctacttccaggccaagaagggtaaatgcaatgactgacaaatgcaaccctattaagaaaaagcctacagtgtaaacaagagagtctatgggcttcttatatccaagaactgtgattgataggtatagctgactccatttgatttcaaggtcttgtctttaaggggagctggggtctcgc

SEQ ID NO: 463816 - DNA, 3552 bp, Homo sapiens
agactcagacatcattattattttaaactccacaagtgttttaatgtttagccaagtttaagaaccaatacttttagaaagcattaggaaagaatgccagtatagcatggtggaaagcgtaaggcttgagaaccagccctgtgacctaagagtgggcagctggatccacgtctaccctaatggatccctgtttattggatcagtaacagaaaaagacagtggtgtctacttgtgtgtggcaagaaacaaaatgggggatgatctgatactgatgcatgttagcctaagactgaaacctgccaaaattgaccacaagcagtattttagaaagcaagtgctccatgggaaagatttccaagtagattgcaaagcttccggctccccagtgccagagatatcttggagtttgcctgatggaaccatgatcaacaatgcaatgcaagccgatgacagtggccacaggactaggagatatacccttttcaacaatggaactttatacttcaacaaagttggggtagcggaggaaggagattatacttgctatgcccagaacaccctagggaaagatgaaatgaaggtccacttaacagttataacagctgctccccggataaggcagagtaacaaaaccaacaagagaatcaaagctggagacacagctgtccttgactgtgaggtcactggggatcccaaaccaaaaatattttggttgctgccttccaatgacatgatttccttctccattgataggtacacatttcatgccaatgggtctttgaccatcaacaaagtgaaactgctcgattctggagagtacgtatgtgtagcccgaaatcccagtggggatgacaccaaaatgtacaaactggatgtggtctctaaacctccattaatcaatggtctgtatacaaacagaactgttattaaagccacagctgtgagacattccaaaaaacactttgactgcagagctgaagggacaccatctcctgaagtcatgtggatcatgccagacaatattttcctcacagccccatactatggaagcagaatcacagtccataaaaatggaaccttggaaattaggaatgtgaggctttcagattcagccgactttatctgtgtggcccgaaatgaaggtggagagagcgtgttggtagtacagttagaagtactggaaatgctgagaagaccgacatttagaaatccatttaatgaaaaaatagttgcccagctgggaaagtccacagcattgaattgctctgttgatggtaacccaccacctgaaataatctggattttaccaaatggcacacgattttccaatggaccacaaagttatcagtatctgatagcaagcaatggttcttttatcatttctaaaacaactcgggaggatgcaggaaaatatcgctgtgcagctaggaataaagttggctatattgagaaattagtcatattagaaattggccagaagccagttattcttacctatgcaccagggacagtaaaaggcatcagtggagaatctctatcactgcattgtgtgtctgatggaatccctaagccaaatatcaaatggactatgccaagtggttatgtagtagacaggcctcaaattaatgggaaatacatattgcatgacaatggcaccttagtcattaaagaagcaacagcttatgacagaggaaactatatctgtaaggctcaaaatagtgttggtcatacactgattactgttccagtaatgattgtagcctaccctccccgaattacaaatcgtccacccaggagtattgtcaccaggacaggggcagcctttcagctccactgtgtggccttgggagttcccaagccagaaatcacgtgggagatgcctgaccactcccttctctcaacggcaagtaaagagaggacacatggaagtgagcagcttcacttacaaggtaccctagtcattcagaatccccaaacctccgattctgggatatacaaatgcacagcaaagaacccacttggtagtgattatgcagcaacgtatattcaagtaatctgacatgaaataataaagtcaacaacatctgggcagaatttattttttggaagaagtttaatcaaaggcagccataggcatgtaaatgaatttgaatacatttacagtattaaatttacaatgaacatgcaaaataaaaggacttgtaaataaatgcattatgaactgatgatactgatttatttaatggatctcaaaacaaacttttaacttaaggcacttttattttgccaacaaataacaataaacaaacattgaaacggttcactataaaataacaaatggctaatgtacctgaatttttcagtaaaaaaatgaacttctaataccagttgcctagtgtccacctcctatcaatgttacaagcatggcactcagaacagagacaatggaaaatattaaatctgcaatctttatgatgtaaatttaccatcctgatgtataaatattttgtggtttataaatttttttgctaaaacctacagaaaataagcactgaactgtcttatgattcaccatttgttcacactgaaaattttcattgatggggaatacaaaaatgttttaataactgcatttaaaaataaatgcaggctcacttttccacatgtaaaaagcaatgtaatacctgcacatcataaaatgtgaaaagggggttatttttgtccaaatacacccattaaaaaggttttaaaaatacaatgaaacttctttataactttaaaatctagctcaggcacccctggtttggagctgtttataaggaaatttttctgagcaggaatcgttgctctataagcatttcatttcattaattctttatgggatgggaaaatgcttgggagggtctaggtctattatatataatgaagtttcactgtatttaaaatctgatcaatcctacacaaaatgtgtttttgtaattcactgaatttatattacatgcttaattcaacctgaattaatttggggaatattaaatgattgatcttatctaaatctaggggtggggttttccagtgtaatttctccagcatctattcaaacattcacctagtacttacttaagaattataggagctttataaatgggaaaaaaatgccataggtcttagatatctcagtgcacaaaaccgagaattactaataagttagcccctgccaatcatttgagacatgtggaatagcgcccttgggttttcatcacactgactttcagttagccccatctcagcctaaaatgtgacctggttgcaacttatgtctgatgttagtaccctgtggctggaagtggtcaaagctacgcattgatctcctctacttccaggccaagaagggtaaatgcaatgactgacaaatgcaaccctattaagaaaaagcctacagtgtaaacaagagagtctatgggcttcttatatccaagaactgtgattgataggtatagctgactccatttgatttcaaggtcttgtctttaaggggagctggggtctcgc

SEQ ID NO: 463817 - DNA, 1110 bp, Homo sapiens
gaaagacagagaggcaaatgcagcgggttgggggtggtcagcagagaggggtcggtccattccagcttcctgtggacactgctggctgagggttggaggtggggcaggaacagactgcacctggcacacaggccagaccccctcaagcccctccatggcaggaactggtattgatcccattttaaagctgtgaaaactgcggggaaaaaaatgaagtgacttgcttgaggtcccagagctagtggcaaaaaggagcaatgaagtccatgacggcctgagtctgctggatgtcaagaccctcagttccaacgattcgacctcattcagcatcatctgctgtgctgatgtccaggggccagagcagttattgcaaaggaagatttctctaaggctcttcctatttttctgttagccatgcaaagtttataaacttttattaggatagcagtaaattgcagagcagtgacaatatgtgaaaaaggtcttgcttcactcaattaagtatgttctggatggttacagacttcatgtaggaaagagtttgcatccccttcagtctcctagcacctacccaaatacgtggagtggagtgaatttatgtataatgctggctatgtctaatcttggactattccctcacctcctaaataaaccacttgactttgaattcaacctgagacacaggcttcaagttcatggcttcaagttcatggctttggtgagggggagggagaagaaggacaaaccatggggactggggcccagtcagcctccaggcttcttcccagaacattttgggattggccacctccaggtccaaaccagggacagtagccagcatagcctcccgggccattcagcagaactgggggcctctgtgacctgggattctgctcagcaccatcctgtctaccccatgtggatgccctgttccagcagcacagaacccttggagccccttactgcaggttcattgcaagcagttaaatgggaaccttcacaggctccacctgcaagtgtgctgccaaagagcattgaaggaaaccactagggaccagcagcctcagcactgccagggaaaatgacagaaatgcacattcttggcccggc

SEQ ID NO: 463818 - DNA, 2441 bp, Homo sapiens
gcagagcctcagagaagttaaacgattgatcctatgtcagggggtagagtcaagactcatacctatgccttttaacttcaagattggacgactgattattggacagaatggcatcttgtcgacacctgcggtctcctgcattatcaggaagatcaaggcagctggtggaatcattctaacagccagccactgccctggaggaccagggggagagtttggagtgaagtttaatgttgccaatggagttctaaatggtgcactggatgttgaaaaagttgatgatgagcaagaacaaaattcctcctttcaggagacttacagttcaatatgggaaatgtaatttgttaaaatataaaagtgcaattgtgttacatgctgtacgaagtacatgttgacatgggcatctggcatccggcaagtggcagctccctcatcatcctgtctgatccaaattcaacccacattcagccaggtgaccatggtggctcccccccagggtggagctgatcccctccatgaggcagcttgcaacatggcagcctgcttcttcaaaggcgtcaagagagagtccccagaaagacagtcccgaatctcatctaaatcgggtttaggtgtagaacagatttccttggatgttcctctgatctggaaaactaaagatacaagctatctgccccctacatatgcaacacacaatggtctctggagcccaacgcacacttcagcccactctcacaggcattctctctgtccacaaaatatcaccgaagagtcttctgtgagtgcagcatggtgtgaacactgggagtacaaggagaaataagacacagttgctgtgctggagaagcttgtgcccagtggtggtgatactgccggagctcccacacaacggggtttcggggctgtggaccctgtgccaggaaaggaagggcgcagctcctgcaatgcggagcagccagggcagtgggcaccaggctttagcctccctttctcaccctacagagggcaggcccttcagctccattctcctccaaggctgcagagggggcaggaattgggggtgacaggagagctgtaaggtctccagtgggtcattctgggcccagagatgggtgctgaagctcccacgcctgcctgtgaaaatggagtcctctctcacctgggagagccaggtgctgccccgagaaggatgcatttatggcttcatgaagtctttcctgacccccgatgctgctgactatagagacaaagtctcactatgttgctcaggctggtcttgaactcctggcctcaagcgatcctcccaccttagcctcccaaagagttgggattatagacatgagccactgcacctggccgaccttgggcaagttcttaaacccttcaaagcctcatttttctccaatcataaaagggaaagatggtaatattttcccctccaaattcttgtaagtattaaacattgtatatgtattttgaacacgattaagctctaaacacttgttaggaagcaggagtagcatttgaaacaaacagctcttttcccacaggtcggatgccctcacagaattgagattatgtacgtaaaacaccaggtgcctaacccggcacagagcaggagggctaagcgtgacatccagcacgtggtcagtggaatccagtattcctacccacctctctagtctcccctccacccctctccctttcagaggcaccaagctgcttgtggtcttgtctattcccactccctgcctgactgaacattttctccacctcctgatcatcagcagcagaaactggctgctcttcctcctgggtagacagccagactgtatttcccagctgcccctgcagtgagatgtggccatcggagccagcattggccaatggactctgcatgggagtgacgcatgctgcctccaggcttgtccctaaaacctcccacgtgtcctccgcctgctcttcccacttccaaggagcacggcaattgtggaagacccagattagtgatggcagaaccatagatgggaggaacctgggtccctgacttaaagtatcatggatttggatgttcccttagtgagaaataaacttccattgtgtttaagcctttatttgtttatagttggttacagcaactgccttcttttaattaaaacactcctgctgcttcatgttgctggaatgcttgtaaccctgccctgcttcaccagggtaactcctacttggcctttaagtttatctctgctgtcacaccgtccagaaagccttctcccagcaccacaacccctccaccaagggttaggtgtctccagcagatgctgcacagctggctgccctttgcccaccctccccttctttctcatagaatcctaggactcctatgtatctagaaggagttgtgtggtccagtgctggccaagaagatgtgagagcaagtc

SEQ ID NO: 463819 - DNA, 1459 bp, Homo sapiens
cggggtcgcgcggacgcggctcgggccgcgggtgccgagaggtcgccgggccacccgcacccccgctccccgcctgacgcacggaggggccgggacgcgatttgccgcgagtgactggagccgcagccgtcgccgctgctgccgccgccgcccgggcccgctccgcccccagcccgccttcctcccgccgcgccctccgcctccgcccgcacctcgatagcgttcccctgtcttccccaacgccccggagccgccggccgctagcgtcagcgccagccaggtgagtgtggccgccgctcggcccgggcgggagaagcgcgcaggccccgcggccgggtggccggcttgggccggtgcagtcggcggcggcggcggtagcgggcccggctttcttcccctgcgcgggccgcggggcggaggggctacgcagtgaaggaggggcgcccccgccccgccaccgcctctgctcccaacgccccgaccgcccccaccgccttgccgccacagacaaagcgccggaggtgggagccctgcgggccgcctttgcctccgcgccgtctgccgggtgcggccgcggcccgcagagaccgggccgcgcgcttttccgttcctgagcgcccttgttcatttctgggtgaaagggacccgaattgtgcaacaggtttgggcgttagtccttattttccagcgggtctcttttgccagcgtgcaggaaccagatgtggctccctgctctcgggcgagtcccgcgtccagcgcccgcgactggctcctttgtgtgaccggtgaccggccctgtcgggtgggtggaggacacgggctcgaggccccagggctgcgccgaggctcctggacgcctcctcaggtcgcggggcttggcttccacgggcctgccagagatcattctaacagcgccccttgtgggctccactgggctccactcacacaacagggatgggggatgttggagctgcaggtctgttggagtttgctggaggtccactccagaccctgtttgcctgggtatcaccagcggaggctgcagaacagcaaatattgctgcctgatccttcctccggaagcttcgtcccagaggagcacccacctgtacaaggtgtctttgggctgctactgggaggtgtctcccagttagatgccaggcacaagtattgggtccgcaggttacccacacttctgtctgacttggctgcaaatcaaggttctcatcacccacaaccccttcaggaaggcactcatcagagaggggaagcatgtcaagatgaaactggtgaccagctgaatccaggagagattcgtgaaggtagcaggcatctttggggagagaatgattccattcacagtatcatttaaaagtgaaactgttgaattctagaagataaagttttgttttttaaagccgttggccaaaaagggagacaaacctcttgctttgtgactg

SEQ ID NO: 463820 - DNA, 6206 bp, Homo sapiens
ctttgagtaaccagcagctagtgaggacctaaggtacaatgagcatgcataagagaaaacagagaatcccctcttggggaccatccgttggctctgaagaaataaaaaagctacggaaacaactggaagaaatccaaaaagaaaatggccgatatattgaattactgaaagctaatgacatatgcttatatgatgacccgacaattcactggaaaggaaatcttaaaaactcaaaggtctctgttgttattcctagtgaccaggttcaaaaaaaaattattgtttattccaacgggaatcagcctggtggaaacagccagggaacagctgttcaggggataacttttaatgttagtcataatttacaaaagcagaccgccaatgtggtgccagtacagaggacttgcaatcttgtgactcctgtatctatttctggagtttacccttctgaaaacaagccatggcatcagaccacagttcctgcattggctaccaaccagcctgttcctctttgtcttcctgctgccatttctgctcagagtattctcgagcttcccacctctgaaagcgaatcaaatgtgcttggtgccactagtggctcactgattgctgtttcaattgaatctgagcctcaccaacatcattctttgcacacatgcctaaatgatcaaaattcttctgaaaataagaatggacaagagaaccccaaagtattgaagaaaatgaccccttgtgttacaaacatcccccacagctcctcagcaactgccactaaagtgcaccatggaaacaagtcctgcctgagcatacaggacttcagaggtgattttcaaaacacttttgttgtttcagttaccaccacagtctgctcgcagcctcccagaactgcaggtgattcttctccaatgagcattagtaagagtgcagacttgacaagtacagctacagtggtggcatcatctgcccctggagtagggaaggccaccattcctataagcactctttcgggaaaccctttggacaatggttggactctttcttgttctttgccttcttcaagtgttagtacttcagatttgaaaaacattaatagccttacacgaatctcttcagctggaaacacacagacaacgtggactactttgcaactggcaggaaacactattcagcccttaagccagacaccatcttctgctgtgactccagtattaaatgagtctggtactagccccaccacaagcaaccacagtagatatgtggctacagacatcaacttgaataattcctttccagcagatgggcagccagttgagcaagtagttgtaacattgccttcttgtccatctttacctatgcagccactaattgcccagccacaagttaaatctcagcctcccaaaaatatccttccactgaattcagcaatgcaagtgattcagatggctcagccagttgggtcagctgttaattcagctccaactaatcaaaatgttataattcttcagccacctagcaccaccccatgcccaacagtgatgagggcagaagtttccaaccaaacagtaggtcaacagatagtaatcatacaggctgctaatcagaatcctttgccactcctccctgctccacctcctggttctgttcgactccccatcaatggagccaatactgtaatagggtctaataattcagtgcaaaatgttccaacaccacagacttttggaggaaagcatcttgtccacatattaccaagaccttcatctttatcagcgtctaactcaacacaaactttttctgttaccatgtcaaaccaacagcctcaaaccatttctttaaatggacagctctttgctttgcagcctgtgatgtcttcatcaggaactacaaatcaaacccctatgcaaattattcaacccaccaccagcgaagatccaaataccaatgttgccctgaatacatttggtgctttggccagcctcaatcaaagcatatcacagatggctgggcaaagctgtgtacaattgtctattagccagcctgccaattctcaaactgctgcaaatagtcaaaccactacagctaactgtgtttcattaacaacaactgcagcacctcctgtgacaacagatagttcagccacactagctagtacttataatctagtgagtacttcctcaatgaacactgttgcttgtttgcctaacatgaaatctaaaaggttgaataagaagccaggtggcaggaaacacttagcagcaaacaagtcagcgtgtcccctgaattcagtcagagatgtgagcaagttagactgccccaacactgaaggctcagcagagccaccctgtaatgatggactgctagaaagcttccctgctgtgttaccatctgtctctgtgtctcaggcaaatagtgtgagtgtttctgcttcacattctttgggtgttctaagctctgaatcattaatacctgagtctgtatcgaaatctaagtcagcagaaaagtccagcccaccctcccaagaatctgtaacaagtgaacattttgcaatggccgcagcaaaatccaaagattctacccctaatctacaacaagagacatctcaggataaaccaccaagtagtttagcattatcagatgctgccaaaccctgcgcttcagccaatgtattgattccatctccaagtgatcctcacattttggtttctcaggttcctggtttgtcatctacaacaagcactacaagtactgactgtgtttctgaggtagaaatcattgctgaaccttgcagagttgagcaagattcatcagatacaatgcaaaccacaggtctcttaaaggggcaaggtttaactacattgctatctgatcttgctaaaaaaaaaaaccctcagaaatcatctctttctgatcagatggatcatcctgacttttcttcagaaaatcctaaaatagttgattcaagtgtgaatttacatcccaaacaggaactattactgatgaacaatgatgatagagatcctccacagcatcattcctgcctccctgatcaagaggttattaatggttctttgatcaacggtagacaggccgactctcccatgtcaaccagctctggcagtagtcgtagtttctcagttgcatccatgcttcctgaaacaacaagagaagatgtgaccagcaatgcaacaactaatacatgtgacagctgtacctttgattcaacttctcagccaccaagcatcaccagtttaagtgtgaataatcttatccatcagagcagcatcagccatcctctggccagctgtgcgggtttatccccaacttcagagcaaacaactgtgcctgcaacggttaatctgaccgtttcatctagctcctatggcagtcaacctcctggaccatctctgatgactgaatattcccaagaacagctaaatactatgactagtaccataccaaattcacagattcaagagccactcttaaagccaagccatgaaagccgtaaggattctgctaagcgtgctgtccaagatgaccttttactgtcttcagctaaacgtcaaaagcactgtcagccagcccccctcaggcttgaaagtatgtccctgatgagcagaactccagacaccatttctgaccaaactcaaatgatggtcagtcagatccctcctaattcttcaaactcagttgtgcctgttagcaacccagctcatggagatggccttacacgattatttccacctagtaacaactttgtgactcctgcattgaggcaaactgaagttcagtgtggttctcagccttcagttgctgaacagcagcaaacccaggcaagtcagcatctacaggccctgcagcagcatgttccagctcaaggtgtatctcaccttcatagtaaccatctctacataaagcagcagcagcagcagcagcagcagcagcagcagcaacagcaacaacaacaagcagggcagttaagagagaggcatcacttatatcaaatgcagcatcatgtacctcatgcagagagctctgtccactctcagccccataatgtccaccaacagaggactctgcaacaggaagttcagatgcagaaaaagaggaatcttgttcagggcacccagacctctcagctttccttacaaccaaagcaccatggaactgaccaatcccgatccaagactggccagccacatccccaccatcagcagatgcagcaacaaatgcagcaacactttggaagctcccagacagagaagagctgtgaaaacccttcaactagtcggaaccatcataaccatccccagaaccatctcaatcaagatattatgcaccaacagcaggatgttggaagcagacagcaaggttcaggggtttcatctgaacatgtatctggccataatccaatgcagaggcttttgacatcaagaggcttagagcagcaaatggtgtcccaaccaagtattgtgactagatcttcagacatgacctgtactccacacaggccagagagaaatagagtttcaagttattctgctgaggcactcattggaaagacatcttctaattcagagcagagaatggggatatcaattcagggttccagagtttcagatcagcttgaaatgagaagctatcttgatgttcccagaaataagagtttggctattcataatatgcagggtcgtgtggaccatactgtggcctcagatatccgcctttctgattgtcagacgtttaaaccaagtggagctagtcaacagccccagagtaattttgaagtacaatcttcaagaaacaatgaaataggtaaccctgtatcatcattgcggagtatgcagtcccaggcttttcgaattagtcaaaacactggccccccaccaattgaccgtcaaaagagattatcttacccaccagttcagagcatcccaacaggaaatggtattccatcaagggacagtgaaaatacttgtcaccaaagtttcatgcagagcttacttgcccctcacctcagtgatcaggtcattgggagccagaggtcactctcagaacatcagaggaatacacagtgtggtccatcctctgcaattgaatataattgtcccccaactcatgaaaatgtccatattagaagagagagtgagagtcagaatagggaaagttgtgacatgtcgttaggtgcaattaacaccaggaacagcaccttgaatattcctttttcaagttcctcttcctcaggagatattcaaggtcgaaacacaagccccaatgtttctgtacagaaatccaatcccatgaggattactgagagtcatgccaccaagggccacatgaaccctccagtcacaaccaacatgcatggggttgcaaggccagcgttgccacatccatctgtgtctcatggaaatggcgatcaaggccctgctgtacgtcaagctaattcttcagttccccagagatcaaggcatcccctgcaagacagcagtggttccaaaattcgtcagcctgaaaggaatcgttctggaaaccaaaggcaaagtactgtctttgatccaagtcttccccatcttcctctctctactggtggcagtatgattcttggacgtcaacaacctgccacagagaagagaggaagtattgttcgtttcatgcctgatagcccacaagtacctaatgataattcaggtcctgaccagcatacactatcacaaaattttggtttttcttttattcctgagggtggcatgaatccaccaataaatgctaatgcttctttcattccacaggttactcagcctagtgccactcgaactccagccctcatcccggtagatccgcaaaatactctgccctccttctatcctccatactctcctgctcatcctacactgtccaatgatatttcaatcccctattttcctaatcagatgttctcaaatcctagcacagagaagcgggatgattactcctttgccttgaaacatttattgggcccaccatgtatggatcagcatgtggtggataatggctacttcttagaaaaggataaagggatgatatcaaggagggaggagtacttcaaaagtattgttatattctattgcactgggtagcagatgctcagatgttgatctcatttatgcctgaagtctttgttctatgaatgtctaaaatatatcctaatgttttaaaaggtaaaa

SEQ ID NO: 463821 - DNA, 411 bp, Homo sapiens
ccagtatctgcatctgacatggcttccctacattcagaagataactgaaaactgattatacagacacacacacacaatccttctcttcatgtacatgtctggcacatgcacgcacaaatacatttgtaatctcctcccagacctgttgggtttgctcaaccaagttttcctcttctcccagatatgccaccaatgcacatgaccaactctcacttatccaattttaatatgacatctttgtttccagaaatagccacagcgcttcctgatggctcagcaatgtcacctttgcttacaatagcaaattcctctgcctctgactcttccaagcagtcctcaaacagacctgcccataacataagccatattctaggtcatgattgcagttcagctgtttaaatactgataaac

SEQ ID NO: 463822 - DNA, 5874 bp, Homo sapiens
ctttgagtaaccagcagctagtgaggacctaaggtacaatgagcatgcataagagaaaacagagaatcccctcttggggaccatccgttggctctgaagaaataaaaaagctacggaaacaactggaagaaatccaaaaagaaaatggccgatatattgaattactgaaagctaatgacatatgcttatatgatgacccgacaattcactggaaaggaaatcttaaaaactcaaaggtctctgttgttattcctagtgaccaggttcaaaaaaaaattattgtttattccaacgggaatcagcctggtggaaacagccagggaacagctgttcaggggataacttttaatgttagtcataatttacaaaagcagaccgccaatgtggtgccagtacagaggacttgcaatcttgtgactcctgtatctatttctggagtttacccttctgaaaacaagccatggcatcagaccacagttcctgcattggctaccaaccagcctgttcctctttgtcttcctgctgccatttctgctcagagtattctcgagcttcccacctctgaaagcgaatcaaatgtgcttggtgccactagtggctcactgattgctgtttcaattgaatctgagcctcaccaacatcattctttgcacacatgcctaaatgatcaaaattcttctgaaaataagaatggacaagagaaccccaaagtattgaagaaaatgaccccttgtgttacaaacatcccccacagctcctcagcaactgccactaaagtgcaccatggaaacaagtcctgcctgagcatacaggacttcagaggtgattttcaaaacacttttgttgtttcagttaccaccacagtctgctcgcagcctcccagaactgcaggtgattcttctccaatgagcattagtaagagtgcagacttgacaagtacagctacagtggtggcatcatctgcccctggagtagggaaggccaccattcctataagcactctttcgggaaaccctttggacaatggttggactctttcttgttctttgccttcttcaagtgttagtacttcagatttgaaaaacattaatagccttacacgaatctcttcagctggaaacacacagacaacgtggactactttgcaactggcaggaaacactattcagcccttaagccagacaccatcttctgctgtgactccagtattaaatgagtctggtactagccccaccacaagcaaccacagtagatatgtggctacagacatcaacttgaataattcctttccagcagatgggcagccagttgagcaagtagttgtaacattgccttcttgtccatctttacctatgcagccactaattgcccagccacaagttaaatctcagcctcccaaaaatatccttccactgaattcagcaatgcaagtgattcagatggctcagccagttgggtcagctgttaattcagctccaactaatcaaaatgttataattcttcagccacctagcaccaccccatgcccaacagtgatgagggcagaagtttccaaccaaacagtaggtcaacagatagtaatcatacaggctgctaatcagaatcctttgccactcctccctgctccacctcctggttctgttcgactccccatcaatggagccaatactgtaatagggtctaataattcagtgcaaaatgttccaacaccacagacttttggaggaaagcatcttgtccacatattaccaagaccttcatctttatcagcgtctaactcaacacaaactttttctgttaccatgtcaaaccaacagcctcaaaccatttctttaaatggacagctctttgctttgcagcctgtgatgtcttcatcaggaactacaaatcaaacccctatgcaaattattcaacccaccaccagcgaagatccaaataccaatgttgccctgaatacatttggtgctttggccagcctcaatcaaagcatatcacagatggctgggcaaagctgtgtacaattgtctattagccagcctgccaattctcaaactgctgcaaatagtcaaaccactacagctaactgtgtttcattaacaacaactgcagcacctcctgtgacaacagatagttcagccacactagctagtacttataatctagtgagtacttcctcaatgaacactgttgcttgtttgcctaacatgaaatctaaaaggttgaataagaagccaggtggcaggaaacacttagcagcaaacaagtcagcgtgtcccctgaattcagtcagagatgtgagcaagttagactgccccaacactgaaggctcagcagagccaccctgtaatgatggactgctagaaagcttccctgctgtgttaccatctgtctctgtgtctcaggcaaatagtgtgagtgtttctgcttcacattctttgggtgttctaagctctgaatcattaatacctgagtctgtatcgaaatctaagtcagcagaaaagtccagcccaccctcccaagaatctgtaacaagtgaacattttgcaatggccgcagcaaaatccaaagattctacccctaatctacaacaagagacatctcaggataaaccaccaagtagtttagcattatcagatgctgccaaaccctgcgcttcagccaatgtattgattccatctccaagtgatcctcacattttggtttctcaggttcctggtttgtcatctacaacaagcactacaagtactgactgtgtttctgaggtagaaatcattgctgaaccttgcagagttgagcaagattcatcagatacaatgcaaaccacaggtctcttaaaggggcaaggtttaactacattgctatctgatcttgctaaaaaaaaaaaccctcagaaatcatctctttctgatcagatggatcatcctgacttttcttcagaaaatcctaaaatagttgattcaagtgtgaatttacatcccaaacaggaactattactgatgaacaatgatgatagagatcctccacagcatcattcctgcctccctgatcaagaggttattaatggttctttgatcaacggtagacaggccgactctcccatgtcaaccagctctggcagtagtcgtagtttctcagttgcatccatgcttcctgaaacaacaagagaagatgtgaccagcaatgcaacaactaatacatgtgacagctgtacctttgattcaacttctcagccaccaagcatcaccagtttaagtgtgaataatcttatccatcagagcagcatcagccatcctctggccagctgtgcgggtttatccccaacttcagagcaaacaactgtgcctgcaacggttaatctgaccgtttcatctagctcctatggcagtcaacctcctggaccatctctgatgactgaatattcccaagaacagctaaatactatgactagtaccataccaaattcacagattcaagagccactcttaaagccaagccatgaaagccgtaaggattctgctaagcgtgctgtccaagatgaccttttactgtcttcagctaaacgtcaaaagcactgtcagccagcccccctcaggcttgaaagtatgtccctgatgagcagaactccagacaccatttctgaccaaactcaaatgatggtcagtcagatccctcctaattcttcaaactcagttgtgcctgttagcaacccagctcatggagatggccttacacgattatttccacctagtaacaactttgtgactcctgcattgaggcaaactgaagttcagtgtggttctcagccttcagttgctgaacagcagcaaacccaggcaagtcagcatctacaggccctgcagcagcatgttccagctcaaggtgtatctcaccttcatagtaaccatctctacataaagcagcagcagcagcagcagcagcagcagcagcagcaacagcaacaacaacaagcagggcagttaagagagaggcatcacttatatcaaatgcagcatcatgtacctcatgcagagagctctgtccactctcagccccataatgtccaccaacagaggactctgcaacaggaagttcagatgcagaaaaagaggaatcttgttcagggcacccagacctctcagctttccttacaaccaaagcaccatggaactgaccaatcccgatccaagactggccagccacatccccaccatcagcagatgcagcaacaaatgcagcaacactttggaagctcccagacagagaagagctgtgaaaacccttcaactagtcggaaccatcataaccatccccagaaccatctcaatcaagatattatgcaccaacagcaggatgttggaagcagacagcaaggttcaggggtttcatctgaacatgtatctggccataatccaatgcagaggcttttgacatcaagaggcttagagcagcaaatggtgtcccaaccaagtattgtgactagatcttcagacatgacctgtactccacacaggccagagagaaatagagtttcaagttattctgctgaggcactcattggaaagacatcttctaattcagagcagagaatggggatatcaattcagggttccagagtttcagatcagcttgaaatgagaagctatcttgatgttcccagaaataagagtttggctattcataatatgcagggtcgtgtggaccatactgtggcctcagatatccgcctttctgattgtcagacgtttaaaccaagtggagctagtcaacagccccagagtaattttgaagtacaatcttcaagaaacaatgaaataggtaaccctgtatcatcattgcggagtatgcagtcccaggcttttcgaattagtcaaaacactggccccccaccaattgaccgtcaaaagagattatcttacccaccagttcagagcatcccaacaggaaatggtattccatcaagggacagtgaaaatacttgtcaccaaagtttcatgcagagcttacttgcccctcacctcagtgatcaggtcattgggagccagaggtcactctcagaacatcagaggaatacacagtgtggtccatcctctgcaattgaatataattgtcccccaactcatgaaaatgtccatattagaagagagagtgagagtcagaatagggaaagttgtgacatgtcgttaggtgcaattaacaccaggaacagcaccttgaatattcctttttcaagttcctcttcctcaggagatattcaaggtcgaaacacaagccccaatgtttctgtacagaaatccaatcccatgaggattactgagagtcatgccaccaagggccacatgaaccctccagtcacaaccaacatgcatggggttgcaaggccagcgttgccacatccatctgtgtctcatggaaatggcgatcaaggccctgctgtacgtcaagctaattcttcagttccccagagatcaaggcatcccctgcaagacagcagtggttccaaaattcgtcagcctgaaaggaatcgttctggaaaccaaaggcaaagtactgtctttgatccaagtcttccccatcttcctctctctactggtggcagtatgattcttggacgtcaacaacctgccacagagaagagaggaagtattgttcgtttcatgcctgatagcccacaagtacctaatgataattcaggtcctgaccagcatacactatcacaaaattttggtttttcttttattcctgagggtggcatgaatccaccaataaatgctaatgcttctttcattccacaggttactcagcctagtgccactcgaactccagcctgggcaacagagccagactccatctattaaaatttgaaaacttaaaaaa

SEQ ID NO: 463823 - DNA, 6284 bp, Homo sapiens
ctttgagtaaccagcagctagtgaggacctaaggtacaatgagcatgcataagagaaaacagagaatcccctcttggggaccatccgttggctctgaagaaataaaaaagctacggaaacaactggaagaaatccaaaaagaaaatggccgatatattgaattactgaaagctaatgacatatgcttatatgatgacccgacaattcactggaaaggaaatcttaaaaactcaaaggtctctgttgttattcctagtgaccaggttcaaaaaaaaattattgtttattccaacgggaatcagcctggtggaaacagccagggaacagctgttcaggggataacttttaatgttagtcataatttacaaaagcagaccgccaatgtggtgccagtacagaggacttgcaatcttgtgactcctgtatctatttctggagtttacccttctgaaaacaagccatggcatcagaccacagttcctgcattggctaccaaccagcctgttcctctttgtcttcctgctgccatttctgctcagagtattctcgagcttcccacctctgaaagcgaatcaaatgtgcttggtgccactagtggctcactgattgctgtttcaattgaatctgagcctcaccaacatcattctttgcacacatgcctaaatgatcaaaattcttctgaaaataagaatggacaagagaaccccaaagtattgaagaaaatgaccccttgtgttacaaacatcccccacagctcctcagcaactgccactaaagtgcaccatggaaacaagtcctgcctgagcatacaggacttcagaggtgattttcaaaacacttttgttgtttcagttaccaccacagtctgctcgcagcctcccagaactgcaggtgattcttctccaatgagcattagtaagagtgcagacttgacaagtacagctacagtggtggcatcatctgcccctggagtagggaaggccaccattcctataagcactctttcgggaaaccctttggacaatggttggactctttcttgttctttgccttcttcaagtgttagtacttcagatttgaaaaacattaatagccttacacgaatctcttcagctggaaacacacagacaacgtggactactttgcaactggcaggaaacactattcagcccttaagccagacaccatcttctgctgtgactccagtattaaatgagtctggtactagccccaccacaagcaaccacagtagatatgtggctacagacatcaacttgaataattcctttccagcagatgggcagccagttgagcaagtagttgtaacattgccttcttgtccatctttacctatgcagccactaattgcccagccacaagttaaatctcagcctcccaaaaatatccttccactgaattcagcaatgcaagtgattcagatggctcagccagttgggtcagctgttaattcagctccaactaatcaaaatgttataattcttcagccacctagcaccaccccatgcccaacagtgatgagggcagaagtttccaaccaaacagtaggtcaacagatagtaatcatacaggctgctaatcagaatcctttgccactcctccctgctccacctcctggttctgttcgactccccatcaatggagccaatactgtaatagggtctaataattcagtgcaaaatgttccaacaccacagacttttggaggaaagcatcttgtccacatattaccaagaccttcatctttatcagcgtctaactcaacacaaactttttctgttaccatgtcaaaccaacagcctcaaaccatttctttaaatggacagctctttgctttgcagcctgtgatgtcttcatcaggaactacaaatcaaacccctatgcaaattattcaacccaccaccagcgaagatccaaataccaatgttgccctgaatacatttggtgctttggccagcctcaatcaaagcatatcacagatggctgggcaaagctgtgtacaattgtctattagccagcctgccaattctcaaactgctgcaaatagtcaaaccactacagctaactgtgtttcattaacaacaactgcagcacctcctgtgacaacagatagttcagccacactagctagtacttataatctagtgagtacttcctcaatgaacactgttgcttgtttgcctaacatgaaatctaaaaggttgaataagaagccaggtggcaggaaacacttagcagcaaacaagtcagcgtgtcccctgaattcagtcagagatgtgagcaagttagactgccccaacactgaaggctcagcagagccaccctgtaatgatggactgctagaaagcttccctgctgtgttaccatctgtctctgtgtctcaggcaaatagtgtgagtgtttctgcttcacattctttgggtgttctaagctctgaatcattaatacctgagtctgtatcgaaatctaagtcagcagaaaagtccagcccaccctcccaagaatctgtaacaagtgaacattttgcaatggccgcagcaaaatccaaagattctacccctaatctacaacaagagacatctcaggataaaccaccaagtagtttagcattatcagatgctgccaaaccctgcgcttcagccaatgtattgattccatctccaagtgatcctcacattttggtttctcaggttcctggtttgtcatctacaacaagcactacaagtactgactgtgtttctgaggtagaaatcattgctgaaccttgcagagttgagcaagattcatcagatacaatgcaaaccacaggtctcttaaaggggcaaggtttaactacattgctatctgatcttgctaaaaaaaaaaaccctcagaaatcatctctttctgatcagatggatcatcctgacttttcttcagaaaatcctaaaatagttgattcaagtgtgaatttacatcccaaacaggaactattactgatgaacaatgatgatagagatcctccacagcatcattcctgcctccctgatcaagaggttattaatggttctttgatcaacggtagacaggccgactctcccatgtcaaccagctctggcagtagtcgtagtttctcagttgcatccatgcttcctgaaacaacaagagaagatgtgaccagcaatgcaacaactaatacatgtgacagctgtacctttgattcaacttctcagccaccaagcatcaccagtttaagtgtgaataatcttatccatcagagcagcatcagccatcctctggccagctgtgcgggtttatccccaacttcagagcaaacaactgtgcctgcaacggttaatctgaccgtttcatctagctcctatggcagtcaacctcctggaccatctctgatgactgaatattcccaagaacagctaaatactatgactagtaccataccaaattcacagattcaagagccactcttaaagccaagccatgaaagccgtaaggattctgctaagcgtgctgtccaagatgaccttttactgtcttcagctaaacgtcaaaagcactgtcagccagcccccctcaggcttgaaagtatgtccctgatgagcagaactccagacaccatttctgaccaaactcaaatgatggtcagtcagatccctcctaattcttcaaactcagttgtgcctgttagcaacccagctcatggagatggccttacacgattatttccacctagtaacaactttgtgactcctgcattgaggcaaactgaagttcagtgtggttctcagccttcagttgctgaacagcagcaaacccaggcaagtcagcatctacaggccctgcagcagcatgttccagctcaaggtgtatctcaccttcatagtaaccatctctacataaagcagcagcagcagcagcagcagcagcagcagcagcaacagcaacaacaacaagcagggcagttaagagagaggcatcacttatatcaaatgcagcatcatgtacctcatgcagagagctctgtccactctcagccccataatgtccaccaacagaggactctgcaacaggaagttcagatgcagaaaaagaggaatcttgttcagggcacccagacctctcagctttccttacaaccaaagcaccatggaactgaccaatcccgatccaagactggccagccacatccccaccatcagcagatgcagcaacaaatgcagcaacactttggaagctcccagacagagaagagctgtgaaaacccttcaactagtcggaaccatcataaccatccccagaaccatctcaatcaagatattatgcaccaacagcaggatgttggaagcagacagcaaggttcaggggtttcatctgaacatgtatctggccataatccaatgcagaggcttttgacatcaagaggcttagagcagcaaatggtgtcccaaccaagtattgtgactagatcttcagacatgacctgtactccacacaggccagagagaaatagagtttcaagttattctgctgaggcactcattggaaagacatcttctaattcagagcagagaatggggatatcaattcagggttccagagtttcagatcagcttgaaatgagaagctatcttgatgttcccagaaataagagtttggctattcataatatgcagggtcgtgtggaccatactgtggcctcagatatccgcctttctgattgtcagacgtttaaaccaagtggagctagtcaacagccccagagtaattttgaagtacaatcttcaagaaacaatgaaataggtaaccctgtatcatcattgcggagtatgcagtcccaggcttttcgaattagtcaaaacactggccccccaccaattgaccgtcaaaagagattatcttacccaccagttcagagcatcccaacaggaaatggtattccatcaagggacagtgaaaatacttgtcaccaaagtttcatgcagagcttacttgcccctcacctcagtgatcaggtcattgggagccagaggtcactctcagaacatcagaggaatacacagtgtggtccatcctctgcaattgaatataattgtcccccaactcatgaaaatgtccatattagaagagagagtgagagtcagaatagggaaagttgtgacatgtcgttaggtgcaattaacaccaggaacagcaccttgaatattcctttttcaagttcctcttcctcaggagatattcaaggtcgaaacacaagccccaatgtttctgtacagaaatccaatcccatgaggattactgagagtcatgccaccaagggccacatgaaccctccagtcacaaccaacatgcatggggttgcaaggccagcgttgccacatccatctgtgtctcatggaaatggcgatcaaggccctgctgtacgtcaagctaattcttcagttccccagagatcaaggcatcccctgcaagacagcagtggttccaaaattcgtcagcctgaaaggaatcgttctggaaaccaaaggcaaagtactgtctttgatccaagtcttccccatcttcctctctctactggtggcagtatgattcttggacgtcaacaacctgccacagagaagagaggaagtattgttcgtttcatgcctgatagcccacaagtacctaatgataattcaggtcctgaccagcatacactatcacaaaattttggtttttcttttattcctgagggtggcatgaatccaccaataaatgctaatgcttctttcattccacaggttactcagcctagtgccactcgaactccagccctcatcccggtagatccgcaaaatactctgccctccttctatcctccatactctcctgctcatcctacactgtccaatgatatttcaatcccctattttcctaatcagatgttctcaaatcctagcacagagaaggtaaacagtggaagtttaaataaccgatttggatcaattttatctcctcccagacctgttgggtttgctcaaccaagttttcctcttctcccagatatgccaccaatgcacatgaccaactctcacttatccaattttaatatgacatctttgtttccagaaatagccacagcgcttcctgatggctcagcaatgtcacctttgcttacaatagcaaattcctctgcctctgactcttccaagcagtcctcaaacagacctgcccataacataagccatattctaggtcatgattgcagttcagctgtttaaatactgataaac

SEQ ID NO: 463824 - DNA, 2082 bp, Homo sapiens
gaagaacctggcaaggccggaagagccgtagttaatgggtcatgtgtgcagtacccgcccgactttgcggtcggtcctttcacagacctccctttatcctcccagaagtttttcttggaaagcttcctggccacttgccctgagcgctggcttgctgtttagcactttcaaatactagtgcgaatgttgcagcgggacagtgtgagccgaggacattggatttggcaacagcaggacctgatatgaccttaatttagatgtagaggttcacgtttcaatggtgggtctgaaggcagactgagggaggtcaaggaaaggttccagaggagacctggcctccgcggggaactcagggggccaaggaggaagggcactgaggtggtggagaagagtcaggaccgccagggtcacggtgtcaagggcggcgcctctgtggcatccagggatcagtcactcggcttcgcttccttgcctttttcctgaagacagaaaagaaggaaaccatgcattgctatctaattccaggcagcgcccgttctgttggtgaggagaccgaggcccaaggcacagggaaagaccccagaagagggcctctcttggaacaggcctggggcccttcactgatctgtggctccaccacccccaccgtgatcggcaggtaccagggccacgtccccactgtggccttctcctttggcgctccctacggcaccaccaccctcaagtacttccaggaccaccgcaacagagccatggagaagagccacactcccttcagccaaggcggccatttccccaccatcttctccaccaaccccaacctcctgctgatggagcgcgccagcacccgggaccgctggctgcacaagcccagctacactcgcttcaacctggacagccatcgctccacagagcttacgaatttctaccagatggtccagcagcatcggaagtactatcaagacaagacgggcacagtgcctcgagtcccctactttgcgatgcccgtgagggagccggaacggtaccccctccccaccgtcctgtgagtgcctgccctcccttcatctacgcagtcaagaaacgcacccatggggcacctgctctcggccaggcatgcacagcacacagactgagaaatgagttgaggatcttgccctaaaacgtgcagtgcagagagtgatggttacagagcaagggggtcagggcattggcagcctcaggggggatggtggtagcctgaatgggcgaatcaggaagagtgctttcccggccagatgcactgggagtttgggagaagctccgtaagcttagtgggcctgaatctgcggactgatgccccgcctgcaaaggcagcctggcagctacactagtcctaacgtgggcgccgatgcagagcgcagtaaggagctgctgccctctggtggatacagagggcactacaccgagcaggaatctcccccggtcccgttcacatttggaaaatgttctcctaaggactttctgtccatctaactaaataggaaagttccttgcctcctgcccctctctgcttttatctaggagagctcctttctccagggaaggcccactctgccctgaaagatgacttgggtactgtggtttctgtgctctctccttcctgaagcgcaggcagggggatcattggctcacacgaggtgtcctggagtggggtagggtggtgggtggtgcctggcctgggaggtcagtggatagagcttgggatttagctccatgccaaccactcccggcttgcctcagagtcctaagattcaccatcatccttactgataaaacagcatctgttttcataagtttaatggtttttaaagaaacaggcttcactgcatctaaaagttcctttttgcaaagccctgacttggcgtcgttttgtccacacgatcacttgtgagggaagaggtgttattatccccactttactgataaagatattgaggctcagagaaggtgagaaagttgcccaagcttacatagttgggaagtaacacagccagaatttgaattcaggtctttctgactcccaagccctggtttttccac

SEQ ID NO: 463825 - DNA, 640 bp, Homo sapiens
agaggatccccccgcgcagtgcatttcttagaatatttgttgtgtgtttactccttgtccagagcttcacatgcattactgcatttattcctcaagtcaaagctaagagggggataccaccactgggccattcttaaatatgcacacttctagcaggagttaggaccagagtccgtcccaggtctgtctgacatctgtgtcctcactcttaaccactgtgccattatgtaaatacaggttattcccaccccaagtccagggggacttatcaggtgttaaactgacgagtagccggcaggtcagcttgagctggaaagtgggcacgtggggctgtgggtgggcacgcaccaccttccttccctggcacactgcataacaccagtcccatcctcacccctaggcctcctctgtgcccaaagaagaagtggcaccttttaagactagcccccgagaacctgaagacctaccagaccttcccatcagggaagagggtctctccacaggagcggaaaaagagagactgctactttgagttcagagcatgagacttttagttcagagcagagcctgatgcctgagatcctgggtcgtgaccagcctggcttgcttggaataaaatctttagccatgaaaaaaaaac

SEQ ID NO: 463826 - DNA, 1362 bp, Homo sapiens
gaagaacctggcaaggccggaagagccgtagttaatgggtcatgtgtgcagtacccgcccgactttgcggtcggtcctttcacagacctccctttatcctcccagaagtttttcttggaaagcttcctggccacttgccctgagcgctggcttgctgtttagcactttcaaatactagtgcgaatgttgcagcgggacagtgtgagccgaggacattggatttggcaacagcaggacctgatatgaccttaatttagatgtagaggttcacgtttcaatggtgggtctgaaggcagactgagggaggtcaaggaaaggttccagaggagacctggcctccgcggggaactcagggggccaaggaggaagggcactgaggtggtggagaagagtcaggaccgccagggtcacggtgtcaagggcggcgcctctgtggcatccagggatcagtcactcggcttcgcttccttgcctttttcctgaagacagaaaagaaggaaaccatgcattgctatctaattccaggcagcgcccgttctgttggtgaggagaccgaggcccaaggcacagggaaagaccccagaagagggcctctcttggaacaggcctggggcccttcactgatctgtggctccaccacccccaccgtgatcggcaggtaccagggccacgtccccactgtggccttctcctttggcgctccctacggcaccaccaccctcaagtacttccaggaccaccgcaacagagccatggagaagagccacactcccttcagccaaggcggccatttccccaccatcttctccaccaaccccaacctcctgctgatggagcgcgccagcacccgggaccgctggctgcacaagcccagctacactcgcttcaacctggacagccatcgctccacagagcttacgaatttctaccagatggtccagcagcatcggaagtactatcaagacaagacgggcacagtgcctcgagtcccctactttgcgatgcccgtgagggagccggaacggtaccccctccccaccgtcctgttgcctggccacttgcactgctgctgacagtttcacaacgaacgcaaagggccaaccaggtggttgggagaagagggcctcctctgtgcccaaagaagaagtggcaccttttaagactagcccccgagaacctgaagacctaccagaccttcccatcagggaagagggtctctccacaggagcggaaaaagagagactgctactttgagttcagagcatgagacttttagttcagagcagagcctgatgcctgagatcctgggtcgtgaccagcctggcttgcttggaataaaatctttagccatgaaaaaaaaac

SEQ ID NO: 463827 - DNA, 1802 bp, Homo sapiens
gaagaacctggcaaggccggaagagccgtagttaatgggtcatgtgtgcagtacccgcccgactttgcggtcggtcctttcacagacctccctttatcctcccagaagtttttcttggaaagcttcctggccacttgccctgagcgctggcttgctgtttagcactttcaaatactagtgcgaatgttgcagcgggacagtgtgagccgaggacattggatttggcaacagcaggacctgatatgaccttaatttagatgtagaggttcacgtttcaatggtgggtctgaaggcagactgagggaggtcaaggaaaggttccagaggagacctggcctccgcggggaactcagggggccaaggaggaagggcactgaggtggtggagaagagtcaggaccgccagggtcacggtgtcaagggcggcgcctctgtggcatccagggatcagtcactcggcttcgcttccttgcctttttcctgaagacagaaaagaaggaaaccatgcattgctatctaattccaggcagcgcccgttctgttggtgaggagaccgaggcccaaggcacagggaaagaccccagaagagggcctctcttggaacaggcctggggcccttcactgatctgtggctccaccacccccaccgtgatcggcaggtaccagggccacgtccccactgtggccttctcctttggcgctccctacggcaccaccaccctcaagtacttccaggaccaccgcaacagagccatggagaagagccacactcccttcagccaaggcggccatttccccaccatcttctccaccaaccccaacctcctgctgatggagcgcgccagcacccgggaccgctggctgcacaagcccagctacactcgcttcaacctggacagccatcgctccacagagcttacgaatttctaccagatggtccagcagcatcggaagtactatcaagacaagacgggcacagtgcctcgagtcccctactttgcgatgcccgtgagggagccggaacggtaccccctccccaccgtcctgttgcctggccacttgcactgctgctgacagtttcacaacgaacgcaaagggccaaccaggtggttgggagaagagggtcagtgacaggcctggggcaagcccctccctcccggaatcccctccatcagcaccatcaccatttcttagaatatttgttgtgtgtttactccttgtccagagcttcacatgcattactgcatttattcctcaagtcaaagctaagagggggataccaccactgggccattcttaaatatgcacacttctagcaggagttaggaccagagtccgtcccaggtctgtctgacatctgtgtcctcactcttaaccactgtgccattatgtaaatacaggttattcccaccccaagtccagggggacttatcaggtgttaaactgacgagtagccggcaggtcagcttgagctggaaagtgggcacgtggggctgtgggtgggcacgcaccaccttccttccctggcacactgcataacaccagtcccatcctcacccctaggcctcctctgtgcccaaagaagaagtggcaccttttaagactagcccccgagaacctgaagacctaccagaccttcccatcagggaagagggtctctccacaggagcggaaaaagagagactgctactttgagttcagagcatgagacttttagttcagagcagagcctgatgcctgagatcctgggtcgtgaccagcctggcttgcttggaataaaatctttagccatgaaaaaaaaac

SEQ ID NO: 463828 - DNA, 1285 bp, Homo sapiens
gaagaacctggcaaggccggaagagccgtagttaatgggtcatgtgtgcagtacccgcccgactttgcggtcggtcctttcacagacctccctttatcctcccagaagtttttcttggaaagcttcctggccacttgccctgagcgctggcttgctgtttagcactttcaaatactagtgcgaatgttgcagcgggacagtgtgagccgaggacattggatttggcaacagcaggacctgatatgaccttaatttagatgtagaggttcacgtttcaatggtgggtctgaaggcagactgagggaggtcaaggaaaggttccagaggagacctggcctccgcggggaactcagggggccaaggaggaagggcactgaggtggtggagaagagtcaggaccgccagggtcacggtgtcaagggcggcgcctctgtggcatccagggatcagtcactcggcttcgcttccttgcctttttcctgaagacagaaaagaaggaaaccatgcattgctatctaattccaggcagcgcccgttctgttggtgaggagaccgaggcccaaggcacagggaaagaccccagaagagggcctctcttggaacaggcctggggcccttcactgatctgtggctccaccacccccaccgtgatcggcaggtaccagggccacgtccccactgtggccttctcctttggcgctccctacggcaccaccaccctcaagtacttccaggaccaccgcaacagagccatggagaagagccacactcccttcagccaaggcggccatttccccaccatcttctccaccaaccccaacctcctgctgatggagcgcgccagcacccgggaccgctggctgcacaagcccagctacactcgcttcaacctggacagccatcgctccacagagcttacgaatttctaccagatggtccagcagcatcggaagtactatcaagacaagacgggcacagtgcctcgagtcccctactttgcgatgcccgtgagggagccggaacggtaccccctccccaccgtcctgcctcctctgtgcccaaagaagaagtggcaccttttaagactagcccccgagaacctgaagacctaccagaccttcccatcagggaagagggtctctccacaggagcggaaaaagagagactgctactttgagttcagagcatgagacttttagttcagagcagagcctgatgcctgagatcctgggtcgtgaccagcctggcttgcttggaataaaatctttagccatgaaaaaaaaac

SEQ ID NO: 463829 - DNA, 582 bp, Homo sapiens
gagtgttatggtgaaaggggagagaaaatggtatggaaggaagggtcagcaacaaatgaggaatctaggctataatggtgttcaaatttttttttccatttcagggacaccctctttttaaaggacattcaattcaaatgtatcttctctggttaaagtatggtgaagtctgtcctgtgggcactccccattgactcctagcagctcttgagccccatcttcaggatccgtactttgatagtcactgacaattagctttgaaaatctatagttccaatcctgtgaaatgagaagaatgttgaagctataaaggaggtctttgcctgcattcagattctgacaccaaagactcctctgattatactgaagtatgtaagaaaaccttctcttgaaatcaaggaccatttctcttcatcttatcttgagctacataccaaatatgagtacacatagttaggattcaataaataatttaagatacttgtgaaaaccttgctctgactggttctatttttacattcagagaggaaagcatcctgtattctccctataaacaaatctaggagaatagggtcatggaca

SEQ ID NO: 463830 - DNA, 1061 bp, Homo sapiens
cattacttcatcaagtcatgaatgagagaggccagtaggatttttttaaaggaggatgaaggaaggtttgggaaacaaggaacaaagagcttcataagtgttgtcaggttctgcagccttttcataggatttagccaggagcaagtcttccagctcttggaaagtgtgaatgcaggctgtagtgtttactctggttccccatggcagtctgtgctggcgcaggaaaggaaaggaaggaggggtgaagaggagaggttggctagtgttaaagggagagcttttccacagggttctatggttgctatagtaacagcttcttttgtttgtacatattcagaacagctgcttctttttggttgctggtggcagggatattatggaggcaacagacgcatgagagtgaggtatttatctgagggcgattgaagtcaccagcttaacagtagtggaaagaccttaagccagagaactccaggttcaagaaccaccacctgcaaacttggcaaatttggacaaatgtctctctgagtttcattgtcttcatccacaaataaagcaagattacttcgcctacagaattgcgggacaccctctttttaaaggacattcaattcaaatgtatcttctctggttaaagtatggtgaagtctgtcctgtgggcactccccattgactcctagcagctcttgagccccatcttcaggatccgtactttgatagtcactgacaattagctttgaaaatctatagttccaatcctgtgaaatgagaagaatgttgaagctataaaggaggtctttgcctgcattcagattctgacaccaaagactcctctgattatactgaagtatgtaagaaaaccttctcttgaaatcaaggaccatttctcttcatcttatcttgagctacataccaaatatgagtacacatagttaggattcaataaataatttaagatacttgtgaaaaccttgctctgactggttctatttttacattcagagaggaaagcatcctgtattctccctataaacaaatctaggagaatagggtcatggaca

SEQ ID NO: 463831 - DNA, 1229 bp, Homo sapiens
cattacttcatcaagtcatgaatgagagaggccagtaggatttttttaaaggaggatgaaggaaggtttgggaaacaaggaacaaagagcttcataagtgttgtcaggttctgcagccttttcataggatttagccaggagcaagtcttccagctcttggaaagtgtgaatgcaggctgtagtgtttactctggttccccatggcagtctgtgctggcgcaggaaaggaaaggaaggaggggtgaagaggagaggttggctagtgttaaagggagagcttttccacagggttctatggttgctatagtaacagcttcttttgtttgtacatattcagaacagctgcttctttttggttgctggtggcagggatattatggaggcaacagacgcatgagagtgaggtatttatctgagggcgattgaagtcaccagcttaacagtagtggaaagaccttaagccagagaactccaggttcaagaaccaccacctgcaaacttggcaaatttggacaaatgtctctctgagtttcattgtcttcatccacaaataaagcaagattacttcgcctacagaattgcgaaattatgaccagaccatgagggtatgaaggatgaggaaaagggagcagtcatggagctgttttggagggagtcataattccttagacctctgacaactggaactctcaatctgccagtgaaagctgacatgagcccaataaggatggtcttttctattcaaagatagggacaccctctttttaaaggacattcaattcaaatgtatcttctctggttaaagtatggtgaagtctgtcctgtgggcactccccattgactcctagcagctcttgagccccatcttcaggatccgtactttgatagtcactgacaattagctttgaaaatctatagttccaatcctgtgaaatgagaagaatgttgaagctataaaggaggtctttgcctgcattcagattctgacaccaaagactcctctgattatactgaagtatgtaagaaaaccttctcttgaaatcaaggaccatttctcttcatcttatcttgagctacataccaaatatgagtacacatagttaggattcaataaataatttaagatacttgtgaaaaccttgctctgactggttctatttttacattcagagaggaaagcatcctgtattctccctataaacaaatctaggagaatagggtcatggaca

SEQ ID NO: 463832 - DNA, 994 bp, Homo sapiens
cattacttcatcaagtcatgaatgagagaggccagtaggatttttttaaaggaggatgaaggaaggtttgggaaacaaggaacaaagagcttcataagtgttgtcaggttctgcagccttttcataggatttagccaggagcaagtcttccagctcttggaaagtgtgaatgcaggctgtagtgtttactctggttccccatggcagtctgtgctggcgcaggaaaggaaaggaaggaggggtgaagaggagaggttggctagtgttaaagggagagcttttccacagggttctatggttgctatagtaacagcttcttttgtttgtacatattcagaacagctgcttctttttggttgctggtggcagggatattatggaggcaacagacgcatgagagtgaggtatttatctgagggcgattgaagtcaccagcttaacagtagtggaaagaccttaagccagagaactccaggttcaagaaccaccacctgcaaacttggcaaatttggacaaatgtctctctgagtttcattgtcttcatccacaaataaagcaagattacttcgcctacagaattgcgaaattatgaccagaccatgagggtatgaaggatgaggaaaagggagcagtcatggagctgttttggagggagtcataattccttagacctctgacaactggaactctcaatctgccagtgaaagctgacatgagcccaataaggatggtcttttctattcaaagataggtccgtactatttccaatttagttttaagaatcaacttaaaatgttgttaactatacatatatttcacttttgaaagaaaatattagcttgtcatcaaacaggataaaccaagagacatcagtctttttgactgatatgaatcacatttagctaaatacaccagttagcaatatctgtccttaagattgacagtcttaaatataacagtttaataaagctcttacttttctatttgtttcttt

SEQ ID NO: 463833 - DNA, 1300 bp, Homo sapiens
gtgacgtttcacaattttgtgctttatattagtgatactgctgtttaaaatggcccccaagcgtaatgctgaagggctgtctactgtttctacatgcaagaaggctgcaatgtgccttatagagaaaggatgtgagttaggtgaacaggtgctccagatgcctggagatcttcctgagcatagagtggagagaaccctgcttcaccacacctctgcacaggaaggatgggtggctcaggccatccagctcagtgaaacacctgcaatttctagggccctacagtgtgttcagcctctacgtctcatgcagaaaatcagcaaatcctcaaagggaagacggagaaaatggaggactctccttattatgtatgataccttcatgacgattaagaagaaaaccagttgccacattatgagctacactttggagaaattcccttgcaacatggatgcagctggaggccattatcttaaccaattactgcaagaacagaaatgccaaccacatgttctctaacttacaagtgggagataaacattgagtgcacatggacacaaacatgtgaatagacactagggcttacttgagggtggagggtgagaaaagaatgagagttgaaaagctacctctcgggtactatgttcactgcctgggtaataagctcatttgtacatcaaaccctagcgacatgtgacttacccatagagcaaacctgcacgtgtacctaatgaacctaaaataaaggttgaaaaaggaaaaaaaattgctagtaagaagctgaaatgaaatggctacttattgaatatctctggtctgcaaggaaaaaaaatctactatgagaaaatacctactctgaaagagactctctgtatagctctgccctcctgaattgcatgtccaaattgcattggaaaaaaatgaggaaaaattctggactcccaaggtagtagttggaaaagggagggcttcataagccccccagaagtgtcttgtggaccccctgaaaatgcttccagatccccagtcctcagatcacaccttgggaactactgtctgtcaccctacagtaagggaggaaacaacagcagaacttcatgttagctcagaccagctgcagatgctcatctgaactttgagaatggtcaaataaaagtaaaacctgatggaacaccactgtgactgtctatgctttcctgttttggagataggtctgccacaggacttcatatttctgccagagatccatgcatacttctctttgttctatgtttgacactgtaataagcaacagccattgct

SEQ ID NO: 463834 - DNA, 739 bp, Homo sapiens
atccccagcttaattactattctctggcatgttatttcagtacataaattatcaatatgattttgtgtcaaaaccaacaatttgaccaggcatgttggctcacacctgcaatcccagcactttgggaggctgaggcaggagaataatttgaaccctggaggcggaggttgcagtgagctgagatcatgccactgcactccagcctaggcaacagagtgagactctgtctcaaacaaacaaacaaacatcccccaacaatttatgcaaacaacatcagggaagctaggaagctctatgagctattctctgccgaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccaggtacaatgagccagtgactgttactgaatttcttaagattacacttttcccaactactgcagactgcttcagaatagaagaagctcccagagctgtctaccctcatccacaaaatctgttgcacctggatcctccccattcctcctattaccgcccccttcaggtcaccaatagtgtgaaatactgacagtgctgtctggaccctctccttcctccagttgctccttctcacatccaggctgccaaattagatcttctcaaaatcttgctcatggt

SEQ ID NO: 463835 - DNA, 280 bp, Homo sapiens
atccccagcttaattactattctctggcatgttatttcagtacataaattatcaatatgattttgtgtcaaaaccaacaatttgaccaggcatgttggctcacacctgtaatcccagctactcgggaggctgaggcaggagaatcgcttgaacctgggaggcagagattgcggtgagttgagatcgtgccattgcactccagcctgggcaacaagagtgaaaactctgtctcaaaaaaaaaaagaaaaaaggatacccaaagaaaaagttccaagctggc

SEQ ID NO: 463836 - DNA, 966 bp, Homo sapiens
tgcacccatgatgtgctacacacttgccattgcacctttcacttttaagtcaagacaagagactgcaaataccttacaatggctttcaaggttctctaagaggtctttcccagcccacctttacttcctaataagcactttattaagcaatatcagattattgtctattcccagaatttttcaaagccatcctagttcgctgcccttgctatttccagtacttggcattccctctacttctctatgcctgaaaatgatggaaatggctttggaattgggcaatagccaacaaaagggaacctcacttctacagcagcaaggaactgcattctgccaaaaacctaatgaacttggaagcagattattttctggagtctgtagaaaattctcatccactcctaatacattttgtctgatacattatttctgccctctcctcctggatattgaattagatgaatgttagatattttcatcattgtccttaggttgcttatgttttgacatgtttcatgtgtatcgttcatctttctttctcactagtgttcagagagacaggaggggtggggaggagggtgaggtgggtgtttagggattaactttgtctttaatttttagagcacatgtaaaactctttggaggtgtttcataagtgtaggaggaggtccagatgtccaactgggtattcaaaagcattcagaacgcattccctgtttactcttttctaaaacatcatctattacatttattactgtacacatacctgtctactttctgttcctcaaactcccctcagactctcataccttctttccttctgtacattgttctaattagaatgccttgctttgaattcacctggacacattttctgaagactgtgcgggcagacaagagtctgttgactttgcaagtgatttgtgatgtccatgtgattggtgacattgagaacagcagtttctgtaa

SEQ ID NO: 463837 - DNA, 1068 bp, Homo sapiens
cttaactgtgaagagagtgtgaaaattggaggctgtcgaggggaatgtggctgaggaaagatgatgctgcaggagtgccccagggtgaacaagcccatcagggaggcctgagtcagaggcccgcggggtcccaggctgatccagcatcagccatcctggacctgcctcatctgcccaggcagcatcctgcctacccccaccctggatcctggaccgggcccccagttgctcgcatctgcatgtctttgcctgggggtctctcaggatggcagttgtgggaaaaccaggaggcagagggtttcctgaagaatcccagcgctgctgcagctgccggcaacaggaagccacttgatcacatgtccaacctggggaaggggacccaaaacccaatctacaatgggagtctgaactggggccacttgagggggtcttgtagaagaggaaaacttgtggcgcaatgggatgtccagggacacagatagccaggtgctgggcctcaggatggaatccagccacccctgctgggtgacacacagtgaccttcctcaggagagtggaagctctgcagggtgagaatgaaacatgggtggtcagtggggataataggacctacctagctgggctgttatgaaggctaaacgaggaaacacttgtaaagttctcagaactgtgcctcgaacaagtgggagatgtcagtcaccatcacccccattcaccaggacagaggggctacagaaaaagctgaactgtgctgagccatctgctgcctcttcccagtgacagcatctgaatctgaaagaaaaaaagaatgtcacatccatttgtcatggctcttgggaccctgactttatgcaggggtgctgggagctaagtaaaacacctcaagccagtaagtccccccgcaacacaccttagaaatataaaattgacttgctacagacttgtttctagacctgaactcacctgcagttcttggaaaagaaaattaaatgggtatgttattatttaaaatattatggttattagcatttatgtgtatatgaaagtattgtttcatcaaatacatag

SEQ ID NO: 463838 - DNA, 1331 bp, Homo sapiens
gggctcccactcggcaagggaggaaaataaaaggagaatcaagtgaagggaaaggagaaaggaggcagaagagaacacaagaagttccctttaacaggaggaaaatggctttttaggaaacagcgatgatctaaaggacaaagaagttgattctacagaaaaccatgagaatctacaaattccaccgtttaaacaggtcagcttcacctgttatgattagagttaacagagaaatggatatcaacaggtttccaggaaataagtctggtgatgcaatcacaaaagatgatacctcactttaaatctgatgacttcaaagtaggcctgagatgactaccctcaaataggttgattttggcatcagtaacactacaggtaaaagcgtgcattaaaactgaagccacagcctgcacatttgcttctgtagtccagcatttagcttgtctgctgaagaacggttttaaaaatatcccagagaagatgacaccacttatactctttgacaaatgaattgggagatgaacagacattgaaaagaatataggaaatgtatcacattgtttaaaaataaagtcaaaaacatcctttagaagcttcagaaacaaaagcatgagaaccgaagcaggggcggcggcagcaaagcgcctgttccctgaaaagcagacctcagaacaggaggaacgcagcctgggcctgcaggtgggcatgtgggtaaggaagccattgacgccgccgccgccgcactcctcaaaggaagagcttaacaggccagtcgggagggggctcaacatgaacccgttctgtgaaaatgcttcaacgcagagttgcatgctctttattgtgggttcagtctattatttaatagacagcacaatattaaaaagagttgaagttctcccacttctattcacaattttaaatccaaagtgtgagcggaacgagagcaaaaagaagcctccagaaagcaccgaactgattaaaagcagcaagattacagtagcagcaaaagcatcaatactagtagaagctgtagcatcagctataatagtagtagtagtagcagtaataataaaagtactactagtagtcgaagctgctagcagcagcagtaacagtagtactagtaatagtagtgagagccgtagtagtagaagtacaagcttcagcagcagtagtaactgtagtaatagtaatagaagctgcagcataagggtaagcatcaaatgcaatgaaaatccataaggaaaacacctcaagcccagaattaggaagattagagaagatgtcccagacaaagtgaaatgtaaggtgatggctgaaacgtgagtagg

SEQ ID NO: 463839 - DNA, 659 bp, Homo sapiens
aagaagagtgatatggtttggctgtgtccccacccaaatctcaacttgaattgtagttcccataatctccacatgtcatgggagagacctggtaggagtctatttcctatcattaaatacttacaagaagtaaaagataaaaagaaagagattaatgaattgcgagtgaatacagatgaaggagaagacgtaataaaaaataatgggtattctgagcctggagaaggctatctgagagatactgcttcccgcaaacagtttgcctctgtgatccttatttacctctaccttttccatgagattgagaacactataagaaagcctacaaatgctatggttgcacatacagaaaaatccaagacctcagagacttcttcccatcactctttgatgtaactgatttctccccatcagtatcctgatcatctggttccttcatttcctctgatccaggatgacccaccagtaggagggtgcaactaccaccagagacctctgacctctgcaagacagctaattataatcacagattctctttctctaggtaaattgtcattgtggtgcactttggttttccagaggtccactaccaaagttcatcttttccccagatgcttcaccattaaaattaactttctgccatcctacctttggtccat

SEQ ID NO: 463840 - DNA, 2661 bp, Homo sapiens
gacaaggaaaccggcagtcttccgcttccggttgctctgttgccatagtaaccgcacccataacagccgtggtggttatggctggcctgagcggcgcgcagatccccgacggggagttcaccgcggtcgtgtaccgcctcatccgcaatgcacgctacgccgaggcggtgcagctgctgggcggagaactgcagcggagccctaggagccgcgccggcctgtcgctgctaggctactgctactaccgcctgcaggagttcgcgctggcggccgagtgctatgagcagctgggccagctgcacccggaactggagcagtaccgcctgtaccaggcccaggccctatacaaggcctgcctttatgcggaggccacccgggtcgccttccttctcctggataaccccgcctaccacagccgggtcctccacctgcaagctgctatcaagtacagcgagggcgatctgccagggtccaggagcctggtagagcagctgccgagtagggaagggggagaggaaagtgggggcgagaatgagaccgatggccagatcaacctgggttgtttgctctacaaggagggacagtatgaagctgcatgctccaagttttttgccgccctgcaggcctcgggctaccagcctgacctttcctacaacctggctttggcctattacagcagccgacagtatgcttcagcactgaagcatatcgctgagattattgagcgtggcatccgccagcaccctgagctaggtgtgggcatgaccactgagggcattgatgttcgcagtgttggcaacaccttagtcctccatcagactgctctggtggaagccttcaaccttaaggcagctatagaataccaactgagaaactatgaggcagctcaagaagccctcactgacatgccacccagggcagaggaagagttggaccctgtgaccctacacaaccaggcactaatgaacatggatgccaggcctacagaagggtttgaaaagctacagtttttgctccaacagaatccctttcctccagagacttttggcaacctgttgctgctctactgtaaatatgagtattttgacctggcagcagatgtcctggcagaaaatgcccatttgatttataagttcctcacaccctatctctatgacttcttggacgctgtgatcacttgccagacagctcctgaagaggctttcattaagcttgatgggctagcagggatgctgactgaggtcctccggaaacttaccatacaagtacaggaagcaagacacaatagagatgatgaagctatcaaaaaggcagtgaatgaatatgatgaaaccatggagaaatacattcctgtgttgatggctcaggcaaaaatctactggaatcttgaaaattatccaatggtggaaaagatcttccgcaaatctgtggaattctgtaacgaccatgatgtgtggaagttgaatgtggctcatgttctgttcatgcaggaaaacaaatacaaagaagccattggtttctatgaacccatagtcaagaagcattatgataacatcctgaatgtcagtgctattgtactggctaatctctgtgtttcctatattatgacaagtcaaaatgaagaagcagaggagttgatgaggaagattgaaaaggaggaagagcagctctcttatgatgacccagataagaaaatgtaccatctctgcattgtgaatttggtgataggaactctttattgtgccaaaggaaattatgactttggtatttctcgagttatcaaaagcttggaaccttacaacaaaaagctgggaacagacacctggtattatgccaaaagatgcttcctgtccttgttagaaaacatgtcaaaacacacaatcatgcttcgtgatagtgttattcaagaatgtgtccagtttctagaacactgtgaacttcatggcagaaacatacctgctgttattgaacaacccctggaagaagaaagaatgcatgttggaaagaatacagtcacatatgagtctaggcagttaaaagctttgatttatgagattataggatggaatatatagtaatagctgatagtggcatttatcaaatggctttgttatgtaaatttgcatcgctttatttaccctttggcatctttatatttgttacatgttgaactttgtacacttatgcattataaaaaaaaaagtagctaaaacttttgctgttaaatttcccagaaagtgacatattctaagaacttttaccccaggagttatgaaaaattccaaacttatgaggaatgtttatatcagaagttgtaatacgtttgtttcctttcctctgttatcttttgtgctttgacgtatcttgaggggtctttgcacaaggattacatcattcagggaccaagcactatctcagtaatagttaagagtagtctttaaataatcatttcagggattgtgtgagagtagtctcacaatttacactcattaatttggggaaaaaaaagcataaagtgtaactaatgttaaccacccaaaaacaaatgttttccagattcccttttgcaaatagcctggtctttatttggccacaatttatttacccaggtgctatgtgtttgtggttttcatgtatgtgtaatttaacttttcagaacat

SEQ ID NO: 463841 - DNA, 824 bp, Homo sapiens
caagtctcagccaccagctggcagagtggcctcgccttccttctccagcctgtgtctccatcagagtggcaaatggcttggcgtgatggctgaggctcctctccaccggattaaagcatggcctggcacatgctcagatgccatcgatatttggtttgctgttgttatttggtctccctgggtctgtggaagaagatcctctggggttgatacaatgggcagatggtgtccttcgaaaaatatcactcttgggatgttggtagcaagcctggaaccccggttggaaattgaaggaaagtgggagaaaaacagaggactggactcggatccaggagccttgatctctgtggacgtggacttgggcccttaccgctctgctttggatattgtaggttctgggtcaatgagaatgagaaacccagtgttcgggagagaggaggcagctgaaatgagcctgcatctctacaaaggaaaatgcagcccaggtcctctgatgcagagaagttagtgttcttcgggacaaggtgaaaaataggcggctggtgtagggagctgaggactggacatccagaataaagctcatccaccaccgttagggatgtcagtacctgccaacgccactggggacagctggtccctcagtaagctgccagagatcggatccaaccacagaggcccaaacgcagttggatccaggaatctgatcattgttcttccatacctcaaccaactctagctatgatgtccgtaactacgtaaaaaaccagaactgcttttaaaccccatttagtgtctgagtgtccagattgggaagttcactttgc

SEQ ID NO: 463842 - DNA, 1584 bp, Homo sapiens
  misc_feature (1582)..(1583): n is a, c, g, or t
gaaaactaaaatgttaaggattttgactcggatggcaaaaatcatgtcatttataacatttcaagacacagagatgaggagcccaagagatgaaactggagagctcctaaaacccaggaggctcttaaaactcctctaccaacatctcccctccatgaaaaaaggaagggtcagcccaagaagcaggaagcagcagtgcagggagaaaagagtactggatttagagtcagacacccaggttcaagttctagtttgcagttcatagaagcagtcttcccagcttgattttattcacagaagaaaaaaggcacccctgggaagtgcctgacaaaagcttgaagagagaagaggctctgctgtggtttgaatgcgtcccccaaagttcatgtgttggaaacttgatccccgatgcagcagtactgggaggatgccctttgccatgttatgatcctgcaggaagaccctcaccagatatggccccttgatcttggacttcccagcctccagaattgtgagaaataaatttctgtttttaataaagttcctagtttgttgcattctgttatagctgcacaaagcagactgagacaggctcctttactcatggtgaagaaggtaagtcccttatgactttatcaaataaaaataatgactacaggtaaagggctagaaatttttagacaaaaggccagtgggtatcacagggagctttccagttggctgttttggcagaatggcaagactttccttcctcattctcaaagcttcctgacatttacagctttggaaggtggtgagtgagaaaattttccaagggactctagacattctcagaatcccctggttccacacttgctagattatggaagagagaagagacacctaaaaggaaaaaaaaaaggaaggagaaaggggaatcagctctttagtcccctaagacccacttggctgtggctcctggctgccaagggttgcctgtgagtggttctccaggcatgaactgtgaccaccctgctatagattaatcctttcctcctacaaagttggtcttcagtatacttaatgagggagaaatgggatgtctttttttccttccagaatcactctagtatgacctgcagaatgattagcgtggctcagcctcagttgggatatcatggcttaaattattcctattagtttccagctgaccttggaacacaagcattacatgtgatttcaatgaaactttagactttgttgttctcagttaactagtgaaacagttgaaccttcccatgacttgtggtaattataataaaggattgggttaatttgaagaccttgtcttcaacctctgaatttctttattctacttgttcaattgtattgctaagactttccagagcattttgcattttaaaagtgtgtccattattttgtgaagttttgaatgttttttatttattccatctatttccttgaatatttctcccttcacttcttgtatcattttttggatttccttgcattgggcttagcctttctctggtccctcactgattagcttaataactaacctcctaaattctttttcaggtannt

SEQ ID NO: 463843 - DNA, 1687 bp, Homo sapiens
  misc_feature (1685)..(1686): n is a, c, g, or t
gaaaactaaaatgttaaggattttgactcggatggcaaaaatcatgtcatttataacatttcaagacacagagatgaggagcccaagagatgaaactggagagcagaacatctccagcagcagctgggatgatgaagcatcttctcttggcaaagaagaacaccaaaatcagagaggccagttaggaggctactgcaatatttcagctcctaaaacccaggaggctcttaaaactcctctaccaacatctcccctccatgaaaaaaggaagggtcagcccaagaagcaggaagcagcagtgcagggagaaaagagtactggatttagagtcagacacccaggttcaagttctagtttgcagttcatagaagcagtcttcccagcttgattttattcacagaagaaaaaaggcacccctgggaagtgcctgacaaaagcttgaagagagaagaggctctgctgtggtttgaatgcgtcccccaaagttcatgtgttggaaacttgatccccgatgcagcagtactgggaggatgccctttgccatgttatgatcctgcaggaagaccctcaccagatatggccccttgatcttggacttcccagcctccagaattgtgagaaataaatttctgtttttaataaagttcctagtttgttgcattctgttatagctgcacaaagcagactgagacaggctcctttactcatggtgaagaaggtaagtcccttatgactttatcaaataaaaataatgactacaggtaaagggctagaaatttttagacaaaaggccagtgggtatcacagggagctttccagttggctgttttggcagaatggcaagactttccttcctcattctcaaagcttcctgacatttacagctttggaaggtggtgagtgagaaaattttccaagggactctagacattctcagaatcccctggttccacacttgctagattatggaagagagaagagacacctaaaaggaaaaaaaaaaggaaggagaaaggggaatcagctctttagtcccctaagacccacttggctgtggctcctggctgccaagggttgcctgtgagtggttctccaggcatgaactgtgaccaccctgctatagattaatcctttcctcctacaaagttggtcttcagtatacttaatgagggagaaatgggatgtctttttttccttccagaatcactctagtatgacctgcagaatgattagcgtggctcagcctcagttgggatatcatggcttaaattattcctattagtttccagctgaccttggaacacaagcattacatgtgatttcaatgaaactttagactttgttgttctcagttaactagtgaaacagttgaaccttcccatgacttgtggtaattataataaaggattgggttaatttgaagaccttgtcttcaacctctgaatttctttattctacttgttcaattgtattgctaagactttccagagcattttgcattttaaaagtgtgtccattattttgtgaagttttgaatgttttttatttattccatctatttccttgaatatttctcccttcacttcttgtatcattttttggatttccttgcattgggcttagcctttctctggtccctcactgattagcttaataactaacctcctaaattctttttcaggtannt

SEQ ID NO: 463844 - DNA, 674 bp, Homo sapiens
tgttttagaacatggtagcttcaaagacgtttgttaaaaggataggctggtctgcatggtggctgttttactgcttttctaaacttgggtgaacccctggaggagaagccccaaacagggtagttccaccagcccaggatgcagcaaggtggacaaatcacagacaggacgggggaggagccaagatgaccgaataggaacagcttcggtccacagctcccagcgtgagcgatgcagaagacgggtgatttctgcatttccaactgagggacatggatgaaactggaaaccatcattctcagcaaactattgcaaggacagaaaaccgaacaccccatgttctcactcatagaaaaaaaaaaaaacaaagaaaaaaaaactttttgggccggcttgggccttggaaaaggttttctacccctttcctggggggcgcgcgggggcgccaagatgggtagtcgagacacttggggcaaaagcgtggtccccagagggagaacccggggccaacagaccagtggggtgcgtttcctccaccaaatgaaaaaaaccgcgcgggggacaacccggagggtctctggacaattcccaaagaggagttccaggagggccatagcgggctcctacacacgacggggcccagtggaggccgaataaatacgcggagggtgggg

SEQ ID NO: 463845 - DNA, 895 bp, Homo sapiens
tgttttagaacatggtagcttcaaagacgtttgttaaaaggataggctggtctgcatggtggctgttttactgcttttctaaacttgggtgaacccctggaggagaagccccaaacagggtagttccaccagcccaggatgcagcaaggtggacaaatcacagacaggacgggggaggagccaagatgaccgaataggaacagcttcggtccacagctcccagcgtgagcgatgcagaagacgggtgatttctgcatttccaactgagggacatggatgaaactggaaaccatcattctcagcaaactattgcaaggacagaaaaccgaacaccccatgttctcactcatagatcagagcctccccaaggggacaggaccacagccctccctaaaaggtcctggatctggtataaatctaaccatgggagaaaacagaattcagttacagacaacatcaagggcaaacttgaaggggagcaaaaatcacaatatggtgacagctggagagcccctgcacactacagactccctcctgctgcagatcagacttctggacaagtccagccctggctttgtggctgtcatgactactgaaaatgtcaaaggagaactcagccacaacacaggggctacaggccccatgcaagtccgaaacccagcaggacggtcattaaatcttaaagctccaaaataatcttgactctgtgtctcacatccaggccatgctgatggagggggtgggcttccaaggccttgggcagctctgcagggtacatcccctgtggctgctttcatggactgatgtgagtgcctgtggattttccaggtacacagtgcaagctggggtctggaggaggatgaccttcttttcagagctccactaggcagtgccc

SEQ ID NO: 463846 - DNA, 1448 bp, Homo sapiens
ctttctgagctcctcttttggctcctatagcctgcagctctgcttgcatgtgcctatgtgatttctcattccagtcatattacaaactaaccgagacacagatcttgtgcaaaaattttctgctgccatctcagcatctacttcagtgtcttcccaagcatcataagcacctggactctccatgttcttcccacctggactctccacctaaccctagatcccactcccatgacacagtgggccatctacttggccagccgccacctccagtaggctgctcagcctgcagcctgccacctgcttggactgctgtctccagctctcagcgatcctcctttcacctttcacttattttcccccttcttatcactttctttctttgttcttctcctgatctctctttcacctgtccaaaggccctccgtcccacttgtctatggctcacaatgtaaacacattgcctgctaatgatctatgatcttattttaaatggaaaatattttcttttgacctaaataattaaatgcaaagtatttgctgtgataaaagtcttggaatccacaataaaaatatttgtacctaccagtcatgactgagcatgggatgactaatgggttacaatcagagttgggaaggtgggtcattatgatgtcatctggcatgtgataatatagatcaggcctgcactctcatgatttggagatagcctcgtagaaatgacaaccacaatgttaatactaacatatgtattacatggtttgtttgttctttcgcttaatattttcagagcacctacctattataggcactgtcacttctcacaaaactgggacaactaactgtttatccaacatctgctggctaaataaagacatgatcttcaccttttgggattgttaatttaaaatggttccataagagcaatgcaaagacagagatatttggcagcactgcagctggtgatttatatggctcttcacaaggtgttattttggggtatcaaggtatggatgcttaaatcagctgcaggaagtaagaaagaagaaaaaaggagtgataaagataaaaaaaaatcaaccttggtccttccaccaagacccattaatttccatatcatcatctgcataagagggaagattcctacatgaccaggttactgcaaggatgtgaattttgaatattaaaatattatacacaattggaaataactgaaatctaccaatgtttttacaatccagcatatttacaaaaacaaatccatcaagacatccaataaattagtcttgatgagatttgtaatgaggcattaaagataagctaagtaaactgttagaaacttagaaaaatatattgtagcgtaacatatctaatcttagctcatattttatgcaaataattagacaataaatatttaaaataaacaagaaatttaaatcttaaaagaaact

SEQ ID NO: 463847 - DNA, 1258 bp, Homo sapiens
agtagctattattattattgtcatttttattaaatgacagatccattttcagtttgttcagacagttgaatatattataatttacatcgtgataaccaacaactgttatcctcaacagatgcagatctgtggatccagcgtagcatctgtagcagctgggacatcattccaggttttgggcccggtgtgttggcaacaactggatctgaagatggcagtcagggtgctttggggtggtctcagcctgctccgagtgctgtggtgtctccttccgcagacgggctatgtgcacccagatgagttcttccagtcccctgaggtgatggcagaggacatcctgggcgttcaggccgcgcggccctgggagttttaccccagcagctcctgccgctcggtgctcttccccctgctgatctccggttccaccttctggctgctcaggctctgggaggagctggggccgtggcctggcctggtgagcggctatgcgctgctggtggggcctcgactcctcctcactgccctttcctttgctctggacggggccgtgtaccacctggccccgccgatgggggcggatcgctggaacgccctggccctgctgtctggttcctacgtcaccctggtcttctacacaaggaccttctccaacaccattgagggactcctcttcacgtggctgctggtgctggtatcctcccatgtaacgtggggccctacacgcaaggagccggcgccgggtccacggtggcgcagctggcttcttggaggcattgtggctgctggcttcttcaaccggccacctttctggcctttgctgtggtccccctctacctctggggcactcgtggagccacaaacctggtttgaagtctctgacccgggaggccctggtgctgctccctggggcgaacctcacagcagcggtgtttgtggccacggacagtggtattctccagccccgctacatccaggaaccttgtcctgacacctgtcaacttcttgcactacaacctgaatccccaaaacctggcgagacatggcacgcagggcgcggctcactcacctggcagtcaacggcttcctgctcttcggggtgctgcatgcccaggcctgccaggctgcgtggcaccggctgcaagtcggccttccaggcctctgcacaaatgggcctcctgagggcactgggtgcccggagcctgctgtccagccccaggtcctatctccttctcctctacttcatgcctctggccctgct

SEQ ID NO: 463848 - DNA, 638 bp, Homo sapiens
agtctccgcgctgctgaggcgcgcccggccgctcccacggcctcccctccgccctgcggtcccgccgcctccggggcctcctgggaccctggccctcgccgggcaggacgccgccagcgctgaaggcgcagcccggaggccgcgcggatgcagatctgtggatccagcgtagcatctgtagcagctgggacatcattccaggttttgggcccggtgtgttggcaacaactggatctgaagatggcagtcagggtgctttggggtggtctcagcctgctccgagtgctgtggtgtctccttccgcagacgggctatgtgcacccagatgagttcttccagtcccctgaggtgatggcaggtaaaactccgcatgtgtggctgagacaagctgcagcagagtctgcttgagaagctgacgggagactttgtggggagggagtagcatgtctgggtagatgagtagtaaatccacaagcagagcagcagcctctctctctggggtaagaacttggaagtggggacttcatatctccttcccgagtggtgacactgaccttctgggtaatgctaataaaccaccagtctctttgatgtatccctgcttggaccaacaatacaggtcattcagaatgagagct

SEQ ID NO: 463849 - DNA, 1287 bp, Homo sapiens
agtctccgcgctgctgaggcgcgcccggccgctcccacggcctcccctccgccctgcggtcccgccgcctccggggcctcctgggaccctggccctcgccgggcaggacgccgccagcgctgaaggcgcagcccggaggccgcgcggatgcagatctgtggatccagcgtagcatctgtagcagctgggacatcattccaggttttgggcccggtgtgttggcaacaactggatctgaagatggcagtcagggtgctttggggtggtctcagcctgctccgagtgctgtggtgtctccttccgcagacgggctatgtgcacccagatgagttcttccagtcccctgaggtgatggcagaggacatcctgggcgttcaggccgcgcggccctgggagttttaccccagcagctcctgccgctcggtgctcttccccctgctgatctccggttccaccttctggctgctcaggctctgggaggagctggggccgtggcctggcctggtgagcggctatgcgctgctggtggggcctcgactcctcctcactgccctttcctttgctctggacggggccgtgtaccacctggccccgccgatgggggcggatcgctggaacgccctggccctgctgtctggttcctacgtcaccctggtcttctacacaaggaccttctccaacaccattgagggactcctcttcacgtggctgctggtgctggtatcctcccatgtaacgtggggccctacacgcaaggagccggcgccgggtccacggtggcgcagctggcttcttggaggcattgtggctgctggcttcttcaaccggccacctttctggcctttgctgtggtccccctctacctctggggcactcgtggagccacaaacctggtttgaagtctctgacccgggaggccctggtgctgctccctggggcgaacctcacagcagcggtgtttgtggccacggacagtggtattctccagccccgctacatccaggaaccttgtcctgacacctgtcaacttcttgcactacaacctgaatccccaaaacctggcgagacatggcacgcagggcgcggctcactcacctggcagtcaacggcttcctgctcttcggggtgctgcatgcccaggcctgccaggctgcgtggcaccggctgcaagtcggccttccaggcctctgcacaaatgggcctcctgagggcactgggtgcccggagcctgctgtccagccccaggtcctatctccttctcctctacttcatgcctctggccctgct

SEQ ID NO: 463850 - DNA, 885 bp, Homo sapiens
ttgtcacaaagccaggcagtggccccaacctctgtgcttaggggaatgctgctccacctttacggtgacccccaggtctgtgctgagcagaacgcagctccgccctcgcggtatcctcagcccgcccgcccgcccgggtctgacctgaggagaactctgctccgccttcgcagtaccactgaaatctgtgcagaggacaacgcaggagaacgcaactccgccgtcgcaaaggcaccccgcgccgcgccggcgcagagaggcgcgccgcgccggcgccggcgcagagaggcgcagggctctcttgcttacagtggtcgccagcgccccctgctggcgccggggcactgcagggccctcttgcttactgtgtctgacttccagcaactgctggcctgtgccagggtgcaagctgagcactggagtggagttttcctgtggagaggagccatgcctagagtgggatgggccattgttcatcttctggcccctgttgtctgcatgtaacttaataccacaaccaggcataggggaaagattggaggaaagatgagtgagagcatcaacttctctgacaacctaggccagtgtgtggtgatgccaggcatgcccttccctagcatcaggtctccagagctgcagaagacgacggccgacttggatcacactcttgtgagtgtccccagtgttgcagaggtgagaggagagtagacagtgagtgggagtggcgtcgcccctagggctctactggaccagcgtctcctgtctcctggagaggcttcgatgcccctccacaccctcttgatcttccctgtgatgtcatctggagccctgctgcttgcggtggccttataaagcctcctggtctggctccaaggcctggcagag

SEQ ID NO: 463851 - DNA, 2264 bp, Homo sapiens
  misc_feature (1)..(3): n is a, c, g, or t
  misc_feature (7)..(7): n is a, c, g, or t
  misc_feature (11)..(11): n is a, c, g, or t
  misc_feature (13)..(13): n is a, c, g, or t
  misc_feature (17)..(20): n is a, c, g, or t
  misc_feature (22)..(22): n is a, c, g, or t
nnngggngggnangggnnnngnaggacctgcacttggagtggccggccggcaccactcggccccgggcagtgaggggcttagcacccaggtcagcagctcagcacccagatgctccagctcccccagcattgctggcccgcccacgccccgctcgaattctcgctgggcctcagccgcctccccgcggggcagggctcgggacctgcagcttgccatgccagagtccccccacccccatgggctcccacgcagtccgagtctccccgacgggtgccaccccctgctccatggcacccagtcccatcgaccacccaagggctgaggagtgcaggcgcgctgcgtgggactggtgggcagctctgcccacagccccagcagaggatccactaggctaagccagctgggctcctgagttgggtggggacttggagaacttttatgtctagctggaggattgtaaatgcaccaatcagcactctgtgtctagctcgggcttcactcctgaagccagcaagaccacgaacccaccagaaggaagaaactctggacacatctgaacatgtgaaagaacaaactccggacacaccatctttgagaactgtaacactcactgtgagggatgacagaaatgtagttgcagtggcacttcgattaataaaacccatgggaaacatgcccttttacaaggaaatcatcatgcttgagaaaatacgaaacaaaaacgactgtaaatcacaaagttgcctggataaagaagctaccagagacattgtgatcaagggtagtaaatctgaatccaaaataagtgagggcaaagtaatcacaaataccttctccctccatgatagaatgaatataaggaaatcaaagcgccagcaagtggcccagaggaagaactgcttaaagttctacttgctgcagcagtctacgtctggtgccagcaggttagataaaagtatctatgggtttgatgcaggtccaggcaatacctgctgcaccactgactctggagggccaatctgtcagccaggcagcaacactgttctgtggcccattggctctttaccagtggttttggtttacttggtgaaaacccagagaaaatatccactaaaggattgtaaatgcaccaatgaacgctctgtgtctagctaaaggtttgtaaacacaccaatcagcactctgtaaaaacacaccaatcagcgcgctgcgtctagctaaaggtttgtaaacgcactaatcagcactctgtaaaaatggaccaatcagcactctgtaaaatggaccaatcagcactctgtaaaatggaccaatcagtgctctgtaaaatggaccaatcagcaggatgtggggtgcttctttcactgtcttcctgagcagtaatgcttcaaagaacacagcttgggaattgacttagacttcattcagtgtcaggacataaagcaaattctaagatccttgagtgttctgattttatttttttccctggaagtaacacagagaatgcattataggaatcatgtttgttttgtgagatgttaattaatctccaagtatttgtgttgtcttagaaaaatagtatctctggttttctttattagtctattatgactctattttcccatcctaaaaattttctaagtctttcttgaatccattggatttttaaaaattatgaataattaaaaaatttactgttttataagcataacattccttatttgccctcaaatttcttgtctcagacttcaagttgagcctcatttgagtgttctaggactctatttttgcagaatgtcagatacggatcccttattaaatcaataaaccaattgattaaaaaaactgaatattctaaatttctctgctctggaagatcaataatggtgtaaaattcacaagggagtatacgttaaatatcaataacgaatgacaaaatatgatctttttctatttataggttatgaagtgttccttttttgcttccataaaggacttgagaaatttacaatcaaagatacattttcaatactatttttaagcagaaagaagataatcaacaccaccaccaataaactatacagatgggagaaataagtgtgccaaaatgtaggttaatgttacagcagttgaaaattaaattaggttcaggtcttcctggaagccaagggaagacaaaaggagcagggcagggacaaggcattatgaggttataacataaatctttaattagcaaaggtatttctttgagggtttgcaaatg

SEQ ID NO: 463852 - DNA, 1018 bp, Homo sapiens
ctgcctgtccggggaccctggggctgctgttcctgtggtaatgtggcagctgggaccatggccagcttcagtctgcctggcgtcacataagccagcccacagggtcctgcagcttgtcctttctggctggaagctctgggcatagcctgggactgggtctttccagagagggctgcagccagggccctgccagcctcgggggccacagcggctctcacaccagcatcttgctggataggagcagttccaggactctctgatcacacctgatcatcgtcactgccagaattcaaggtagctgcctgccatggctgagaggtgtgcctcagcttaacccactcagtgatggactccagtgcctgcaagaagtctcaccagagtaagaagtggaggatccaggcccaggagaattttgccaagaagtttccgtacaggttgtcgtggctgacagagcccgaccctgagcccctgcagccctgggaggtcacaaacgactcgaacacggtgcagctgcccctgcagaagaggttggtgccaacgaggtccatcccagtccgaggggttggtgtgaggattaaaaagagcatgaatgtcacttctaggactttatcccaaatgtacactcacacaggtaagtaaatgctgttcactccagtgctgctggaaacagcaaaggattggaaagcagctaaactgtttgctaaacactcacaggaaactgctaaattatacaactactcccggaaatcttaggcagccattcaaatgtagaggcagctctttatagactgatctgaatgatgtacagatgcattcggctgtgcttccaaaacaataatgcattacatctcgctgtttgtgagaaaccagggatttattttaaattttaagcattggaaacatccctctcaggaagctgcctgaatgacaaagccacagaataaaactgaaaagaaaaacaagccctaccccataactgcagaaagttggttaacattttcctgacaatgaaagccag

SEQ ID NO: 463853 - DNA, 1489 bp, Homo sapiens
ctgcctgtccggggaccctggggctgctgttcctgtggtaatgtggcagctgggaccatggccagcttcagtctgcctggcgtcacataagccagcccacagggtcctgcagcttgtcctttctggctggaagctctgggcatagcctgggactgggtctttccagagagggctgcagccagggccctgccagcctcgggggccacagcggctctcacaccagcatcttgctggataggagcagttccaggactctctgatcacacctgatcatcgtcactgccagaattcaaggtagctgcctgccatggctgagaggtgtgcctcagcttaacccactcagtgatggactccagtgcctgcaagaagtctcaccagagtaagaagtggaggatccaggcccaggagaattttgccaagaagtttccgtacaggttgtcgtggctgacagagcccgaccctgagcccctgcagccctgggaggtcacaaacgactcgaacacggtgcagctgcccctgcagaagaggttggtgccaacgaggtccatcccagtccgagggctcggggctccagattttacatcaccgtctggctcctgcccggcaccactaccagcaccatcaccacctccactgtgcaacctttgggaactcaagttgctgagtcgccgcttccccagacaactcgccttcctgctgtccacccggcacactgaggctgcctgcccccagaccagcaaggcggcagggctgtccaggggcctctcctagagactgggctctgtgtgtggccttcttattggccaccttctccttggcaggctctgggcagtagccacagagactttagtaaagggatcagccttcatggccatcatagaccgggagtggtttgtggtccccccaaaaagctacaccaagctaataaactgcgagttcccaccccacttccagctggaatgatcactttgcctccctgagccttcattttctcatctctaaaattgttgtaataatgtttaatcttgcagggttggtgtgaggattaaaaagagcatgaatgtcacttctaggactttatcccaaatgtacactcacacaggtaagtaaatgctgttcactccagtgctgctggaaacagcaaaggattggaaagcagctaaactgtttgctaaacactcacaggaaactgctaaattatacaactactcccggaaatcttaggcagccattcaaatgtagaggcagctctttatagactgatctgaatgatgtacagatgcattcggctgtgcttccaaaacaataatgcattacatctcgctgtttgtgagaaaccagggatttattttaaattttaagcattggaaacatccctctcaggaagctgcctgaatgacaaagccacagaataaaactgaaaagaaaaacaagccctaccccataactgcagaaagttggttaacattttcctgacaatgaaagccag

SEQ ID NO: 463854 - DNA, 850 bp, Homo sapiens
cacgccagcaggtgaggaggctggggccagatgacagctagtgagggagcagagacaagacaaggcgagcctgtgacagagcgagaccctgtctcaaaaaacaaaaacaagacatgtgagcttggactccagtgtggaatcccatgtccgctcagtgcacctttctgccgctgaaagtacaagaggagaggggaaacccacaggtggagctgaccatgaggactgtcacagggaactctttgaataagaggacaccagatcatgcctgcagttccagcccaggagcaactagcaccagcctcagcatggagcaggacttcagttccagcagcgaggactgagatcagacacaagagaaagctccctgatgaggaggggtgattctaaaacgaagggcggaaattatctggggaatttccttcccgtgaagcctcaggaacatgccagtcccctacttcggtctgtcctggggggtctcacgcccctgtcctcctagggaaatctagatcctccaaactctgcctgggttcttcctggggagtcttgacccctgccttgtggttgatgtgggataggggacccgggaacagggctgccttcctctggccaaggcctggcaagcaagtgtgggatgggtgctgtcttcctgagagggacaatagaagtgacagagccccctaattcaagaccctgcagaggtggtgtgagatcttataatatcagtctctaagccagtgcctctcaagctctctttggtgaagaatcaatttttaaaatatataatcagtcacagatcaatgcttttgtaaaatgcaataaaagttaatttccaaaaaaatcacatacttgg

SEQ ID NO: 463855 - DNA, 7089 bp, Homo sapiens
ggtccctagatgaggtctgacacgtggctttgtggcactagctccaagggagaccttcataccacgcacattctgggacaatctttggttctcctctcagcctggacaagcagtgaaatacagcatccagccactgcctggctcagtcagccatgctatcttgggacagaaaccttgacaggaatcccagctctagccaaggaaaacatgagtcaggcctggctaagccaggtggcttccctctctccaccttccatccccacacccccaactccacagccaatgagctgtttgggtaaccccaagaccccactcccacacagcctacggccagcaaaggcatgcaggcaggattctagaaccttggcccggctttgggttgctgcctttgaaagtgtagcaggtgtggggctctagctccggccctcctcaaaggagacaggagcattccctgtgtctttccggccttccacctaccctggccttctctgcacagggttcccttttggggcactgtgattgttctcaaaggcagagcccaccctggccaggagtggcacaagattcttatcccacttgtagtagaagacttttcctgattcctcttcccagcctatccaggggcttccgttctcctgccggtctcacctcaggctgaaatgttgatatttcctcgtgtctggggacactgctgctggactttgtggaaaaacctttcctgcctttgtgtggcttctgttttgtttgtttgtttatgtatttatgtatttatttattttgaaacatagtctcactctgtcacccaggctggagtgcagtggcgtgatctcagctcactgtagcctccgcctttgggttgaagccgttctcctgcctcagcctcccgagtagcttgggttacaggtcaggtctcagaatgttctggtgagaatccagaactctcctcccaggacctcagggcatttcaggaactgtaataatacaatcacttcgtatagcaagaatcagcccctgaggtctccaggaagtaccttgatttgaaagagctgtgaccaacctcagtggcatgtccaactaccacgctgcagaagtctgtgaggccgtggtcctcagccctttgcacagattaaaaccccaatcccagccgcaccccagaccaatcaatcaggatctctggagatggggcccaggcatctatatatatgtatatatatatatttttttaattcctcagatgattccaatgtacagccaatgatgagcagctgctgggctgaagggactggggccattttataccagttgtaggatgttacacagaaatgcctgaaaagcaaggagcagctatcagaatgtttggtgacacagctcctcctgtcgtggttccttcggcatggacttcacattcagcagatccatgaggtgttccctttcggatgagctccaaggtcttaagagagcatctctagtctgcgtgagtccgtctgaacgacggtcctgagcaagaaccacctataaccatctgctcaaaataactcaggggaagtcaaagctttctatgtggaaggtgactgaaaccacatacacagaccactgcagcattcctgacattatggaacttggaaatgattccaaacatggccatagcttgagtaacatgttttgctatgacaagaacttggactgtagtccttccccctctcaagaatgtgacatcacaccttatcagatcctacgagtgagctactgacctcaaccactgaacttcaaactatgtaaaaacctaagggttcgacagacactttgagagcttgggctgtggcaagctacactctgtcagcctctcttcgacagggccccaccctgctagcctttgaacttggaagcatcgcccacaaacaccagtgccaccctctagccttgagggaccatatatgtctctgtgaatctccgttgcattggacagcttctctcccaagagctgctcttataaaagagacacaccacattttaatgaggttcgctctccacagaggcctgcttccatcctaattgagcaagtagactttagtaactttggaactcactcaccccgtgactaatacaccctgtctacccagcgcattccctgtgagatttgttcatgttgttctccccctccttaagcattgtgaacctaggaaaaatatcatctctgtagggcaataaaccatgtgatttgtgaaatcatactttgagcatctcctaattttaaccatacacaatgcctgagaactgggaaatgaagaaaggaggaattggatctaaaaatgtgtttaacaaagtataaacgccatagatatccaacaacagggtgcctggacagataaacagaggcaggctacctcttccaaatgtcatagactacacaatacatagaaagagggtcatgggattatatgaggtaaaaagaggccataatgcggaaggaggagaatcgctggtttacaagacggtgcagagtctcccacagagagcatctgtttggcccagtactaggaggcctctttggtgtgaaatgtgaagcccccagggaatggccctgatgggctaaaatgtgaagaagggggatggctactgaattaaaagaagtagcaggaatttgagagactgggggctggcagctggaggaggcaggagctgcccagtaggacatccaggcatcgagcaagtgtctgtgaaggagcattcatggaggattcctcacgccagagtcttggaggtgcgggacgttgtgttttagtcatttgctctattatcacataaagtcatgcccctcttgaccttcatgcctttagtaagtgaccagggcagaatctcctggcgagggagagctgaactgggggtggcccccagccccacctcatggaaatcctcagagcagcctggacggctaacatacctgggtgtcaggcagggccagcaggaaacagcaccactcagagtggatgagtgagcagagttacggagggaccattttacaaaggtatgggtgggcttgggggaaaccagacgcagtgcagtcctcagaggtgggaaagctcagcaccgttaattccacctggctgggggcaggtggggaaagagagaaagtggtaggggcaagggagctgggatgctgcctgacaaagctgtgaccttctgtcataggacacagccggtcctcagtgaccccagaaggaggaaggagggaggtgatgttatggggctgaattgttcccccaaaacccatatgtggaagccataacccccagtacttcacaatgtgactgtgtttgaaaatggagcttagacagaaatgaataagttaaaaattgaggccctcatccaatctgactggtgtcattggaagaagaggtaatccagacatactaagagacaccagggtcacacacacagagaggagagactgtgtgaggacacagggagaaggcggaactgaaaggaatccatttctgttgtttaaggccctgagcctgcggtccactgttatggcagccctagcaagcagatacaatgaatccccaaacctccttccttcctccttattgcctctggctggggctccctactggccaaaccccaccaaggccagagggcaggggtgtgagtgggtacagtcaagacaggccagcctcccaggtccagagcagggtgacgaaggtggagagtaggcccagagcagcagacaggggtgtctgcacacctgggaggggtgtggagtcgaggtaatgtatcttcagatggatgacccaggctcctgacaacaccaggttcacaaataggacacagaacagcatggtgaaggcaggccaacatctggaccaagattgggagaaaagggaaacaatgacaatggttggtaggactgcagctgatttgttttccccaagcttttattttatttatttatttttttccgatatggttatgttgttttagactaaaaagagccaatccagaggcagacttttcagacgaaacagcttaatctagcctgagggcagggaggctgttggggcagaagggtggtggacgggggcaggcagcacccttgaattgcttaagctccatcagagaagagatatgcgtgtctcctgtgcccttcgcccctgggttctctcatgataaaggatagaccaagagcgtgaccttctgggtatgatgggtgcttcccccagccccggactccgtctcaacatgggtccaggcacccaaggcacagctctgagaggaacaaaagcttggggagctgtcctaagtatccctcacccctcgcttcttccccagagtcctggggagacatcatttgtgacatctgttgcctggtgttcttgccttaggttcacaggcatgtgagtttcctctctactggatgagaccggtggggctgtgggctgcctgccccagcccttctccctctccatctctgtggctggagcccttgctccggtgccccaggactgtccaccagcccatcctccctgtcagcccctggccctccacaccttggttttgcagactaggaggtgctgcctgttctcctctgttctcatggggaccgcaggcaggaccacatggcggggggttctaaagacatacccatccccctttcacagggttgctatggggacacatgctcagctgcccccaaaccttcttaacctctggaaattgctcaaatggaaacattaacacaggaccaccctccgcacaaagcccatatgagggcggaatgagagtcaggacggggctctgagcacaagacatgcaggtgtgtctgacagacggggtgggggcagataaacctcaaagcaaccaggtcaccaagtcctgggagagagcccagctttgtgatacccacatagtagctcacaactatgcgccagatccaaatgggctcctgtgccactttctttaacactcctggccactccatgagggacgctgtgatctccacattgtacagacaagaagccgagttgcagagtgatcgcataaagcccagggacacgcagatagtcatggtgcagccaggatttgaacctaggcagattccagaggctgctgtctgagttgctggtctgagtttccttctagctaaaggtagcagggaaagaacttaccgcctataggaaaacaagatctattttcataagcaacaagaagccctcatgaggacgacaggactggtagtgtgaagtccaaaagagctccctgccttctcctggcttaggtccacctctgtctgcaagctgatgagtctggccctgaagcgagcagatctttcttaccccactggggcttagctggactcggagctcctgcagccctgacctccccagggcatctgcgactcccagattcagcctaggacttacagagctccctagaaggaattaattgtggacagcagtggggacggtccattttcagtcttcctaatcttctctgggagctgtttgacttgaattctttgacctccagggtttttacagaagcctacttgtttaggatgtgttaatcaaataagggatgcaagctgtgagtcctcttgggcagaaatggactttttctgaccactgctgcactcctcccgctcagcatctcagaagtggacatgggaccaagcatctcagtggtctcagctgtctggcttggaggtgggggggagagggagaaggtatagccctttaatcttcctctttttgacaccagaaagtatcccacattaatcagtcccacattaatcagctccttcctcaggcaaaagctgagctgggaaagtcccagatggggcagtgtccccatcattcattattactaagccagagatatccagcagggatcagtggagttttcagtcctcatcttatatccagagagcacaagacattccaaggcaaaactagatagtggacacttaataattcatcgattccaacacaagcttgcatgtaacatatctcataataccaagtaactcataaaacaagcagtgagagacatttatcggacaaacacttcctcagatcacttcatctgcctgagagaacagacctgccataatgggccttatccagcaaaacaggctgcgtgttgggagggcaaaatggctgttacatgagcccacccatcttgccatcaaagggatgtatttgcaccctgagtggtagcagggacagcttgctatgtgaaagctataagacaatgacacctcagagaccaagccacccagctatgggatcgtctagtgtgggagagagaacatacttttcctacccctttttcagtgaggcaagaagcagtagggatgtttttaactgccattaacagaaaacccaactcaaaggggcttaaccaataagaaatttattatctcctataacaagaaaccgcaaggtaggctagctccagaaaaggttaatttagcagctcaatggcatcatcaaggacccagatgctatcctcagtgctgctgtcagcttcaggctggcagctggatgcctatagtggttccatgcacaatatccagagcgtctcgggagaatgaaatgagaaaccttcccaaagtaccccttatagacttcttcttgaatctcactggccaggattgggtcacaagcccatgcctaagccaatcacaggtaagagaagtggaacggctctcattggcttgaaccaatcgggatccaccttcaggggctacagatggccgcagctgggctaaagcccgaggctggctgggagaaggcggaagcccgaataaaatcagtctctgttggtgaggaagaaggtaaactccagctgagaagaccaaccccaggagctaacagatagcgggaactcaatacatagagttattttctttaagtgacttgccaaagggcacagagctataagtggcagaaccagaactcaaatccagaaagagaacaaggatgctaaagataaactgggcttagttcacagctgctcccatgacagtccccatggtggaggggcctcttcctctgggagtccggctgttttgtcaccctgaaagtgaag

SEQ ID NO: 463856 - DNA, 826 bp, Homo sapiens
gcccttagctttcgtctcatctccttgccaacagcacataagtgtgagtgactccttactgccgtccaggcagcctgggggctacgaggggcttcagaggtcctcatccccagcctgtaggcctggccatactggacccatgagatcagccaccctgtcagctggtacctcggggtcctacagtcctcctcgctcaagccctggtcctctaactcggaggtgatgaggtgttgggctggaagagacaggcagcagatgattccaatgtacagccaatgatgagcagctgctgggctgaagggactggggccattttataccagttgtaggatgttacacagaaatgcctgaaaagcaaggagcagctatcagaatgtttggtgacacagctcctcctgtcgtggttccttcggcatggacttcacattcagcagatccatgaggtgttccctttcggatgagctccaaggtcttaagagagcatctctagtctgcgtgagtccgtctgaacgacggtcctgagcaagaaccacctataaccatctgctcaaaataactcaggggaagtcaaagctttctatgtggaaggtgactgaaaccacatacacagaccactgcagcattcctgacattatggaacttggaaatgattccaaacatggccatagcttgagtaacatgttttgctatgacaagaacttggactgtagtccttccccctctcaagaatgtgacatcaccttattaatttagagaggatggctaagacatgatcaatttaaactaggtgccaaattgagtggggggaagaaacggactttaagcc

SEQ ID NO: 463857 - DNA, 1036 bp, Homo sapiens
cacgccagcaggtgaggaggctggggccagatgacagctagtgagggagcagagacaagacaaggcgagcctgtgacagagcgagaccctgtctcaaaaaacaaaaacaagacatgtgagcttggactccagtgtggaatcccatgtccgctcagtgcacctttctgccgctgaaagtacaagaggagaggggaaacccacaggtggagctgaccatgaggactgtcacagctttgagaggcaaatccagaaatcagccctccagcttcctctaccaagaagactggcggttacaaccctggctctgtggggcttctcttgccctctcttctgactgccctacttggctccaggtgagggtgagaggaagctggagatggaagatgcagctgggggaactcaccaggcaggtctcagggaactctttgaataagaggacaccagatcatgcctgcagttccagcccaggagcaactagcaccagcctcagcatggagcaggacttcagttccagcagcgaggactgagatcagacacaagagaaagctccctgatgaggaggggtgattctaaaacgaagggcggaaattatctggggaatttccttcccgtgaagcctcaggaacatgccagtcccctacttcggtctgtcctggggggtctcacgcccctgtcctcctagggaaatctagatcctccaaactctgcctgggttcttcctggggagtcttgacccctgccttgtggttgatgtgggataggggacccgggaacagggctgccttcctctggccaaggcctggcaagcaagtgtgggatgggtgctgtcttcctgagagggacaatagaagtgacagagccccctaattcaagaccctgcagaggtggtgtgagatcttataatatcagtctctaagccagtgcctctcaagctctctttggtgaagaatcaatttttaaaatatataatcagtcacagatcaatgcttttgtaaaatgcaataaaagttaatttccaaaaaaatcacatacttgg

SEQ ID NO: 463858 - DNA, 6086 bp, Homo sapiens
cacgccagcaggtgaggaggctggggccagatgacagctagtgagggagcagagacaagacaaggcgagcctgtgacagagcgagaccctgtctcaaaaaacaaaaacaagacatgtgagcttggactccagtgtggaatcccatgtccgctcagtgcacctttctgccgctgaaagtacaagaggagaggggaaacccacaggtggagctgaccatgaggactgtcacagatgattccaatgtacagccaatgatgagcagctgctgggctgaagggactggggccattttataccagttgtaggatgttacacagaaatgcctgaaaagcaaggagcagctatcagaatgtttggtgacacagctcctcctgtcgtggttccttcggcatggacttcacattcagcagatccatgaggtgttccctttcggatgagctccaaggtcttaagagagcatctctagtctgcgtgagtccgtctgaacgacggtcctgagcaagaaccacctataaccatctgctcaaaataactcaggggaagtcaaagctttctatgtggaaggtgactgaaaccacatacacagaccactgcagcattcctgacattatggaacttggaaatgattccaaacatggccatagcttgagtaacatgttttgctatgacaagaacttggactgtagtccttccccctctcaagaatgtgacatcacaccttatcagatcctacgagtgagctactgacctcaaccactgaacttcaaactatgtaaaaacctaagggttcgacagacactttgagagcttgggctgtggcaagctacactctgtcagcctctcttcgacagggccccaccctgctagcctttgaacttggaagcatcgcccacaaacaccagtgccaccctctagccttgagggaccatatatgtctctgtgaatctccgttgcattggacagcttctctcccaagagctgctcttataaaagagacacaccacattttaatgaggttcgctctccacagaggcctgcttccatcctaattgagcaagtagactttagtaactttggaactcactcaccccgtgactaatacaccctgtctacccagcgcattccctgtgagatttgttcatgttgttctccccctccttaagcattgtgaacctaggaaaaatatcatctctgtagggcaataaaccatgtgatttgtgaaatcatactttgagcatctcctaattttaaccatacacaatgcctgagaactgggaaatgaagaaaggaggaattggatctaaaaatgtgtttaacaaagtataaacgccatagatatccaacaacagggtgcctggacagataaacagaggcaggctacctcttccaaatgtcatagactacacaatacatagaaagagggtcatgggattatatgaggtaaaaagaggccataatgcggaaggaggagaatcgctggtttacaagacggtgcagagtctcccacagagagcatctgtttggcccagtactaggaggcctctttggtgtgaaatgtgaagcccccagggaatggccctgatgggctaaaatgtgaagaagggggatggctactgaattaaaagaagtagcaggaatttgagagactgggggctggcagctggaggaggcaggagctgcccagtaggacatccaggcatcgagcaagtgtctgtgaaggagcattcatggaggattcctcacgccagagtcttggaggtgcgggacgttgtgttttagtcatttgctctattatcacataaagtcatgcccctcttgaccttcatgcctttagtaagtgaccagggcagaatctcctggcgagggagagctgaactgggggtggcccccagccccacctcatggaaatcctcagagcagcctggacggctaacatacctgggtgtcaggcagggccagcaggaaacagcaccactcagagtggatgagtgagcagagttacggagggaccattttacaaaggtatgggtgggcttgggggaaaccagacgcagtgcagtcctcagaggtgggaaagctcagcaccgttaattccacctggctgggggcaggtggggaaagagagaaagtggtaggggcaagggagctgggatgctgcctgacaaagctgtgaccttctgtcataggacacagccggtcctcagtgaccccagaaggaggaaggagggaggtgatgttatggggctgaattgttcccccaaaacccatatgtggaagccataacccccagtacttcacaatgtgactgtgtttgaaaatggagcttagacagaaatgaataagttaaaaattgaggccctcatccaatctgactggtgtcattggaagaagaggtaatccagacatactaagagacaccagggtcacacacacagagaggagagactgtgtgaggacacagggagaaggcggaactgaaaggaatccatttctgttgtttaaggccctgagcctgcggtccactgttatggcagccctagcaagcagatacaatgaatccccaaacctccttccttcctccttattgcctctggctggggctccctactggccaaaccccaccaaggccagagggcaggggtgtgagtgggtacagtcaagacaggccagcctcccaggtccagagcagggtgacgaaggtggagagtaggcccagagcagcagacaggggtgtctgcacacctgggaggggtgtggagtcgaggtaatgtatcttcagatggatgacccaggctcctgacaacaccaggttcacaaataggacacagaacagcatggtgaaggcaggccaacatctggaccaagattgggagaaaagggaaacaatgacaatggttggtaggactgcagctgatttgttttccccaagcttttattttatttatttatttttttccgatatggttatgttgttttagactaaaaagagccaatccagaggcagacttttcagacgaaacagcttaatctagcctgagggcagggaggctgttggggcagaagggtggtggacgggggcaggcagcacccttgaattgcttaagctccatcagagaagagatatgcgtgtctcctgtgcccttcgcccctgggttctctcatgataaaggatagaccaagagcgtgaccttctgggtatgatgggtgcttcccccagccccggactccgtctcaacatgggtccaggcacccaaggcacagctctgagaggaacaaaagcttggggagctgtcctaagtatccctcacccctcgcttcttccccagagtcctggggagacatcatttgtgacatctgttgcctggtgttcttgccttaggttcacaggcatgtgagtttcctctctactggatgagaccggtggggctgtgggctgcctgccccagcccttctccctctccatctctgtggctggagcccttgctccggtgccccaggactgtccaccagcccatcctccctgtcagcccctggccctccacaccttggttttgcagactaggaggtgctgcctgttctcctctgttctcatggggaccgcaggcaggaccacatggcggggggttctaaagacatacccatccccctttcacagggttgctatggggacacatgctcagctgcccccaaaccttcttaacctctggaaattgctcaaatggaaacattaacacaggaccaccctccgcacaaagcccatatgagggcggaatgagagtcaggacggggctctgagcacaagacatgcaggtgtgtctgacagacggggtgggggcagataaacctcaaagcaaccaggtcaccaagtcctgggagagagcccagctttgtgatacccacatagtagctcacaactatgcgccagatccaaatgggctcctgtgccactttctttaacactcctggccactccatgagggacgctgtgatctccacattgtacagacaagaagccgagttgcagagtgatcgcataaagcccagggacacgcagatagtcatggtgcagccaggatttgaacctaggcagattccagaggctgctgtctgagttgctggtctgagtttccttctagctaaaggtagcagggaaagaacttaccgcctataggaaaacaagatctattttcataagcaacaagaagccctcatgaggacgacaggactggtagtgtgaagtccaaaagagctccctgccttctcctggcttaggtccacctctgtctgcaagctgatgagtctggccctgaagcgagcagatctttcttaccccactggggcttagctggactcggagctcctgcagccctgacctccccagggcatctgcgactcccagattcagcctaggacttacagagctccctagaaggaattaattgtggacagcagtggggacggtccattttcagtcttcctaatcttctctgggagctgtttgacttgaattctttgacctccagggtttttacagaagcctacttgtttaggatgtgttaatcaaataagggatgcaagctgtgagtcctcttgggcagaaatggactttttctgaccactgctgcactcctcccgctcagcatctcagaagtggacatgggaccaagcatctcagtggtctcagctgtctggcttggaggtgggggggagagggagaaggtatagccctttaatcttcctctttttgacaccagaaagtatcccacattaatcagtcccacattaatcagctccttcctcaggcaaaagctgagctgggaaagtcccagatggggcagtgtccccatcattcattattactaagccagagatatccagcagggatcagtggagttttcagtcctcatcttatatccagagagcacaagacattccaaggcaaaactagatagtggacacttaataattcatcgattccaacacaagcttgcatgtaacatatctcataataccaagtaactcataaaacaagcagtgagagacatttatcggacaaacacttcctcagatcacttcatctgcctgagagaacagacctgccataatgggccttatccagcaaaacaggctgcgtgttgggagggcaaaatggctgttacatgagcccacccatcttgccatcaaagggatgtatttgcaccctgagtggtagcagggacagcttgctatgtgaaagctataagacaatgacacctcagagaccaagccacccagctatgggatcgtctagtgtgggagagagaacatacttttcctacccctttttcagtgaggcaagaagcagtagggatgtttttaactgccattaacagaaaacccaactcaaaggggcttaaccaataagaaatttattatctcctataacaagaaaccgcaaggtaggctagctccagaaaaggttaatttagcagctcaatggcatcatcaaggacccagatgctatcctcagtgctgctgtcagcttcaggctggcagctggatgcctatagtggttccatgcacaatatccagagcgtctcgggagaatgaaatgagaaaccttcccaaagtaccccttatagacttcttcttgaatctcactggccaggattgggtcacaagcccatgcctaagccaatcacaggtaagagaagtggaacggctctcattggcttgaaccaatcgggatccaccttcaggggctacagatggccgcagctgggctaaagcccgaggctggctgggagaaggcggaagcccgaataaaatcagtctctgttggtgaggaagaaggtaaactccagctgagaagaccaaccccaggagctaacagatagcgggaactcaatacatagagttattttctttaagtgacttgccaaagggcacagagctataagtggcagaaccagaactcaaatccagaaagagaacaaggatgctaaagataaactgggcttagttcacagctgctcccatgacagtccccatggtggaggggcctcttcctctgggagtccggctgttttgtcaccctgaaagtgaag

SEQ ID NO: 463859 - DNA, 2048 bp, Homo sapiens
ggacacaaagtaaaagcgctgccagttcatttaggagtccaagatgcatcataaatacccatatttgaatatggatttggaaatgtctaaattttatcagaacattacctttggttctgttatgtccttgaactacatcactggagttcaagcaggatttgtgtttcagatcagcaaaacatttccttttctgaggctttttcaattttgtctcattcgaataatattaaactacttaaaatgtcaacaccaaaaatccagcagtacctgtagactagatataaatgcctatggaaccacagatctgaacaggagcagccctgtcacaacagcctccaaaggacagagagtgaaccacagaggaaattcgaatgcatgtacagtgggttccattaccagggagcctgagcttgggacaagaggagctcatcaccaccagaaaatactaccaacatgcccaagagtttgtttcccatacttttaaagaaaaagaaaaatggatggttctgaaatcacctgggtttgttttattacattatatcttctggcaagatcagtgatggcagatgtgattcagcaatagaagcatggctgtactggaggggactgacaagaacgtttgcagtcggtagtgttcctcagtactcatcaatttgtgagccacaagaaattctagctctggaggcggatggtgggagtgaagcggaccagccggccattccctgttgcctacctgtggtggctctgcccagtcatcggtgtccactgttcagcatgcattctttatggacaatcttattcaagaaaatagttgcaaaagagcaagacaaaattcaaatgatgtacacttgaacacttgcctacagaggtgacagttgccccaaaaagtttgctgtaaagtttggaggaggaagacacttcctgtcttgaaatataaatatgagtatcaaaaatatctgagcgatttcgtcaatatttcaggcagttgttggaatgatttgtacatgaagagcctgaattctttgctgaactggtaatgggtagatacagtctaatacatcactatttttgtaaaaacagatttgatagtgcagcaaccttcgagcattctttaatcctggaactccaccatccaccctgaaaacattggaaaagaatacacaacaaaaaacacacaacctaaaacacacaacctaacaaaaaaacttcctaatgtgtacaaatgagaacactatcttccttactgtagtttgatttctaccaaattctaattttaagccagcagacaaacaggttgtcctatctattcccttaggctaaggctaaagggagaaacaggcatctcatttctaactcctggtacatttggacttcgggcctctagagcaccaaaaagtttgatgggaccacgccaagggggtcccctgtaaccaggagttggttaatatcctcccatccctcattcagacagggaacagaggcaaaaaaaaaaaaaaaatagcagggcaacaaacgctgccttctgcaaatgctctgtaataaattgttctttcagtggtgcagaagacggatttttctttcctttgcctctttcctcctttgcggggaagcaccaatgggcggcttgctttcccacctggccctggctgcctgtgcccataaatttgcctatgcaatgcctgtttacgggtcgctgatggaacatggagacggtgcattttgtaagcgccgggtagataatcatggtaattgatgtttggagctgtgagctcctaggagcacagggtctctttctcccagtgaggccctgctctctgttatcagcccagcccataattaaatatcactcttttacaatatgtttcaggctccttaatgagtctaaagcagaaatagtcacctctttcccctcggagctttatttgcttgttattaaacaatgttattgagctgccttctttccctgtgttgccaaacctgcatcatttccgttttataattgcacaattagagcgaaggctttgcttccatacatcagcaggccctgc

SEQ ID NO: 463860 - DNA, 5823 bp, Homo sapiens
gagtcggagctcggcctctccccggcacgttctcagctgctcctggttcagacccagcgagggagccgcgagcgaggctcaccgtccccggcgtgcaggatccggggctgctgagcgctcgctcccgcgtgtccggcgcttggagtccccgcggcaggagaggagtcgggacactagagctccaggggcgcctgtgggctccagggcctccggcttccccagtccccttcagctaaagccccagagacgtgctcagccccaggacctctgcggaacaagatccggattgagaagccactgcaactaccgaaatgggcagcaaaaccttgccggcgccggtgcctatccacccttccctgcagctcaccaactactccttccttcaggcagtgaacggcctgcccacagtgccttcggaccatctgcccaacctgtatggtttcagcgcgttgcacgctgtgcacctgcatcagtggacgctgggctacccggccatgcacttgccgcgctcttctttctccaaagtgccgggcacggtgtccagcttggtggatgcgcgcttccagctgcccgcctttccctggttccctcatgtcattcaacccaagcccgagatcaccgctggaggcagcgttccagcgctcaagaccaagccgcgctttgattttgccaacctggccttggcagcaacgcaagaagatccggccaagctcggtcgcggggagggcccaggctcccctgcaggtgggctgggtgccctcctcgacgtgaccaagctgtctccagaaaagaagcccacaaggggacgtctgccttccaagaccaagaaggaattcgtctgcaagttctgtggccgccacttcaccaagtcctacaacctacttatccatgagcggacgcacaccgacgagcggccctacacctgtgacatctgccacaaagccttccggaggcaagaccacctgcgagaccacagatatattcactccaaagagaagcccttcaagtgtcaagagtgtgggaaaggattctgccagtccaggactctcgctgtccacaagacgctacactcacaggtgaaggagctcaaaacctccaagatcaaatgctaaatagaacctgtgggtcacaaggaccctaggcccagcggccctctcctccatagggaccagaagcctgactctggcgggcagcgggagaggcgctcgctcgggaccttccacctctccaacattgtcccctgggtccctggcgcacgcggcacttcagagccccgcccggggccgcgaccccgaccgtccctgctgctcccctaggacgcggctaaactcttggccaaaaggcggtactcacgtggcggaagggaaactgcattaaaaaaagaacgaaagctccgcggagccgcagcggcgcctctcccagaagtattactttttctattgttattttatacgttttcttttttatttttgtctttgaccatataagcttgtaactctgactgcggagagtgagtggagagaggagaggcaacgaagtccttagcactggcagctcccacctcctcctcccgcccctgcccccacccccggagcctgcaaaagtgtaatccctgtatctgcttcagcctcctgccctagggaccgcggggcagccccctcccagctcttgcagctcagctggcggccgtgggctccgggactaggagagcgggacggggacctcgggcctggggtctgcagggggcccggcctccgctgccgcgacactgcgagggagcagccagccaagagccgggcgttatattgcgattggcactttatgctgaccatcggtaacggacatttatcactggagttttttttttttttaactattaaataaacggttattttacaggcattgcaggatgggtaatttccctcctaaacgcaggaaaccggttgggtcctctctttgagaggaccaggtttctctgctggacgccagcgtgtccccctcctaccaccccgtcttattaggatgacagggctgagatgtgtggagcaacgtcctctctcccggttaggtctgcctccgccccaccatgtattgattttcctacttttctcctccgcctcagggatagggtctcagccttcccactcctcaccgctaaagtgctgtgagtttacgaagaacctaagcctgaaggcagaaaaccgcccgtgagaaatcccagagtctctgggtgctgagacagcgtctctgggtgctgagatcgcttagggtgcaagaagagaagagaatgtctttccccaccctaaccgaaggcctccctcctggcctctggctttggggtgggaaggacccgccctcacagagcctcagagctgtaatatttcccgttccccgggtctcaacactcgggtgcaaatacacaatgaccgctgcctccccggaaccccaaaccaacatcactccctcccttagggtccctcagacacaattctctgcttgggacttgtcccctcctaggatcgaggctctgcacccgcgaagattccctacaattttaaagccttgtcaggaatggtgggggcgggcgccctgggaggcccgggacgcttaggaggaaaaattcgagtccgccttccataagctgaaccttccctggggtgtctagttttcccacagttagaagccaggccgccggggctcttctccttggggcaaggcggggctccccccagctccagcgccctgaccgcgggaccgcgcaggcggtggcgcccgcggcctttcccaagcgcaggatggcctctccagcttcagcgcccggagcgcggcggccgcggatgacaactggactataagcttccctgctgcaggcaccaaaaatcccagcctcaagccgggccctgctggctgagaaagcggcaggggatgcagaagttaaaacgctctgggctttcaccaccccatccccacctcctccgggaacgctcctgagtcctgtgcgggctagaacttcgaggcccgggaacccaactgggcactggaggctggccctgccggcgcggaccagccctggcctccacgctcagagccacgctgccccctgctggccagccctggaggggcggcccaggacttggcacctcaaggggtcttgcccgcaacctcgcgaaaccaccaagcatctatgtgtttggtcccaaaatcttgactggccccaggacccactgtggatgaggggcagggcgctgctgagtctggtctggtctgagggatcttcattagttgggcactatcccaatccttcttccaagcagttcacaaggtcgcgcgcggcccaggattatgcccccattcctgagaactggggcctctgagtgcgtggaagtggggctagccagtaggtttgcgggtggtgtagacggtctgcgcccaagcggcgcacgcaggttgtggtgtggtttgtgcctgaccatagcttgtactagggtcaactgcagaatcttccttggtttctttatgaagccccaggaggctgcgggccatggttgctccaaaacaaccagagtgcatgggtgaacacacacacacacagggtgcccttcctagtcccttggctctttctgggatgctatccttggggttgtctatggctgctcttccctagcccctgacatccctccacctcccagaacacatcattccacctccctgaagatcgagcctctgcagttcccggggcctcaggaagctacaaatgcggtgaaatggggaggtttgccagccacgttaatcctttttgggtcaccccacctccagcactgtgaaaacccacccagtccaaggtctgcaactgaatgtcagtatcaagtgtgcatcctcaaaataacagatttccagtgcagaattttaaattggggatggggaatggagggtgggacaggatgatgcgcagcaactccctggccctctcagaatgcccctatttgctctactgatgtttgctgttatcccggtggactcagagatcacgtctccctgcagcttgttctagtgattcatagactgtgcagaaacagtaactacaggtggaaaggccggctgggcctgtgggccatccgaccctatccaggctacaattcccaggtgatgtggttggttgatgtggttggaaactagtgccccagtttcctgctcatactcagtgtgggttgcacaaaaagtgcaattgagagggtcagaaatgttgggtgggtttccttgcctgccccaatttttcccccaatgcatctctagaaagtcccagctcttgtctcctctccagacccccatcacaataagcttcgctggtcccagtgactgtgtggcgctcagcgttgctggggctatttttcaggagaaaaagaggccgatggtgctggccaggtggagttcagctggggcccttctcaaagctgctaggcctgaagtttttgtgtacggctggggaagctatctggcctaggacagcctcttgggcagggagggcggaaggtgccagagaccctgggcacagcccggaactgccagatgctgtctccggtaagatatcaggtgcttccagggaaaagaacagcttgcaggagcttcttcctgggagagagtgtttcaggttctaccccctatttccagagtgtagttaggggttagggacccactaaaaaatgttttcccgcgtacttccttgccgcggaattcactgctcacattgtggggagggacgcaatgtgatgctctgggactccctgacgtgacctcagctcccagaacctgaggacctgatatcctaaatcccctagaatcttggtgtccccatagccggctcaaaagagtcccgtcccacctctcagagcgcgaagcctctgtgacgtcatggtctcctcccgcagacaccgtgacgtcacagaggcctcgggctggaacacaaggcttgaatgaggtccacagaggcattccattacgtaacttcgtgacgtcacagatgggccccgcctcgggctaacatatccacacctctcagccccgccccgccccgccccgcgaatcggcccaggcaggcgccacgaatcggttcgtctccactaacacgatccgcagacccgaagcgttggcagctgtcctgagtgaagggcggtgccctgcagcgtcctcttcttgaatcagtggtttagagtggtctccctgcccgcggggtttcagggcagcagttgccgcggcgtactcatcccacccacttctgcgcccactatggccgcgcccactgcggccccgccctcctctcccactgcgcaagcgccacgcgcaggcgcaaaaggaactcgcaggccagtgctgctggtgccggagtccggaagctgacggcggtgcgtggaaatcgtcgcggagttcagtgttttgcttttggggatcacaaactcaggggcacactggcccggcgggcgcatccagccgttggcgtatgtgtgggcagaaaatgcagacgagaaagtgggtggcgcttggctaatgcgggctggagcccttgacttggagtgcccagtccagcgccgcggtcctacagaggcccctgggatctgagctggcgagggtggcgcggcgggtcctacccaaggccagaaagttcgctgcggtcccagctcttttgggcagcctctctgaggtagagctctcagacggtcttcagcccggtggaacgccctggtgtcccactccacccgttcatcccgacttcctgggccgtctctagagcccagttggtagttgggcccagttggcatatgtttcaga

SEQ ID NO: 463861 - DNA, 1902 bp, Homo sapiens
gagtcggagctcggcctctccccggcacgttctcagctgctcctggttcagacccagcgagggagccgcgagcgaggctcaccgtccccggcgtgcaggatccggggctgctgagcgctcgctcccgcgtgtccggcgcttggagtccccgcggcaggagaggagtcgggacactagagctccaggggcgcctgtgggctccagggcctccggcttccccagtccccttcagctaaagccccagagacgtgctcagccccaggacctctgcggaacaagatccggattgagaagccactgcaactaccgaaatgggcagcaaaaccttgccggcgccggtgcctatccacccttccctgcagctcaccaactactccttccttcaggcagtgaacggcctgcccacagtgccttcggaccatctgcccaacctgtatggtttcagcgcgttgcacgctgtgcacctgcatcagtggacgctgggctacccggccatgcacttgccgcgctcttctttctccaaagtgccgggcacggtgtccagcttggtggatgcgcgcttccagctgcccgcctttccctggttccctcatgtcattcaacccaagcccgagatcaccgctggaggcagcgttccagcgctcaagaccaagccgcgctttgattttgccaacctggccttggcagcaacgcaagaagatccggccaagctcggtcgcggggagggcccaggctcccctgcaggtgggctgggtgccctcctcgacgtgaccaagctgtctccagaaaagaagcccacaaggggacgtctgccttccaagaccaagaaggaattcgtctgcaagttctgtggccgccacttcaccaagtcctacaacctacttatccatgagcggacgcacaccgacgagcggccctacacctgtgacatctgccacaaagccttccggaggcaagaccacctgcgagaccacagatatattcactccaaagagaagcccttcaagtgtcaagagtgtgggaaaggattctgccagtccaggactctcgctgtccacaagacgctacactcacaggtgaaggagctcaaaacctccaagatcaaatgctaaatagaacctgtgggtcacaaggaccctaggcccagcggccctctcctccatagggaccagaagcctgactctggcgggcagcgggagaggcgctcgctcgggaccttccacctctccaacattgtcccctgggtccctggcgcacgcggcacttcagagccccgcccggggccgcgaccccgaccgtccctgctgctcccctaggacgcggctaaactcttggccaaaaggcggtactcacgtggcggaagggaaactgcattaaaaaaagaacgaaagctccgcggagccgcagcggcgcctctcccagaagtattactttttctattgttattttatacgttttcttttttatttttgtctttgaccatataagcttgtaactctgactgcggagagtgagtggagagaggagaggcaacgaagtccttagcactggcagctcccacctcctcctcccgcccctgcccccacccccggagcctgcaaaagtgtaatccctgtatctgcttcagcctcctgccctagggaccgcggggcagccccctcccagctcttgcagctcagctggcggccgtgggctccgggactaggagagcgggacggggacctcgggcctggggtctgcagggggcccggcctccgctgccgcgacactgcgagggagcagccagccaagagccgggcgttatattgcgattggcactttatgctgaccatcggtaacggacatttatcactggagttttttttttttttaactattaaataaacggttattttacaggca

SEQ ID NO: 463862 - DNA, 1095 bp, Homo sapiens
agggggaggcgggtcgggggagggcaggggaacggaaggggtacccggggagcatcctaagggaacctcttcgcttaaaagggcggccgctgaagtggctctgagaacaaaggagttaacactcggactccacaggtggcccggggtggccctggaggagcccgcctttaccttgccctagcccaccggcgcgtcccgcagttccgaactaaacgcgccaggccgggaaggctcgggctgtctgaagagaggcgtgacctcgcctacaccagatccaaggcgcacataccgagacacccctcaacctcactcagcagtgccgtttccaactccgcggcagagacagcgcctggcgaccccggggcctgcgtccccgcccggtcagcatcgcaggtgttacccaaactctgacggtccctttaagaactcacccggagtcgcgccctccgaagctgagccgccctcggccagcgctgcaggccccagcttataaatctatgaaggtgtccaggtcctgccagactccgctgcatcttttgctttcactccagcagggtagcagcatgctgcctgtgccaaggcaatcactaaaaggaaaggatttaatgctgtcaaaaaagcttatgccagcttaggctgcaggaagaggaacagtgtcaagtatgttgaaagtggacatattgggagctgcagtcatcaaacaggcttattctgtgtacccagtgggcaagtacagtcaatggatgaaaattcaaccaatggacaaacacaggaagtttttccttaacatgagttgtcagaaactgtccaaaattccaaagagctgcctcaagaattgtgcgatgccctttgtggtgctggtatggcatggtgtcaaacgtgtgggctccggcgtcatcctgcttggactggaatgtacgttaaagaactctggagagtcaatcaggtttgtgtgtgtgccacaatttcttgaggtggagaagctgagcttttttcctaaacaccagaatggaagaggtcataggacagtaagaatgattaataatgcccttagactctggtgcttatatgacccctagccaagtcacttcaata

SEQ ID NO: 463863 - DNA, 1217 bp, Homo sapiens
ggcaggtggggacccaacccaacatgagtgacaaccagcccgccctaccaagtcatcctgaggggcccagggacttcaacatcaagctgttctacttcaggttctccaagctctgcctgcgggatgacagtggccaacagagattaagcaagaacttctgcgggttggtggcatatgcagcccccgagctgctgcagggcatcccctaccagcccatggtgtatgacatctggagcctgggcatgatcctctacatcatggtctgcagctccatgccttacgactccaacatcaggaagatgctgcgtatccagaaggagcaccgcgtggacttcccacactccaagaacctgacagacgagtgcaaggacctcatctactgcatgctgcagcccgacgtcagccagcggctgcacatccatgacaccctcagccaatgctgggtgcagcccaaggcacagggactgccctctatggtcttcaacaaggagggggaaagctcccagggaactgaactcttgtggacccctgaacctggctctgccaagaggtctgccaccaagctggagcctggggaacagacacagcccgagggacagcctgagacaaaacctgaggggttggcaatgcaaatgtccaggcagtcggacatcctaggcttccccagcaagccgtcgaccagggagaaagaggaagggccccccagcagcctccagagatgcgcacctagtgagccgtttgtggcccagtgtgccagcggcgaatgagatggagctcacgccttcaggcccaagctctgaagaagtcaaggcacaaaccagagaaggaagacggtcccggatgagccgctgttttcatcaatttcttctctctccccttgaacttcataaccgacattgctaaaggagcaataaatcactatattaatgcagatgccaaagtgaatgtctttgcctcaactgactagtcctgggctcccctccactggtttcccactcagattgtgcaatgattcctcgtttgcttgggaaaacacatcccaacgtgcccagtccagaccatgacctcaggcccaggctggggctggggcttgggctggggctgggagagacctggaggggcaggggccagagctgaaagggccctccatggcctgtccgtgctcctgccaagccacatcccttcaaaccgtcacatgtaatagctatcctcatccc

SEQ ID NO: 463864 - DNA, 981 bp, Homo sapiens
caaccatctgaatgaacacctcctgtcagcgacggcattccaaacctgaaaaattggttcaggccaagacaggaagggagggtcagacatgcctcattttaccctactccctttcttttgctttctggaactttgtggaattctttttttcccaaatattgtcaatctgtggttggttgaatccacagatggcaaacccacaaatatggaggacaaactatgtggtaagcacatgctgaaagttgttgaatattattttcacccttatgaaaggcctgacataagcagtttcagattgtgtgaattcttaattctgcagtgggcttccaacagtggttctgttgccagtgataacaaaaacctgggagagaccttgggcggttttatctttcaggggtcagccaagccagtgggaagcctacgacattcccctgggtcacttagtgaactcctactctttcatcaggcctcacttgaacatgacttcctccagaagccttcccagacatctttgagctagaaagtcagaagagtagaattggaacccagctcagtctgatgccacatcctttgttgtttccattaaatcagagaatttcttagtgctgagaaactattctggaacttacaacaaaggcaagtgggaagggagtcgcctggaatttgatctctgtagatgcctttttcatttagtttatttttcatttttatctgttgctttgctcttatcaaatacagataaatagcagctgctactggtgctgttgattgcgatttctgtttgaaaatggaatcttgagcatctgttctctccttttatattttactgtgagagaaaatctatttttttcaaaaggtaattcatacacatggtaaaaatttaaacaatataaaaacctatttttaaaaaacatatactcttgagtatttctgtgtactttgctttcatcactaatacatctttaagtttattccatattg

SEQ ID NO: 463865 - DNA, 6150 bp, Homo sapiens
aatattgaggcctgaggaatttctcccatgagttatcacaggagcccaaaggacatgtaactgattccccaggatggaagagtgacttccacaagacctaaaaataaccgaaccacttaatactcggaacatagcctctcccacccgcccccaccacggcccacccactagccagcaagataaaggcagctgctggggctggcaggggacagagacctggagccagggcagcaagaaggtgtctgttggagccagcagaacagaaccaatttgaacaagaacctccagaggaacgacgaaccctgagaccacagctgctacagaccacaaacaccccatcagccaagagagacccttgcatccagcctctaccctgctgaacatctagatctaaggctcccaatcccatcctcatctctgccccttcttctcagaaggatggccgacacccagacacaggtggcccccacaccaaccatgaggatggcaactgcagaggacctgcccctccctccacccccagccctggaggacctgccactgccgccacccaaggaatccttctccaagttccatcagcagcggcaagctagtgagctccgccgcctctacaggcacatccaccctgagctccgcaagaatctggctgaggctgtggccgaggatctggctgaggtcctgggctctgaggaacccaccgagggtgacgttcagtgcatgcgctggatctttgagaactggagactggatgccattggagaacacgagaggccagctgccaaggagcccgtgctgtgtggtgacgtccaggccacctcccgcaagtttgaggaaggctcctttgccaacagcacagaccaggagccaaccaggccccagccaggtggaggagacgttcgtgcagcccgctggctatttgagacaaagccactggacgagctgacagggcaagccaaggaactggaggccactgtgagggagcctgcagccagcggagatgtgcagggtaccaggatgctctttgagacgcggccgctggaccgcctgggctcccgcccctccctgcaggagcagagccccttggaactgcgctcagagatccaggagctgaagggtgatgtgaaaaagacagtgaagctcttccaaacggagcccctgtgtgccatccaggatgcagagggcgccatccatgaggtcaaggccgcatgccgggaggagatccaaagcaacgcggtgaggtctgcccgctggctctttgagacccggcctctggacgccatcaaccaggaccccagccaggtgcgggtgatccgggggatttccctggaggagggggcccggcccgacgtcagtgcaactcgctggatctttgagacacagcccctggatgccatccgggagatcttggtagatgagaaggacttccagccatccccagaccttatcccacctggtccagatgttcagcagcagcagcatctgtttgagacccgagcgctggacactctgaagggggacgaagaggctggagcagaggccccacccaaggaggaagtggtccctggtgatgtccgctccaccctgtggctatttgaaacaaagcccctggatgctttcagagacaaggtccaagtgggtcacctacagcgagtggatccccaggacggtgaggggcatctatccagtgacagctcctcagcactgcccttctctcagagtgccccccagagggatgagctaaagggggatgtgaagacttttaagaacctttttgagacccttcccttggacagcattggacagggtgaggttctggcccatgggagtccaagcagagaagaaggaactgattctgctgggcaggcccagggcatagggtccccagtgtatgccatgcaggacagcaagggccgcctccatgccctgacctctgttagcagagagcagatagtcggaggtgatgtgcagggctacaggtggatgtttgagacacagcccctagaccagctcggccgaagccccagtaccatcgacgtggtgcggggcatcacccggcaggaagtggtggctggggacgttggcacagctcggtggctttttgagacccagcccctggagatgatccaccaacgggagcagcaggaacgacagaaagaagaagggaagagtcagggagacccccagcctgaggcacccccaaagggcgatgtgcagaccatccggtggttgttcgagacttgcccaatgagtgagttggccgaaaagcaggggtcagaggtcacagatcccacagccaaggctgaggcacagtcctgcacctggatgttcaagccccaacctgtggacaggccagtgggctccagggagcagcacctgcaggttagccaggtcccggctggggaaagacagacagacagacacgtctttgagaccgagcctcttcaggcctcaggccgtccctgtggaagacggcctgtgagatactgcagccgcgtggagatcccttcagggcaggtgtctcgtcagaaagaggtttttcaggccctggaggcaggcaagaaggaagaacaggagccccgggtaatcgctgggtccatccccgcgggttctgtccacaagttcacttggctttttgagaattgtcccatgggctccctggcagctgagagcatccaagggggcaacctcctggaagagcagcccatgagcccctcaggcaacaggatgcaagagagccaggagactgcagctgaggggaccctgcggactctgcatgccacacctggcatcctgcaccatggaggcatcctcatggaggcccgagggccaggggagctctgtcttgccaagtatgtgctctcgggcacagggcaggggcacccttatatacgaaaggaggagctggtgtcaggtgaacttcccaggatcatctgccaagtcctgcgccggccagatgtggaccagcaggggctgctggtgcaggaagacccaactggccagctccaactcaagccgctgaggctgccaactccaggcagcagtgggaatattgaagacatggaccctgagctccagcagctgctggcttgcggtcttgggacctccgtggcaaggactgggctggtgatgcaggagacagagcagggcctggtcgcactgactgcctactctctgcagccccggctaactagcaaggcctctgagaggagcagcgtgcagctgttggccagctgcatagataaaggagacctgagtggcctgcacagtctgcggtgggagcccccggctgacccgagtccagtgccagccagcgagggggcccagagcctgcacccaactgagagcatcatccatgttcccccactggaccccagcatggggatggggcatctgagagcctcaggggccaccccttgccctcctcaggccattggaaaggcagtccctctggctggggaagctgcagcaccagcccaattgcaaaacacagaaaagcaggaagacagtcactctggacagaaagggatggcagtcttgggaaagtcagaaggagccacgactacccctccggggcctggggccccagacctcctggccgccatgcagagtctgcggatggcaacagctgaagcccagagcctgcaccagcaagttctgaacaagcacaagcagggccccaccccaacagccacttccaaccccatccaggacggtcttcggaaagctggggctacccaaagcaacataaggcctgggggtggaagtgatccccggatcccagcagcccccagaaaggtcagtagggaagagcaagcactacccagagggctgcctggggggtgggtgacaattcaggatggcatctacaccgctcatcccgtgaggacctttgacccacctgggggtgtccagctttctcagagggaaccccagtcaaggcacagggagactgccctctcagtccaggctccccgcccactccagggaggcccaggtcagagtactgggccagggcgggaggagcctgggggctgcacacagatggcctgggggccaccagggaaggcgatggcagaagtctgcccagggggcctccaagctgcagagaccaccctgaagactgcccctctaggccgccacattctggcctctgggccccaagctgcaggtgccagcccgcacccccataatgcctttgttcctcctcctcctactctcccagctgctgtgacaggacctgactttccagctggagcccaccgtgctgaggactccatccagcaagcctctgagcccctgaaggacccccttcttcactcccacagcagccctgctggccagagaacccctggagggtcacagacaaagaccccaaaactggaccccaccatgcccccaaagaagaagccgcagctgccccctaaacctgcacacctaacccagagccaccctcctcagaggctgcccaagcccttgcctctatctcccagcttttcctcggaggtggggcaaagagaacaccaacgaggtgagagagatacagccatccctcagccagccaaggttcccactactgtagaccagggccacatacctctggccagatgtcccagtggacatagccagcccagcttacaacatggcctcagcaccacggcccccaggcccaccaagaatcaggctacaggcagcaatgcccagagctctgagccccccaagctcaatgccctcaaccatgatcccacctcaccacagtggggccccggcccctcaggagagcagcccatggaaggttcccaccaaggggcccctgagagccctgacagtctgcaaagaaaccagaaagagctccagggcctcctgaaccaggtgcaagccctggagaaggaggccgcaagcagtgtggacgtgcaggccctgcggaggctctttgaggccgtgccccagctgggaggggctgctcctcaggctcctgctgcccaccaaaagcccgaggcctcagtggagcaggcctttggggagctgacacgggtcagcacggaagttgctcaactgaaggaacagaccttggcaaggctgctggacattgaagaggctgtgcacaaggcactcagctccatgtctagcctccagcctgaggccagtgccagaggccatttccagggacctccaaaagaccacagtgcccacaagatcagtgtcacagtcagcagtagcgccaggcccagtggctcaggccaggaggtcggaggtcaaactgcagtcaagaaccaagccaaggttgaatgccacactgaggcccagagtcaagtcaagatcagaaatcacacagaggccagaggtcacacagcctcaactgccccttccaccaggaggcaggagacatcaagagagtatttgtgccctcctcgggttttaccttccagccgagattctccctcctccccaacatttatctccatccagtcggccacaaggaagcctctagagactcccagctttaagggcaaccctgatgtctcagtgaaaagcacacaactggctcaggacataggccaggccctgctccaccagaaaggtgtccaagacaaaactgggaagaaggacatcacccagtgctctgtgcaacctgaacctgcccctccctcagccagtcccctgcccagagggtggcaaaagagtgttctggagctacagacggggccagggagctcacaacactatggagccatgagaaccgtgactgaacagtatgaggaggtggaccagtttgggaacacagtcctcatgtcttccaccacagtcaccgagcaggcagagccacccaggaacccaggctcccacctcgggctccacgcctcccccttgctgaggcagttcctgcacagcccagctgggttcagcagtgacctgacagaagctgagacggtgcaggtgtcctgcagctactcccagccagctgcccagtgaggcccaccgcctcccaccacacctgccacctgttcctggcctccactgccccaggactgaagtgggtacctgcctcctgtacactggagcaaggaccaagaggaaatggcatcttcagaggattactgtgggccatttccctttcgcagttctttcaataggcccagttcttccaaatgg

SEQ ID NO: 463866 - DNA, 6016 bp, Homo sapiens
aatattgaggcctgaggaatttctcccatgagttatcacaggagcccaaaggacatgtaactgattccccaggatggaagagtgacttccacaagacctaaaaataaccgaaccacttaatactcggaacatagcctctcccacccgcccccaccacggcccacccactagccagcaagataaaggcagctgctggggctggcaggggacagagacctggagccagggcagcaagaaggtgtctgttggagccagcagaacagaaccaatttgaacaagaacctccagaggaacgacgaaccctgagaccacagctgctacagaccacaaacaccccatcagccaagagagacccttgcatccagcctctaccctgctgaacatctagatctaaggctcccaatcccatcctcatctctgccccttcttctcagaaggatggccgacacccagacacaggtggcccccacaccaaccatgaggatggcaactgcagaggacctgcccctccctccacccccagccctggaggacctgccactgccgccacccaaggaatcccaccgagggtgacgttcagtgcatgcgctggatctttgagaactggagactggatgccattggagaacacgagaggccagctgccaaggagcccgtgctgtgtggtgacgtccaggccacctcccgcaagtttgaggaaggctcctttgccaacagcacagaccaggagccaaccaggccccagccaggtggaggagacgttcgtgcagcccgctggctatttgagacaaagccactggacgagctgacagggcaagccaaggaactggaggccactgtgagggagcctgcagccagcggagatgtgcagggtaccaggatgctctttgagacgcggccgctggaccgcctgggctcccgcccctccctgcaggagcagagccccttggaactgcgctcagagatccaggagctgaagggtgatgtgaaaaagacagtgaagctcttccaaacggagcccctgtgtgccatccaggatgcagagggcgccatccatgaggtcaaggccgcatgccgggaggagatccaaagcaacgcggtgaggtctgcccgctggctctttgagacccggcctctggacgccatcaaccaggaccccagccaggtgcgggtgatccgggggatttccctggaggagggggcccggcccgacgtcagtgcaactcgctggatctttgagacacagcccctggatgccatccgggagatcttggtagatgagaaggacttccagccatccccagaccttatcccacctggtccagatgttcagcagcagcagcatctgtttgagacccgagcgctggacactctgaagggggacgaagaggctggagcagaggccccacccaaggaggaagtggtccctggtgatgtccgctccaccctgtggctatttgaaacaaagcccctggatgctttcagagacaaggtccaagtgggtcacctacagcgagtggatccccaggacggtgaggggcatctatccagtgacagctcctcagcactgcccttctctcagagtgccccccagagggatgagctaaagggggatgtgaagacttttaagaacctttttgagacccttcccttggacagcattggacagggtgaggttctggcccatgggagtccaagcagagaagaaggaactgattctgctgggcaggcccagggcatagggtccccagtgtatgccatgcaggacagcaagggccgcctccatgccctgacctctgttagcagagagcagatagtcggaggtgatgtgcagggctacaggtggatgtttgagacacagcccctagaccagctcggccgaagccccagtaccatcgacgtggtgcggggcatcacccggcaggaagtggtggctggggacgttggcacagctcggtggctttttgagacccagcccctggagatgatccaccaacgggagcagcaggaacgacagaaagaagaagggaagagtcagggagacccccagcctgaggcacccccaaagggcgatgtgcagaccatccggtggttgttcgagacttgcccaatgagtgagttggccgaaaagcaggggtcagaggtcacagatcccacagccaaggctgaggcacagtcctgcacctggatgttcaagccccaacctgtggacaggccagtgggctccagggagcagcacctgcaggttagccaggtcccggctggggaaagacagacagacagacacgtctttgagaccgagcctcttcaggcctcaggccgtccctgtggaagacggcctgtgagatactgcagccgcgtggagatcccttcagggcaggtgtctcgtcagaaagaggtttttcaggccctggaggcaggcaagaaggaagaacaggagccccgggtaatcgctgggtccatccccgcgggttctgtccacaagttcacttggctttttgagaattgtcccatgggctccctggcagctgagagcatccaagggggcaacctcctggaagagcagcccatgagcccctcaggcaacaggatgcaagagagccaggagactgcagctgaggggaccctgcggactctgcatgccacacctggcatcctgcaccatggaggcatcctcatggaggcccgagggccaggggagctctgtcttgccaagtatgtgctctcgggcacagggcaggggcacccttatatacgaaaggaggagctggtgtcaggtgaacttcccaggatcatctgccaagtcctgcgccggccagatgtggaccagcaggggctgctggtgcaggaagacccaactggccagctccaactcaagccgctgaggctgccaactccaggcagcagtgggaatattgaagacatggaccctgagctccagcagctgctggcttgcggtcttgggacctccgtggcaaggactgggctggtgatgcaggagacagagcagggcctggtcgcactgactgcctactctctgcagccccggctaactagcaaggcctctgagaggagcagcgtgcagctgttggccagctgcatagataaaggagacctgagtggcctgcacagtctgcggtgggagcccccggctgacccgagtccagtgccagccagcgagggggcccagagcctgcacccaactgagagcatcatccatgttcccccactggaccccagcatggggatggggcatctgagagcctcaggggccaccccttgccctcctcaggccattggaaaggcagtccctctggctggggaagctgcagcaccagcccaattgcaaaacacagaaaagcaggaagacagtcactctggacagaaagggatggcagtcttgggaaagtcagaaggagccacgactacccctccggggcctggggccccagacctcctggccgccatgcagagtctgcggatggcaacagctgaagcccagagcctgcaccagcaagttctgaacaagcacaagcagggccccaccccaacagccacttccaaccccatccaggacggtcttcggaaagctggggctacccaaagcaacataaggcctgggggtggaagtgatccccggatcccagcagcccccagaaaggtcagtagggaagagcaagcactacccagagggctgcctggggggtgggtgacaattcaggatggcatctacaccgctcatcccgtgaggacctttgacccacctgggggtgtccagctttctcagagggaaccccagtcaaggcacagggagactgccctctcagtccaggctccccgcccactccagggaggcccaggtcagagtactgggccagggcgggaggagcctgggggctgcacacagatggcctgggggccaccagggaaggcgatggcagaagtctgcccagggggcctccaagctgcagagaccaccctgaagactgcccctctaggccgccacattctggcctctgggccccaagctgcaggtgccagcccgcacccccataatgcctttgttcctcctcctcctactctcccagctgctgtgacaggacctgactttccagctggagcccaccgtgctgaggactccatccagcaagcctctgagcccctgaaggacccccttcttcactcccacagcagccctgctggccagagaacccctggagggtcacagacaaagaccccaaaactggaccccaccatgcccccaaagaagaagccgcagctgccccctaaacctgcacacctaacccagagccaccctcctcagaggctgcccaagcccttgcctctatctcccagcttttcctcggaggtggggcaaagagaacaccaacgaggtgagagagatacagccatccctcagccagccaaggttcccactactgtagaccagggccacatacctctggccagatgtcccagtggacatagccagcccagcttacaacatggcctcagcaccacggcccccaggcccaccaagaatcaggctacaggcagcaatgcccagagctctgagccccccaagctcaatgccctcaaccatgatcccacctcaccacagtggggccccggcccctcaggagagcagcccatggaaggttcccaccaaggggcccctgagagccctgacagtctgcaaagaaaccagaaagagctccagggcctcctgaaccaggtgcaagccctggagaaggaggccgcaagcagtgtggacgtgcaggccctgcggaggctctttgaggccgtgccccagctgggaggggctgctcctcaggctcctgctgcccaccaaaagcccgaggcctcagtggagcaggcctttggggagctgacacgggtcagcacggaagttgctcaactgaaggaacagaccttggcaaggctgctggacattgaagaggctgtgcacaaggcactcagctccatgtctagcctccagcctgaggccagtgccagaggccatttccagggacctccaaaagaccacagtgcccacaagatcagtgtcacagtcagcagtagcgccaggcccagtggctcaggccaggaggtcggaggtcaaactgcagtcaagaaccaagccaaggttgaatgccacactgaggcccagagtcaagtcaagatcagaaatcacacagaggccagaggtcacacagcctcaactgccccttccaccaggaggcaggagacatcaagagagtatttgtgccctcctcgggttttaccttccagccgagattctccctcctccccaacatttatctccatccagtcggccacaaggaagcctctagagactcccagctttaagggcaaccctgatgtctcagtgaaaagcacacaactggctcaggacataggccaggccctgctccaccagaaaggtgtccaagacaaaactgggaagaaggacatcacccagtgctctgtgcaacctgaacctgcccctccctcagccagtcccctgcccagagggtggcaaaagagtgttctggagctacagacggggccagggagctcacaacactatggagccatgagaaccgtgactgaacagtatgaggaggtggaccagtttgggaacacagtcctcatgtcttccaccacagtcaccgagcaggcagagccacccaggaacccaggctcccacctcgggctccacgcctcccccttgctgaggcagttcctgcacagcccagctgggttcagcagtgacctgacagaagctgagacggtgcaggtgtcctgcagctactcccagccagctgcccagtgaggcccaccgcctcccaccacacctgccacctgttcctggcctccactgccccaggactgaagtgggtacctgcctcctgtacactggagcaaggaccaagaggaaatggcatcttcagaggattactgtgggccatttccctttcgcagttctttcaataggcccagttcttccaaatgg

SEQ ID NO: 463867 - DNA, 993 bp, Homo sapiens
gaaagagggactcagatcacctggaattatggcaatgtcttgcaaggatacttctgaaaatcgggtgtcacgggaagctgaactttgcatcccagttctgaaacatacagcaacctcatggagacagatgcatcactcggcattttggggcggtagcgagttcagtgacctgccagatttcttagcattaacttgaaagagaagacacttatttgatttgatttgatttctactagtcaagtgggcacctggattaagcagactctcccccaggcaccccggaggcctctgacatcccttatgtccagcccagacatggcctttctgtggcctcagcgtatctgcccagtccaatcggctatagccagaataaaaaggttggtttccctccacccatgagccatgccatacatgacatgcatgtgaataatgatctgagctgtgttatctggcagaggtgatgctcacggctctgctccatgttctgggacatgactggactctcattttagggaggaagatccaagagagggaaggaggctttcccagctactttcctgctaaccagggcagaggctggtctacatccccctatccaggtggcccctgcagtcatggcttttctgcttctagaagccatccctgaggtcagctgaatttagacctatggtatctccagtacagcactttgtcatctgtttgtgataatagttttccaattcttgtcacttccgccagaacatcattgcagaactcaaaatacattgcatcatacaaaatgaagtggagaattaaggtaattatccaattattaaaaaccatttcttattcgttagctaaataactcttcaagtctccattttacatgtgttcctctgatgtgaatttgaccctggcctatttgtttttcagtaaagtccaaaatccaaaatagcccaacagaaagaccccctcccagtattccacagcatcagtaataaagctccttatcag

SEQ ID NO: 463868 - DNA, 1171 bp, Homo sapiens
agaaactgcagcatgtcacaaccaaagccattgctttttgcaaatgggaaatctgatgcccaaagagaagaagagcagatcccaggccttttgctcactgctctgccttactaatgccatattggctaacctcatgagtgcccttgccagagctggtgagcccttaaaagaaactgggcctttgctaaagagaaagagtcagaggaatgctcttgctggccttgaaggtgcaatgccttattgtggaaagggccacatggcagagactagcagccagcctctaggagctgggaacggactcactgacagccagcaaggaaagcttgatgaaattgtactggtcaagtcagtcaaaccagtcaagcggacaagaaagagggactcagatcacctggaattatggcaatgtcttgcaaggatacttctgaaaatcgggtgtcacgggaagctgaactttgcatcccagttctgaaacatacagcaacctcatggagacagatgcatcactcggcattttggggcggtagcgagttcagtgacctgccagatttcttagcattaacttgaaagagaagacacttatttgatttgatttgatttctactagtcaagtgggcacctggattaagcagactctcccccaggcaccccggaggcctctgacatcccttatgtccagcccagacatggcctttctgtggcctcagcgtatctgcccagtccaatcggctatagccagaataaaaagggaggaagatccaagagagggaaggaggctttcccagctactttcctgctaaccagggcagaggctggtctacatccccctatccaggtggcccctgcagtcatggcttttctgcttctagaagccatccctgagaacatcattgcagaactcaaaatacattgcatcatacaaaatgaagtggagaattaaggtaattatccaattattaaaaaccatttcttattcgttagctaaataactcttcaagtctccattttacatgtgttcctctgatgtgaatttgaccctggcctatttgtttttcagtaaagtccaaaatccaaaatagcccaacagaaagaccccctcccagtattccacagcatcagtaataaagctccttatcagatctaatttaaatctttcttgaaacaacttaag

SEQ ID NO: 463869 - DNA, 2288 bp, Homo sapiens
ggctcacctgctggcttcacagaagcattaatgcatggggtgtcaggcgtcttggctccggagaaagctgcgtggcaagaggcggccagtgatagcgttctgcctcttgatgatcctatctgcgatggctgtcacccgctttcccccacagcgtccatccgccggcccagaccctggtcccatggagcctcaggggcatgttgtgctcctgagggaggatgaggttggagatccaggaaccaaagacctgggccacccccagcatggcagtcccatccaggagacacagagtgaggtggtcaccctggctcccccatggctgacagaccacgatgtgcagatgctccgtctgttggcacagggggaggtggtggacaaagccagggtccccgcccatgggcaggtgctacaggttggcttctccactgaggctgcccttcaggacctgtcctctcccaggctcagccaactctgttcccaagggctctgtggcctgatcaagaggcctggggacctgcctgaggtcctgtccttccacgtagatcgtgtgctggggctgcgccggagcctacctgctgtggcccgccgcttccatagccccctcctgccctaccgatacacagacggtggagcaaggcctgtcatctggtgggcacccgatgtgcagcacctgagcgacccagatgaggatcagaactctctggccttgggctggctgcagtatcaggccctgctggcacacagctgcaactggccaggccaggccccgtgcccgggcatccaccataccgagtgggcacgcctggcgctcttcgacttcctgttgcagggttgcagcgtgggactcttcctcagctgccaacccctgctgtggggacaagtctctgtagccaaagcatacacagtggaagaagtggccaaagaacctaagtcaaaatctgggggatcgaagtcctctgctatgtcttcagacaggtccctggctgaaaatggagcgatggccgaggagaagccaactccccagatgaacgggaccccaggtgatgacagggctcccagccactctgaaagtgccttgaataatgactctaaaatgtgcaatacaaatcctcattgaaatgcactaagtacagacagcccttgccacacagaagctgctctggaggcagctgtcttaaataaagaagagtaaacttactttttatagagagtgaaggatgctggaagggtaaggtatttaggaatatctggagagaaagaacctgcagttatgtacattttgtcctttctgtaagagaaaaatgaggactttggaaattcagatccctctttgatatcagagatttaaatgatacatttttaattttaaccagttatagtcaaaatgctacaataaaacaaaaaagagaaagaaaatgaagagcatttgactcccactcttaaaatgaagtacacataagctttaaactggttatgacaaaagcctatagttgtgtttcttgaagtataaagaaaacaaattttggcagtctttaagtatatatagcttaaaatataatttgtagcatttggcaccatatgtatgccattatatttgattttgcattactgtttcacaatgaagctttctttaagactttgatttttatgattatgaaagaaataaggaacaaccacagtttttctttcttaaatttcatcactgttgatgtggttcttttgtgttaaaaaaaagtgcaactatcaaaactaaaaaattatagagtaatattgccgttctgctgattttaaatatacatcatacgtactttacgagcaggttaaatggagataaagttgaaatcatagaagatgcaaatgacctttcaaaatcaacacaatgtgttctgaaacttttcgtgactcacaccatgcatctgtgatcaatgaactatgtggttttgaatcggatgtagacctttaatactactacttgagctaaacttctgcatggttcgtaatttttgaagtgtgtggttaatattgtgcatgttatcatcctttcttccattcttatcagtatgtgcccatttgcaaaacaaaaatactaataatcagtaatagtcctagaaaagatgttaattctgtttagtcattgactgatattgcgctaaccttgaaattgtatgattattgacctctgttgcatttattctaaagccccccaaaaattatctagccgtttcgaatatcaacattacactggtgtattcactgctttatgcattattgttctttgttgctgtttt

SEQ ID NO: 463870 - DNA, 1972 bp, Homo sapiens
ggctcacctgctggcttcacagaagcattaatgcatggggtgtcaggcgtcttggctccggagaaagctgcgtggcaagaggcggccagtgatagcgttctgcctcttgatgatcctatctgcgatggctgtcacccgctttcccccacagcgtccatccgccggcccagaccctggtcccatggagcctcaggggcatgttgtgctcctgagggaggatgaggttggagatccaggaaccaaagacctgggccacccccagcatggcagtcccatccaggagacacagagtgaggtggtcaccctggctcccccatggctgacagaccacgatgtgcagatgctccgtctgttggcacagggggaggtggtggacaaagccagggtccccgcccatgggcaggtgctacaggttggcttctccactgaggctgcccttcaggacctgtcctctcccaggctcagccaactctgttcccaagggctctgtggcctgatcaagaggcctggggacctgcctgaggtcctgtccttccacgtagatcgtgtgctggggctgcgccggagcctacctgctgtggcccgccgcttccatagccccctcctgccctaccgatacacagacggtggagcaaggcctgtcatctggtgggcacccgatgtgcagcacctgagcgacccagatgaggatcagaactctctggccttgggctggctgcagtatcaggccctgctggcacacagctgcaactggccaggccaggccccgtgcccgggcatccaccataccgagtgggcacgcctggcgctcttcgacttcctgttgcagggttgcagcgtgggactcttcctcagctgccaacccctgctgtggggacaagtctctgtagccaaagcatacacagtggaagaagtggccaaagaacctaagtcaaaatctgggggatcgaagtcctctgctatgtcttcagacaggtccctggctgaaaatggagcgatggccgaggagaagccaactccccagatgaacgggaccccaggtgatgacagggctcccagccactctgaaagtgccttgaataatgactctaaaatgtgcaatacaaatcctcattgaaatgcactaagtacagacagcccttgccacacagaagctgctctggaggcagctgtcttaaataaagaagagtaaacttactttttatagagagtgaaggatgctggaagggtaaggtatttaggaatatctggagagaaagaacctgcagttatgtacattttgtcctttctgtaagagaaaaatgaggactttggaaattcagatccctctttgatatcagagatttaaatgatacatttttaattttaaccagttatagtcaaaatgctacaataaaacaaaaaagagaaagaaaatgaagagcatttgactcccactcttaaaatgaagtacacataagctttaaactggttatgacaaaagcctatagttgtgtttcttgaagtataaagaaaacaaattttggcagtctttaagtatatatagcttaaaatataatttgtagcatttggcaccatatgtatgccattatatttgattttgcattactgtttcacaatgaagctttctttaagactttgatttttatgattatgaaagaaataaggaacaaccacagtttttctttcttaaatttcatcactgttgatgtggttcttttgtgttaaaaaaaagtgcaactatcaaaactaaaaaattatagagtaatattgccgttctgctgattttaaatatacatcatacgtactttacgagcaggttaaatggagtgtgacttatgttgcttaggaaggcaaaatccagagctttaagacactgggtttttacaggaaatacaggaaccaaatataagggctgtccatataggccacggaagtatacccttatggtattcaggaggtctggactttg

SEQ ID NO: 463871 - DNA, 787 bp, Homo sapiens
aacaatcttacctaattttatggtctccatgggtgtctgaaaagaaacattatatgggtcacacaactgttggtggtgattgtggtggtggtgctggtggtggtggtggtggtgatggtggtagtggtggtggtggtggtggtggtggtagtgatggtggtgatggtggtggtggtggtggtggtgatggtggtggtggtggtggtggtggtagtgatggtggtgatggtggtggtggtgacggtggtggtgatgatcatggtggtgacactgacaatgatggtggtggcaatggtagtggtgatgttggtggtggtgatggggataatggtggtgatggcagtcatggtggtgatggttgtgatggtgacagtggtggtgatggtgaaggtgatgatgatgttgatggtggtggtgatgttggtaatgatggtgatggtaacggcgattgcactcaaatcccaaaatatgaattaaagactttaactggtatgttagatacttgagaaatctactctacctgtcttctctaagtctcaattcctatccctcaaatgttgattaatctgattacaatgatattgttctttgattaaaacctgaaagcacatttgaaagaaagtaaaagaagtgaagttaaagcaactgcttgagggatggatgtatttctctccatggatgagtttttaattctttattattattttcatcacagtccttgtcacagaaaggatttcaaagtatcaatagtcctttaggttgctgtattataaaattccaaggatat

SEQ ID NO: 463872 - DNA, 1054 bp, Homo sapiens
gggatggaaagtcacccgtaaggatgctaacatgccttggaaccatgctgcttgaggctctggactgcatcctaccaccaactcgtccaactgacaagcccttgcacctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggtatgtacatgcgttgtaaacttcgaagaaggaagtttgggcccttggttttttgggtggggttaagatagtaaaacgcttttgggaatgtcccattcgcttggccttcagttgaaaaagggggctatatgggagaactttagcatagatataacgcagagggaatgttaaaaatgtttttaaatttatataaaa

SEQ ID NO: 463873 - DNA, 1709 bp, Homo sapiens
gaaaactacccccaaaagccaaaatgggaaaggaaaagactcataccaacattgtcgtcattggacacatagattcgggcaagtccaccactactggccatctgatctacaaaggcggtggcatcgacaaaagaaccattgaaaaatttgagaaggaggctgctgagatgggaaagggctccttcaagtatgcctgggtcttggataaactgaaagctgagtgtgaacatggtatcaccattgatacctccttgtggaaatttgagaccagcaagtactatgtgactatcgttgatgccccaggacacagagacttcatcaaaaacatgattacagagacatctcaggctgactgtgctgtcctgattgttgctgctggtgttggtgaatttgaagctggtatctccaagaatgggcaaacccaagagcatgcccttctggcttacacactgggtgtgaaacaactaattgttggtgttaacaaaatggattctactgagccaccctacagccagaagagatatgaggaaaatttgctaacatgccttggaaccatgctgcttgaggctctggactgcatcctaccaccaactcgtccaactgacaagcccttgcacctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaggagaatgtttgtggaccacttggttttcttttttgcgtgtggcagtttaagttattagtttaaaatcagtacttttatggaaacaacttgaccaaaaattgtcacagaatttgagacccattaaaaagtcatgagaaacaaaaaaaaaaaaaagggggggtaaagatcccgggggcaagtagcgtaccgtttgaagggccaaaggggataagaagggggggtaaacgggaggaaagttcgggtttggaggacattggggggatggacacaggagcggaataaattgggactcgggagtta

SEQ ID NO: 463874 - DNA, 1946 bp, Homo sapiens
gagggacactcttaggcctcttactgagggcgggggtcccggagagccatggacagggcaacgctctactaggctccttggttcatcccagatcagcccttgggcccctggcatctaaggcagcaaaaaggcaaggggacaccgcccggggtggggcacgccaccgcgacaatgcctcttggccttgggtggataatggcacccctgggcaaaccctaggggcggggcccagaggcgaggggcttccccaatcagtctccgccctagcgccctggacttcggccccattccattgggtgagggtgggggcacgaaaagaggagcgggcttgcggccccaccgtgtcccgcctcctcagtccccagcgactcgcaggggctggtggggctggggtccagctgccgtgctcccctgccctgcgccgcgccgcgcgtcttggtaggcgctgcgctgccggggccgggtcctgggccagtgcaactccgcccccagccgtatccagcggactgtcctccgccgcgcgcccggcacagcatggggaggcgctgctgccggcggcgcgtgctggcggccgcctgtctgggcgccgcgctcctgctcctatgcgccgcgccccgctccctgcgcccggcatttggaaacagagccctgggctccagctggcttggtggggagaagagaagccccctgcagaagctctatgacctggatcaggacccgcgctcgaccctggcgaaggtgcaccggcagcggcgcgacctgctgaacagcgcctgtagccgccactcacgccggcagcgcctgctacagccggaggacctgcggcacgtgctggtggacgacgcgcatggcctgctctactgctacgtgcccaaggtggcctgcaccaactggaagcgcgtgctgctggcgctgagcggccaagcccgcggcgacccgcgcgccatctccgcgcaagaggcgcacgcgcctggccgcctgccctcactggccgacttcagccccgccgagatcaaccggcgcctgcgcgcctacttggccttcctgttcgtgcgggagcccttcgagcgcctggcatcggcttaccgcaacaagctcgcgcgcccctacagcgccgccttccagaggcgctacggtgcacgcatcgttcagcgcctgcggccgcgcgcgctccccgacgcccgggcccgcggccacgacgtgcgcttcgcggagttcctggcctacctgctggacccgcgcacgcggcgtgaggagcccttcaacgagcactgggagcgcgcgcacgcgctctgccacccgtgtcgcctccgctacgacgtcgtgggcaagttcgagacgctggcggaggacgcggccttccggtcctggaggtcctgtggccacgcggggcaagtgcctttccgacaagacccccggggaatgcaggtgctgccggccccaggacccctcttcaagagccactgcgtgcactcacctggccgccgggccagcgggcgcagggcacacctggccaggcttgggggcagcccatctcaggtggccctgcacgcgtgtgcctgcctcggcctgtcgcctgaggcctgcttcctccacttgctccagctgacaggcacctctccaggcccctgtggcccgagcctgtgtcctccccacctcgcccaccctggcaaggacagctgcggccaaggacgaaagccctcccttggctggcctcacgatggggccgtcccgggagccagctcagccaagccctgggccttgtgctgcctcccacctttgtgcgtgtgtgactgtgagagtgtgcatgagtgtgtgagtatatgagtgagagtgtgcataacgttccctgggtgctatggtttgaatatttgtcccctccaaaactcatgttgaaatttaatccacaatgtggcagtcttgagagatgacccaaccattaagac

SEQ ID NO: 463875 - DNA, 1131 bp, Homo sapiens
aagtgaccatgagcgacgagagagcaagagagggagaggaattcctcctaggcagtgagatgaaggaagaagagccttccctgaaagggcgtccactcccctgttcgcaggtcaaccctttcagagaccgtatctgcagagtgttctcccacaaaggcatgttctcctttgaggatgtgctgggcatggcatctgtgttcagcgagcaggcctgcccaagcctgaagattgagtatgcctttcgcatctatgattttaatgagaatggcttcattgatgaggaggatctgcagaggatcatcctgcgactgctgaacagtgatgacatgtctgaggacctcctgatggacctcacgaaccacgtcctgagtgagtcggatctggacaatgacaacatgctgtccttctcagagtttgaacatgcaatggccaagtctccagatttcatgaactcctttcggattcacttctggggatgctgatgtagcggcaaatacctgacatggcagcctcgagggagaccacaggaatcgaaccccctccagcactggagggagctggtttgaagtatgactttgtactgggcccacactcacctctagaatattgtttattagataaaagaaaaagcttttccttagcccatcagatcatcgctttttaaatgcagggtcatacatggtactttttattaagaactgccctttccagggcttcagtgtgccagcgatgtcaagcaggctggggtggcaatctttctgagggaatagttcaaatctcaacccatgtcatagcagggggccaagccaaatgggatgaaggtccctagcaagatacatgtccttccctcccttcatcaaaacccccgacccccagcacctcacagttcacagctgcacagagacgtgcacatagcagccattccagccggtgcccggctccccactccccttctgagggagaaggcatcttggccctgattgtgggaccagcaattagagtttatttgctttgctattcagccaagccctggaatgaatttggccaccacagacagcctttggggtccagctcctcagggactttgagacacagaagaagccccccattgggtttttcttatttacactg

SEQ ID NO: 463876 - DNA, 1207 bp, Homo sapiens
atggggcaatgcttgaggtatcagatgcactgggaggacctggaagagtaccaggccctgaccttcctgaccagaaatgaaattctgtgcatccatgacaccttcctgaagctctgccctcctgggaagtactacaaggaggcaacgctcaccatggaccaggtcagctccctgccagctctgcgggtcaaccctttcagagaccgtatctgcagagtgttctcccacaaaggcatgttctcctttgaggatgtgctgggcatggcatctgtgttcagcgagcaggcctgcccaagcctgaagattgagtatgcctttcgcatctatgattttaatgagaatggcttcattgatgaggaggatctgcagaggatcatcctgcgactgctgaacagtgatgacatgtctgaggacctcctgatggacctcacgaaccacgtcctgagtgagtcggatctggacaatgacaacatgctgtccttctcagagtttgaacatgcaatggccaagtctccagatttcatgaactcctttcggattcacttctggggatgctgatgtagcggcaaatacctgacatggcagcctcgagggagaccacaggaatcgaaccccctccagcactggagggagctggtttgaagtatgactttgtactgggcccacactcacctctagaatattgtttattagataaaagaaaaagcttttccttagcccatcagatcatcgctttttaaatgcagggtcatacatggtactttttattaagaactgccctttccagggcttcagtgtgccagcgatgtcaagcaggctggggtggcaatctttctgagggaatagttcaaatctcaacccatgtcatagcagggggccaagccaaatgggatgaaggtccctagcaagatacatgtccttccctcccttcatcaaaacccccgacccccagcacctcacagttcacagctgcacagagacgtgcacatagcagccattccagccggtgcccggctccccactccccttctgagggagaaggcatcttggccctgattgtgggaccagcaattagagtttatttgctttgctattcagccaagccctggaatgaatttggccaccacagacagcctttggggtccagctcctcagggactttgagacacagaagaagccccccattgggtttttcttatttacactg

SEQ ID NO: 463877 - DNA, 3367 bp, Homo sapiens
gggaccgtcttccttctctggtttgtgccttgacttcttcagagcttgggcctgaaggcgtgagctccatctcattcgccgctggcacactgggccacaaacggctcactaggttcttggagtgtgggaagtccacgcggtgctccttctggatacgcagcatcttcctgatgttggagtcgtaaggcatggagctgcagaccatgatgtagaggatcatgcccaggctccagatgtcatacaccatgggctggtaggggatgccctgcagcagctcgggggctgcatatgccaccaacccgcagaagttcttgcttaatctctgttggccactgtcatcccgcaggcagagcttggagaacctgaagtagaacagcttgatgttgaagtccttgtcgaggagaaggttctaacacttgaggttctggtgcatgatgtccaggtcgtggcagtatttaatggctgaggagagttggtggaacatcttgcacgccatgtccttgggcagggctccctggcactcaatgaactagttttttttctgcccctggctgggctcccagggcagatctggggctgggggctaaaggcggggactggatgccaccctgagcactggtggctgctctgaggacagtacaagcagcaggggcagcactggagagtgtggccattgttttttctggcagtggagcccctctgctgtgccaggctctgtgtccagcacttgttccgggctatgccctaggggaaaccggcaggccctccctcctccacagcggttcggccttaaaaagacccctttggggcgcacttttgggctgctcacgggacctgagcttgcaggtgtgaagacccttggagtcccagccaggttcccacttcgttctctccgctccccacccgcgcgacccctcggcgccccgccccatgccccgcgcctttcgatgtccatccttgccgtcccgcgcccgccgtccctaaccggcgtccagagaccctactcccttcggtggccccgccgctcaggccccggccccggccctgcctctctgcttaaccaatggcacgcctcactccgtatggtcccgcccttcccttagagcccgcccctcagtccccgcccttaggtccccgccctccgccgtcgcgaccttaggcctcaccctcttcggagggctttggctctggccccgccccccatcttgacggtcattggcccgcgcctgcgtcgcgggcgggaggcggggcggggcggcgcggcgcggagccgagcaggacggccgccatcttgcgcgcagctggagtcggtgcctgaggttgcagccgagagtgtgcgccagcccgcggcccagccgaagctctttcccgccgcctctccgcgcctcgcccaggttcagctccgcctgaccctccgcttggcacggtcccctgaccctcagtccggcctggtccggccttccagccgccccggggacgatgaacggaggataaatggtgcccaaggcagacagcggcgccttcctgctgctcttcctgctcgtgctcactgtcaccgagccgctgcggccaggtgcgccgcgcgatgggggcggtgtgggggctgggcggcgagcggggccggggtcgccccgggacctcctttcacccgcggcgccctcctgcaggggccgcgcctggggcaggggcgggcggggcctggctcgcgggccgcctggcactctctgcggacgcctgctggagcttacctgggctcgcggcgcctcggacttcgtgcagctctgctgtccaggatgttgcctctgggcccttcccgggagcggcggcggccaggagctacgccacgggcgcaccctctcgccagtccagcgtcggagtcgggctggggacagtggctctcaggggcacctggtttcacagacgtcctcccagcagtggcctagtgccagcctctcagtcctggaaactcctcgcctggacagcggtggttgtggctgtcattcagtgagacgttgcgctaaggaagtcctcaggtcccaccgggcctagaggaggcaccaggagtcagcctagcgttgtgtggccggcgcgagcgtcccgggagcagagacctcgccactgtgcggggcccttagccgtgctgcagtactgagtgattatatcctcttagcagcggtggccggtgatttgtttgtgcaggtgtccttctagcagtgacggcaggcagggagttcctctgcctctcttggttgttggcataaggacgacccgattggcatttagtagtttcttgactctaagtggaatgcatcagtgacaacatttaaggaccccgtagatagctcttgactgattagatgtcttttccttgtctgcagagtgggctcggtaatcccgagagaccagttttgggccaacagttcattgagcagagtgatgcatgggcttggctgcctctggtgggggtggcgaggaggatgagagccttgtggcagtcctgcaaaaatgccttgggaggatgggatccgggggtaggggacatggctgtggagccagctggcctgggccccaccctgcccatgggctatggtttgctggcctactgccacttcctcaatggcctctcaccctttggtcccacagagctgcggtgcaaccctgggcagtttgcgtgtcgcagcggcaccatccagtgcatccccctcccctggcagtgtgacggctgggcgacttgcgaggatgagagcgacgaagccaactgtccagacgcccctggtggtcctcacctgtcagtgctgctgggccagcttccccgttcaccatcagtgtgggagaatcagtcactctcacctgtgtctccttgctgtgttcctgtgctggggaagcagcagcgtggcactctagtggtgctggaggcaggaggggcacatgtgctccgagctgcacaggtcatggagcccagagtcggagcagatgtggctctgggtgctacagtgacccctgcaccaggtccccagctgggctgtgaggcagggctgctcgggccccatggccctggtggaggtggaagaggccccccagcttaccaaaggctggccctccgcgggaagagggacattctctactgtcagaggcaggcctgagaggtctgtaagggttctgtcctgtgctatgcgcattccccagcctggcccccagactctcccccaggacactgtctgacatcagcatcatcttgacagccaagcccttccccttcttgctggcaaaggcctgtgtctgtgctggcaggtttccatggtgggcccagaatgggcattgaataaacgtggggttcatcttgtctttctgtgagcaattttaccag

SEQ ID NO: 463878 - DNA, 1367 bp, Homo sapiens
tcatcacttaagtcaaggaccggccatttacacttcttttttggtggaatgtcatcagttaaggtggggcagggcattttcacttcttttgtgattcttcagttacttcaggccatctgggcggtatatgtgcaagtcacaggggatgcagtggcttggcttgggctcagaggccctgacataaggggtgattaaaatttaaagccattggacctgaggaggggcatttgctgactataagataatgacaaaaggggagataagaagaagtttaataagactctttgagttgcaagtaacggtcatccgatttgaattggcttcatcaaaggggaaattcactagctgggtactcatattattgataaaaaagattgaaaaatcaaacaaagagtcaagcaaggatgtagttggttacaggaagaaactggcaccggaggacttacatgctgctaggactcattccttaccaatcaattatggtcaggggagtgggaccatgaaagaaagtgcagttcccgtgggtattacaggattcgaggtcgggggctggaaggaacaacacccagaagtagaggaaacctcttttattcttagaagaagggaagcgtatttagcagacaaaataattggtttcctctacagatggattaattatttgccaactcacccccctccctgatctgccaaatggttaagtggaatatcctattccaggcatttttttttttttccagatacaaccttagagataatgaagtctattgcacagaaagaaactggaatcaggctgtttattgactgcagagaagtagcgtctcttgaatggttaatggcaattgttaattagattgcttttcctacactgccctgtgtggtggtggatggcatacgtggtaatctgagtgtggtaagcatgaaaagcacagaatgtgtgaaagcagcaacaaacttcacatccatcaaattcttaacatgaaccaggttctttgcttacattcgcataggcatatcggtctggttttacttgtcaggagggactgaagaaagcacaggacgtaagttcctccaagagcattcttggagcagcatctcatcgctgtccttgggtgtagcctcccttttgtgaggttcactccctcagctggaggatgaaccacagtgctgctgcagacctagctgatgtcacagttgttcaaaaggttcctcttgaagaatgaaatccttgggctgccattaggaactgcatgcagttaagccgtataacctctctgatttttagtttctccatctattttataaaataaaacattgaactaaattatctctaaggcctattctattattttttatattattttctaatc

SEQ ID NO: 463879 - DNA, 2072 bp, Homo sapiens
atgtgttttgaaaatatgcgtattatgagatatgaagagtttatatccatgatattcaggctggattatacccaaccactttcagatgaatacatcacagtgactgatacaacatttgttgacattccagtacgattgtacttgccaaaaagaaagtcagaaacccgaaggcgagctgtgatatattttcatggtggtggtttttgttttggaagttccaaacagagggcttttgacttcctgaatagatggacggcaaacacgcttgatgctgttgttgtaggcgtggactataggctggctcctcaacaccactttcctgctcagtttgaagatggccttgctgcagtcaaattttttcttttggaaaaaattcttacaaaatatggagtggatcccacccgaatctgcattgcgggagacagttctgggggcaatttagcaacagcggtcactcaacagaagggaaacatcatgggaagaaagactattttgtttctgattgcaggggtccttggggcatattatgtttatactcctctctcagataatattgaggaactctggtgactggtgtggatagctacacctgtgaaaatggtaacaaatttgctttgtttaattatgactttctgtcaagatgaacagctgatagacttaatgctgttgttgtatcaaccaactcatagaagacccagatgtcaagatcaaactcaagcttcagtctttaatatatcctgcccttcagacgcttgacatggatttactatcacatcagaaaaaactagactctctagttctgtccaaaccattcatggtcaggttctgtagggaatactttaccacagacagatcacttgaaaaagtcatgttcttcaacatgtaccaatggaatcaaaccatctgttcagatttgttaattggagttccttgctcactgagaagtttaagaaaggccacttttgttatattccaactcgtggtagttctgagctagctaaaaaatatccagggttcctagatgtgagggcagcccctttgttggccaatgacaagttacatggtttacccctgtcctatatcatcacctgtcaatatgacatcttaagagatgatggactcatgtacatcacgcgactttagaactctggagttcaagtgacacataaccacagtgaagatggattccatggagcactttcctataatgggcttaaaattgagtatggaatagaaaatcagtatatgagttggctaagtgaaaatctatagtaaaaatgtaagcaatggtttatttaaaatgtataaggctcagaacaggaaacaaattagtgaaaatcaaagggttgatgtttgaattggtctttatcatctgtgacctttctaaggtcctcatagccatagtgggttttggttttgtttttatttattggccgctagcaaattcttctccattttatttattatcctgttattcactcacttctgtgaagatactttagtattttcttctgctaccattactcacttgttaaatctctagtttacagctatagttttttgattgccgaatagtattacagatgagaagaaagttttaaacaaacacgtctgatttgtaaaatgccagttttagtcaacatgaatttagagacttaaaatgtttccctgtgagaactgatatgaaatatgtgccatctcttttaaaaagcatttgcctcaatataatgctgtttgcctgtcactgtaaaatttgcttcttaatacagatctcttccagtactaggataccaacattaatgcaaatgatctttcagttactttagggaaaggcagctctaattgtgtgagaaattagggaggttgaggtaggcacgaagccagcataaggcagtagctccacatgtggcagtggcttatagtcgtgagcgaagcttaagacacggaagaaattatacaaccaaattgaaacacttaaatctctgaaacttcttatgtccatataggcaccgtatgggggaaagaccacaaagaataagccatagtgatcatatggtatgtaaggtttgatc

SEQ ID NO: 463880 - DNA, 862 bp, Homo sapiens
gttctgagggctggaaggacaagatgagggttccagaatggtcatttctggtgaggctcctctccttttccacagatggcccactttgtgctgtgtcctcacatggcctttgctctgtgagtgcccatccctggtacctctcttcttatagagcagtgctcctaaagctggcaaatttgtgtgctcctttccctgaggatcttcctggaagcctgggcaagcctaaacgtgattccatttcccacaatgccacagggtggttcacacagaacaaagctccgcttctttacctaagagtgccaggagtaaaagattattcggctgcttcaactgccggagagcgaggtgacctttgcccccaagtaacagccactcagcaaatagcaccaaatgaagacggagaataacatatagatttgccgtaagaaaaaattgatctaaatccatatatcaaatctgctgatcagagctctagagaaatgcttcacaatccttagcaagcacttgcaggaagtttgggcagaaagaagaccttcctgaagcttatattaataaatcatcttgtcaactgtttctcaatgtggaatgtgttcctcaaaaatctgctgagaaatcagatccccagggatttacgtgcaccttgcgctgtgatgatcagcaagagccccgcctgagtaggtcctgaagggagtctcttcaattaagagtcttcctttttcttttcatataagttgaatagatctacatgtgagcaatattgactgaggttctgcactgtatttgcaaaactagctttgcggggaataaacttgactaactggaaatgatcccatggtaattaattagcatttcaaaaccacag

SEQ ID NO: 463881 - DNA, 1894 bp, Homo sapiens
gtgccatttgatttcctcgtggctgcagtagctttatttcaggaagctgtggtcacagaagagaaccgtgaacccagcgactagtgttcagctcgattaggatgaacccgggcacttagctgcacagctcatcaggcagcatcttgcataattgagaagcttttgctgatggtttcataaaacagaaaaggattattttcttttgtaatggggcttggtcgccgacagctatggcacagtgaacagggccatcaaaagcctctccattcttctggaagctgcagagaaaggggacccagaaacctggtataccagcaaaaaggaaaacataagataattactaacagcctgggctgcctggggaaaaacaggaggtaccatggaccccattctgggaaaaacttctgttttcccatggaaccccaggaattgaaagaaaataaatccctctcaaaatctaaggctcttagtgcgttcaaaggggccttaggtggaggctcctttatcacacccacaggattctgttacatcttctcccgggacaatggcttctctcttcccactgctctcatgtcaaactcagagtctccaaaagagcccgaacagctgcagaagctctttattggagagctgagctttgaaacaactgatgagagcctgaggagccattctgagcaatggggaatgctcatggactgtgtggtcatgagagatccgaacaccaagtgctccaggggctttgggtttgtcacatatgccactgtggaggaggtggatgcagccatgaatgcaaggccacacaaggtggatggaagagttgtggaaccaaagagctactggactccacaaggagtccaaggacccaaaatggacctgttgaaagttgctcagagagctcgctatgaaattggggatcggttgactgcccagtactatcctcgttctggaccattgagcaaagtcagttatctagggcgccgatccaatggcaacgttctgtggatgttcccaatcccacacagcgggaaagtgaccgggcagggggccccgtgcgagaaaggtgcaggttattagctaaagcatttcaagttaattataatctatgttatatcaaatttcaattatggcctggaataatttgactgatgatgatctatcatggagaagtgtggcaagaaacatgatcacctctatgtgtattgcctctggtactatttgtttcactttcctgcaaatattttggtgtttcttcaaattcttaaaagccccatggggatgtgtccatctgtcataggagacacttggacaagaactgtagggtccctgcctttaccagactagaaggtgtagcaaaattgacagagctttggtactggacacaactcaatgtgatggtagtgctgccattttctaactctgtctcctctggcaggtcacttaaccttcctaggcatcagtttcctcagctgtgaaaagggaatattaacttcattacaaggttatcaggaggatgggtaaccaaccatcttcagtctgtatgtctctccaatgcatcctgaatcactgggattcctttgaaaagagaaaatcaaccttcttcttcctgtttcctcctctgtcctctcttcatggatgaataatcatgtctccataccacaggacatttccctctgtgaaaagtttaatttctgcattaaaccacttggcttaaaaaaaaatgaactgggaagacattataactcacattcccctctgtgaaaagtttaatttccataaaccttaaatcacttgacttaaaaaaaaaatgaactgggaaaactctaactgagcaatctcttgaggaaggacaatgtttacagtatgcaaataacctatttgtctgctccccctttac

SEQ ID NO: 463882 - DNA, 890 bp, Homo sapiens
  misc_feature (808)..(808): n is a, c, g, or t
  misc_feature (814)..(814): n is a, c, g, or t
  misc_feature (818)..(818): n is a, c, g, or t
ttcctttcaccctgggctgcggctctgaggctgccgtggccatggagctctggaagctgggctgggggaggaagcctggtggctctgacctcccctggaggcgaaggaggcccagccatgacactcttaacggatgccacgccgctggtgaaggagccccatcccctgcctctggtcccacgtccctggttcctccctagcctctttgctgccttcaatgtggtgctgctggtctttttcagtggcctcttcttcgcattcccttgcaggtggctggctcagaacggggagtgggcctttcctgttatcacaggctccctctttgtccttaccttcttcagtcttgtttcactcaacttctcagaccctggcatcttacatcaaggctccgctgagcagggccccttgacggtgcacgtggtgtgggtgaaccacggggccttccgcctgcaatggtgtccaaagtgctgcttccaccgcccgccccggacttaccactgcccctggtgcaacatctgtgtggaggactttgaccaccactgcaagtgggtcaataactgcatcggtcaccgcaacttccgcttcttcatgctgcttgtcctgtccctgtgcctctactcgggcgccatgctggtcacctgtctcatcttcctggtgcgcacaacccacctgcccttctccaccgacaaggccatcgccatcgtggtggccgtgtccgccgcggtcctcctggtgccgctgtccctcctgctgctgatccaggcactgtccgtgagctcggccgaccgcacctacaagggcaagtgcngacccnttcngggatacaaccccttcgaccaggggctgtgccaagcaactggtatttaaccaatttgtgcaccactgggacc

SEQ ID NO: 463883 - DNA, 790 bp, Homo sapiens
ttcctttcaccctgggctgcggctctgaggctgccgtggccatggagctctggaagctgggctgggggaggaagcctggtggctctgacctcccctggaggcgaaggaggcccagccatgacactcttaacggatgccacgccgctggtgaaggagccccatcccctgcctctggtcccacgtccctggttcctccctagcctctttgctgccttcaatgtggtgctgctggtctttttcagtggcctcttcttcgcattccctcttgtttcactcaacttctcagaccctggcatcttacatcaaggctccgctgagcagggccccttgacggtgcacgtggtgtgggtgaaccacggggccttccgcctgcaatggtgtccaaagtgctgcttccaccgcccgccccggacttaccactgcccctggtgcaacatctgtgtggaggtgagtgcccctctacctgtccaccagccatcgccccacatctggctgggaccaggagcctccctcatacaggggccagggctgggtgtgaagctgttttcaggactgctaaaggccaagggtggcagtaactcccagccacccttggtcactcatgtgttctccacctgcacctgtcctgggaggctggccgttgcctgcagaggtgctgacatgcacagggcatccgcatctgtcctgggctgggtcaggccaggggaggagaggcagccctctgtcccacccctgggctcgctaacacgagatacccaagcccctcaggctggctgcccgcctggtctgg

SEQ ID NO: 463884 - DNA, 1523 bp, Homo sapiens
ttcctttcaccctgggctgcggctctgaggctgccgtggccatggagctctggaagctgggctgggggaggaagcctggtggctctgacctcccctggaggcgaaggaggcccagccatgacactcttaacggatgccacgccgctggtgaaggagccccatcccctgcctctggtcccacgtccctggttcctccctagcctctttgctgccttcaatgtggtgctgctggtctttttcagtggcctcttcttcgcattcccttgcaggtggctggctcagaacggggagtgggcctttcctgttatcacaggctccctctttgtccttaccttcttcagtcttgtttcactcaacttctcagaccctggcatcttacatcaaggctccgctgagcagggccccttgacggtgcacgtggtgtgggtgaaccacggggccttccgcctgcaatggtgtccaaagtgctgcttccaccgcccgccccggacttaccactgcccctggtgcaacatctgtgtggagagttacagtaggatgtgtctcacagaaggccaggccagtcttctctctaaaggtcttctgacaggactttgaccaccactgcaagtgggtcaataactgcatcggtcaccgcaacttccgcttcttcatgctgcttgtcctgtccctgtgcctctactcgggcgccatgctggtcacctgtctcatcttcctggtgcgcacaacccacctgcccttctccaccgacaaggccatcgccatcgtggtggccgtgtccgccgcggtcctcctggtgccgctgtccctcctgctgctgatccaggcactgtccgtgagctcggccgaccgcacctacaagggcaaggcggtttggattctttgagcgatgggaatagagaataactgaaattgttggcttgtgagtctggcttctttcacttagcacaatacattcgagattcattcatgttgttgctcatagcagtcgtttattccttttgattgcccatatagattttgtatccattttgttagatttatatgtatttctttttttgtgctattgtaagcatgttttttaaaatttcaatttccatttgttcattattataaggaaatacaatggatttttttgaattggtgttgaatcctgccattttgctagacccatttattagttccaatagcttttttgttgattctacataggaaatcctgttgtctgtgaaaaaggacagtttcacttcttcttttccaatctgtatggctttatttttttctcttcttattgcactgtcttggacctctagcacaatgtggagcaggagtggcgatcctccttcgtgtctgcaaagtagaaaatgagcaaaaagacaggcaatagcaaacagtcttggtaaggatgtgaagaagttagaaccatcatacattgctactgtgaatataaaataatgtgcagctttggaaaacagttcttcaaaatgttaaacatagaattaccatatgacccagaaattata

SEQ ID NO: 463885 - DNA, 703 bp, Homo sapiens
cggagaaagaagggagtaaaaatgatgcgcgcacaaagaaatttttcccattgcttgccagattcattctttttaggctacccttactccagtccttacctacaccctaaagaactgtatttagctagcaagagaggcattctcaggatacaaccgcatggagggtggaggttagttcccacaggaagggatgatgggcagacaaaaacaacagctgtccacttcatccaacccattggctgtctggtccacaggcattccactataatccacactcctgaagagtgtgtggacaaagatcatgggagactggcgattcacgttcccatacttcccttcatctgctctgtattggagctgattctcagctctcttgccctctggctttttgttaggttctgccaaggggacaaatcacggaagattggattggaacaaaaagcagcagaaggcagtctcctctgctgactttcatgcctgacatcaattttctcaaagagtgaagatagagcatctataccggtatagctgaaggactttggtcagtggcttcctggttctgccactttctgtcagctttcctgctcaatttagagacattctaattcttgttcagaaaaccttgagtccactcctgtaattcttctagtgagtttgtaagccaaccaatgcctactaataaatcccctttagcaccaactag

SEQ ID NO: 463886 - DNA, 734 bp, Homo sapiens
atttaggttgtaatgactgaagcatttggtaggccaatagcaaatattaaaaatgaagagaggcaaagtaaagaaattgagaactacaaatcactgctcaaggaaagagaagacacaaacaaatggaaaaacattccatgctcatggataggaagaatcaatattgtgaaaatggccatattgcccaaagtaatttatagattcaatgctatttccattaaaataccattgatattcttcacagaattagaaaaaaactattttaaaattcacatgaagccaaaaaagagcctgtatagccatgacgatcctaagcaaaaagaacaaagctggaggcatcacattacccaacttcaaactgtactacaaggctacaccttcacagtgcacatatatggaaacaaggaaatgtatacaaggatacaaattctactgagctatacaaatagggatgattggctagtatagctgtattcttagttgctgcctctttgggatttaaggatcctgaagtgttgggaaaaggaagatgacccagtgaagaagatgaaagggacctcaaagaagtcagaagaaaatcagcatagagtcatgttaacgaagctgagtacagaataagattccaaaagagctaaaaatccatctcaattcattcacctcttctttactgaggaataattggttattccttcaatacaatcacaagactctgtttttacaattcacatcaataa

SEQ ID NO: 463887 - DNA, 824 bp, Homo sapiens
tggcttcagagaagagcgaggatcttgccatctcttttacagatccgtggaaggcagagagaatttgggaacctctgtgctataagcatggaaaattgggactcaggtaaaaaggctggttcctggtcgcacagctggtcatgggtgagtgtggtttttgaactctgatatttggattctgagtacagaacatgttatattgtggcccatgccctcctcctgagttcttcagttttaatcatttcattttctactctttttaggcactttggcaaaggagtgtgagttttggggaagctcaaggaagaggtaccaggtagagagagggccagggctgagttcacgggctctttctaaatggaaatgtctcacattcagctgttgtctgcctttgagtcacacagaaccacttgcaggaagaactctagagaatttgggaagaaagggggagaggacagacaaaagatgcatttttctttcaagaagcaggaaaatgtaaggaaaattgaaggtgttctcaagtgtgtctgctgctgcctgacacagggattctggggccctttgtcggacggcctcgctgctcctttgcgcccatgccttcccgggagctggtacagtggctcagagctccagccacatcagcctctcctgaatgacagcatcacaccttcctccatcccatttacatttcaaactgccacccacctgctcttgattaattatttagtaaccctggccacttgtgagcctttcggagctcatatttcacatggattcatgaaggagtagcaagaacaatacacactgagttctgaccgtgagga

SEQ ID NO: 463888 - DNA, 3934 bp, Homo sapiens
gagaggcgggcagcgggtgcgcccgggccgcggcggccgcagagggcgggcggcggccagcatggagcgcgagctggaggcgctggcggcccggcttgcgcgccctgccgagccgcccttccaggcgttggtggaagcggcggggggccgcgggcaggtgctgctggtgggcgagctgtgggagcgcgaacagagccgcgcgctgctgcgggacttcgcacgggcgggcggcgagggcggctggggcggcgggggcggcggcggcggcggcgcgcgccatccgctcgccgctggtcttcgtgctgtgccgcgcgtcgtcgctggccgcccgggagccgcggcgccgcctgcgggagatgctgcgggacgtgcgcggccggcggcgggccggggcggcgctggtcggggtgctggtggccgaggccgggccagaggacgcggtggcgccggggctgcggctgctggaggcgcttaaattggtcctgaataaagattatgaacaaggattttccttgttttggttgcctgaagtcttttaaaaataaataaataaataaaataaacaacctagttcctgttgactttatagattactaaaaaatgtatctattcctgccaagaaatagtttgaactaaaatcagagggaacgtgcagctctttgagtattttgtttggtgctatgtaattgtaattaatttcatgtcattttcattgctttatttcctcaacatggtacctacatcacagggcttttgtaagaattaaatgagataacatagataaaagtaaagcaatcatttttaaagttcggttttaaaaacccacccacttttgcaaatcagactctgtgtttttaatcagacagttgaaactagggcagttgaccgttggggcacttgatttgctaaacgaaatctctcagtcttgtgaagtgggaaccatgtgaccctctgactcaggttttgtgttcttcctagtggaaggagcctgggagaggccaggcctccccggactgctagcctgcttttcctggggtccctggagccggaggaagaaccaggatgttgctgcctgcagaagctcagctcaggaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggacctaaaacagtgtctcccctgggaacctactccccacccagcatttgctaagtctgatcacagggaggttattttgtctctctgtctcggtttctctgagccactgagacagatggctgtccgctttgaggctctgcagagctgtggcaccccatggtgtgtctgcagtgttctgggcacatgcatgggcacccatcgttgagagtgcagctgggaagaactctgaaccagaagtcatcagagctgaggcatggccttgaacatgtcactcagtctctggggcttctgtttcacaaatgcatgagggggccaccagcccagtggctttaaaccaggggcaggttgtccctccaggcagcattggaaatgtgtgtgtgttgagggggtcacagtgactgtgggggcacccctggcatctagtgggcatcccacaatgtgcagaacagtctctgacagcaaagaattggtccattcaatgccaattgtagtacctttgagacattctggctgagccaatgccttctccctgtcagagtcccccagagcagagagggtcaggcttccctggaccttggctcccagagcaagccaaaataaagactacactgttgccttgggggcttgtcgggccagggccaagacggtctgcgtgctgcagggccaggacagaaatagccacacatgccggtgagaacaaagagcctctttctttctcatgttgacatcgactttctgtgccaagtcctttgggtataaggatgctagggaattcctataggcaccaaacagaaggaaagctaggggcttggactactgggtataggacttgctctagctctcaggtcctagcccaagctcaatgcaaacacagcccctccgggctctctgtttctgtgaggttctggaatcccttcctctgtgtccgtgagtctgacagaatcgatgatgttcccttagagctgggaaatccatgtgtttattcacggagggaactcaccattacctcccttgtcttctttgcctgccttggagaaatccagagtcttcggaatggcaaaggcagctcctggatttccctggaggggaggcactagctgagggaagtagctcccttcattcatgatgcacagtttacgcagcagacacacaactgcgcctactatttgctcggtgccctgcaaggtgctgcctaactttgatttgttatttcagctctctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtgggagagggagctttgtttaagtttggaatttgcctaaggcagaagttataaggcttcataaccttttgtatgtattgccaatatttgaaacttgggagattacgtataaaaaatacctagttttctgggtggaggatggggcatgctgtcatctcaagtctgctgcggctcacccccaccacctttaccccctcccccgcccttcccatcccccactgcacttcactcatgtaagacgtctgcccggtgctggtccaggcgggcatgtgagtttgtagcctctgctccaaaggatggtttacacattattttttcattaccttcagtattcctgtgaatggttcaagagagaaagtcttcatttactaagatttgggttctgcctcccaagtgacaatacggggctgagatccctctcagcttctttgagatgtggccaccataagcatcatcgttgtagggacagtctcattgctgtcttctagcagacagaagagttaggtgccagaaaggacaatcttgatggtgggtcccctccctgaaggactttaagaaggcataaaggggttggggtggagggtggcgtgtgaaggaggaggcccttgattaggtcagtggtccctgggagccatcggcgagaggcctccagccgggtgacagtctgggctctcgggtactaatctttctaatatggcagtggttgtggcacttctgacttgaattgataattctcatatctaataaaaccaagaagtacctcgttgatatcttatagaaaacaaaatgga

SEQ ID NO: 463889 - DNA, 1091 bp, Homo sapiens
aggcctcccagaggagcaaatcatgactgctggggagaagaaggcaacacagcttcaaagacctgccccaaatccatcaaaaacagtaagtttgctgggagatttgaatgtttctgttaaaggaataatttgcaattccatcctgagtgggaattctcaagactggatgaaagaagatagagttagaggattcatcccaaaccatgggcatgttggagacaaagatgagcaggttgtacttggcgatgggtttgagaaaggatgtgatttgggagattcttggtggacagtcgcatcactaccactaagcaatttgcattctgtggaccagcccctgaattcctattgccctttgggcattgcatttctggacgcttctagacagtgttcatacttggctgtctggtttcaccaggaactctacccaaaagaggaaacagcaaggagaacatttgctttgtttgtaggagggaagtggtcgagctacaaacaaatctttaggcatctgaggaattgctaagtttctaatttcatatggttgctgacaaggaggtgcagacaaggaccctcttgctttcctcactatggatagtctgttgcctccatctagattctcttatttcaaaaaatatcctctccatgcaattaggagatatttatcgacgctgagaaaccaaagagccgaagaacagattctcttgcagcaagtgtttcacaaagccaaatccccacatatgtagaagattaacagcattaatgagatgaagatgctgaaggaggaaagccgagaaggagtcagaaaacacaggccagctaatttaatctacaagaatttgggatgacctgtaccaatgtctcgctctcttgaacagagattttttttttcctgattgagaaataccattcaagggctgatctgacaagtcttgcctgtttaacagtgaatctgcttaaaatgaggagagtggtctttgggcccagggggcatgtactgtagctacattttaattacagagtagaatcaaattttgttttggaagctgttctaaagtttcctttcaatggcttaagaaaatgtttctagttggaac

SEQ ID NO: 463890 - DNA, 714 bp, Homo sapiens
aggcctcccagaggagcaaatcatgactgctggggagaagaaggcaacacagcttcaaagacctgccccaaatccatcaaaaacagtaagtttgctgggagatttgaatgtttctgttaaaggaataatttgcaattccatcctgagtgggaattctcaagactggatgaaagaagatagagttagaggattcatcccaaaccatgggcatgttggagacaaagatgagcaggttgtacttggcgatgggtttgagaaaggatgtgatttgggagattcttggtggacagtcgcatcactaccactaagcaatttgcattctgtggaccagcccctgaattcctattgccctttgggcattgcatttctggacgcttctagacagtgttcatacttggctgtctggtttcaccaggaactctacccaaaagaggaaacagcaaggagaacatttgctttgtttgtaggagggaagtggtcgagctacaaacaaatctttaggcatctgaggaattgctaagtttctaatttcatatggttgctgacaaggaggtgcagacaaggaccctcttgctttcctcactatggatagtctgttgcctccatctagattctcttatttcaaaaaatatcctctccatgcaattaggagatatttatcgacgctgagaaaccaaagagccgaagaacaggtatcattttgtttatattatc

SEQ ID NO: 463891 - DNA, 1129 bp, Homo sapiens
aggcctcccagaggagcaaatcatgactgctggggagaagaaggcaacacagcttcaaagacctgccccaaatccatcaaaaacagtaagtttgctgggagatttgaatgtttctgttaaaggaataatttgcaattccatcctgagtgggaattctcaagactggatgaaagaagatagagttagaggattcatcccaaaccatgggcatgttggagacaaagatgagcaggttgtacttggcgatgggtttgagaaaggatgtgatttgggagattcttggtggacagtcgcatcactaccactaagcaatttgcattctgtggaccagcccctgaattcctattgccctttgggcattgcatttctggacgcttctagacagtgttcatacttggctgtctggtttcaccaggaactctacccaaaagaggaaacagcaaggagaacatttgctttgtttgtaggagggaagtggtcgagctacaaacaaatctttaggcatctgaggaattgctaagtttctaatttcatatggttgctgacaaggaggtgcagacaaggaccctcttgctttcctcactatggatagtctgttgcctccatctagattctcttatttcaaaaaatatcctctccatgcaattaggagatatttatcgacgctgagaaaccaaagagccgaagaacagattctcttgcagcaagtgtttcacaaagccaaatccccacatatgtagaagattaacagcattaatgagatgaagatgctgaaggaggaaagccgagaaggagtcagaaaacacaggccagctaatttaatctacaagaatttgggatgacctgtaccaatgtctcgctctcttgaacagagattttttttttcctgattgagaaataccattcaagggctgatctgacaagtcttgcctgtttaacagtgaatctgcttaaaatgaggagagtggtctttgggcccagggggcatgtactgtagctacattaatacgagtagatcatttgtttgagctgtctagtcttcatgctagaatgtctagtgacgatcactgattctgctgctctgtctatgatgctactcagttgcactgttaaataaatatttgaatcc

SEQ ID NO: 463892 - DNA, 757 bp, Homo sapiens
tgagttcatgtcctttgcagggacatggatgaagctggaatccattctcagcaaactaacacaggaacagaaaaccaaacactgcatgtccccactcataagtgggagctgagcaatgagaacacatggacacagggaggggaacatcacacactgggacctgtcaggggatggggtgctaggggaggggtagcattaggagaagtgcctaatgtagatgatgggttgatgggtgcagcaaacccccatggcacatgtatacctagagttgcatttgggaactgcaatgggttggctgtggtggattttatacagaagacagtactgttaagcatggggaccattgacctatatagatcaagtgacttataccagcgacaaccacggtctcctcgaaaaaacaaacagttcattgcaggaaaatctgtgaagttataaactcagtttgtgtttagtgtacaagatgacacagtgagaactcactttatattataacaatgaagtattaaagactgaaatctttagctttctttttaattgctgaaggattaaagacaatcattttttattaatgaaataatttatacatattagttacaagccaaagaagtgtattttgtaaaaacatataaggaaaatgtgccatctacttttataagacatttaaataagataaaaataaatatttataaatatttttatattaaatatttaaataaatgttaaaattactaccgcattctcatcattcatctat

SEQ ID NO: 463893 - DNA, 1899 bp, Homo sapiens
ctgtgatgagaaaccactcagatgggggagctatgaacattccattacgaagagcagaggagcttcaccccacggccatcaccaccacaggcccacgagagtactaccaggctactgcagatggtccttttaggcccaagggctcttcagtcaatttatgttgaatgctgcctgggactcacccttcagggcaatgggctcccctctgtaccacacacagcagatacagaaatgctgtccaagagcccaaggcctggaactggggacccccaaggagctgtttggtgctctgtcccactgtggctgacctggtacctgatttttggttcttacgaagacatggctgaatgctggaagaaagtaaagaaagttcctggagtcaaagatgaagtgagaaggaaaaatcagagcagtgaaggcagtaatgctcattctcaccagccgctcacctactgctgtacaatcccattcctaacaggccacagactggtacaggtccgcaaccatggggacccctgcaaactggagatcttctctaccaccaccctcacacacccaaccaccctttcctcctaagccatactgggctgccactgttcttcatatatcaggttcaagctgatggatccaagccaaaggactccatattctccaaagcctataagcagaatgctggtgtggtgtggggggggaagaagttccattgtgtccctactgaagggacacagaagtaccaaaagggtcactgaactgccaggagaaaggaaagggaatacaatgtaaaaggactgtttgaatcagaagagattgacatattgatatttgtccagttccatggtttctaccccacacccaataagaaagaggcttaagaggaacattagttcatgagactaactggctgttcattaaacccacagctggactacattttcagccttccttgcagttaggtgtaaccatgtgaatggatctggccaataaaattgatcttggaaaccaggtattgaagatggtgaggccacagatggaaggcacctggatccagatttaaaagagttgcctgccaatcaggaacaccctttttgagctttggggatgtgttttagttctcatattcctgcataacaaactactccaaatttagtggattaaaacaacaatttattataatccctataaattctgtagttcctgtcacttttccattgaattctagtgttctctcttggatgatctattccaagtgtaataatctcacaattttggttcttcttagtagaagaggctacaagcacaaattttcctccatcaatcattatatgtgatttccaatatgttcagtattgaaagtgggtattattattcctttaaaaaggcataattctttgagatctctgcatttgggatgagtttatagtgttgctgcaaatttgaaggctgaaaacagtgataggaaaaacatgtttgttttttaaagttggctatttttagctatgtaggctaaatgaaaaggcaatcatatttaaaattatgctaccatgtttttctttgatgtatgaaagaaagctgttcactaaatgaaattcacaactagtcagtgcaggtggggggcagggaactttttagtctaagaaaatgtttcaaatcttcaggccaagatgctcatgaggaggacaatctcccagtgtttacagactgtgatcacaaccgccaataatcatttggaaccttctaggaaactactctggtttatgtccctgaagactaatttctagcttctagaaaacggtgtgaaatgtacactagaatattcagaccacttactagtttctgttgatctttttaatataactattttcataattacatttatatcgctttaaggctctcctttca

SEQ ID NO: 463894 - DNA, 992 bp, Homo sapiens
ttttatgacgtgcttgttagagctgtgtgaggaagaaagcatttctatacactgaggatgagagtgtatattaaagtcactgctgtgaggcaatttggcattatcaatcaaaatcacaaatgcacaaaccctttgactcaggaatacagatatattctgatgcatgccaaaaacccagaaagcccggagtcgcccaggaagtttggctcggactgagagcatttccttctgggccggccgggcgcgatccgggaagggcggctgcggtcgcaagccgcgctgctttcagccaggctggcaccatgcggcccctgctttgcgcgctggccgggctggccctgctctgtgccgtgggcgctttggccgatggtagagaagaccgtggatcacctggggacacaggtgaaaggcctgctgggcctgctagaggacctggcctggaacctgcccgggggacccttcagccccgtccccgacctcctcggaaaagatggcttctgagccccggagctggagcccagcagctggaggtggtgcacctgccaggcagcaccctctgatagccagcgctgtcctctcgccttccttcctcagcttcgtgtgaaataaaagctactgtttttggtctcctctgtgtctgctgacagagtaacccgtttacagccccctctccctccacttccatgcctgggggaggccggccaccccctccaggctcagacctggggacacgcccactcccgccatctgtgctttagcattcccttatttataggggcagatggagcaggggttgattcacagaggtgggggcccttcgagtggccttgcgtctcaaaatgtggccataggtatttcttttatgattatcatgaggcttgtataaaacatagttataacagtctattttaagctgataacaactcaattttgcttgcattaaaaaccctgtatgtttacttctccccaccccatactttgtttttgatgtc

SEQ ID NO: 463895 - DNA, 975 bp, Homo sapiens
accacattctcatctgtatgttttacaaaggcatgagtgatggctttgctgtgattcacgcaatttgcacttttagtataaaaatggaaaatggctattgtctcttcacctccctgtcactgagtagcctcacctggcaattcttcctgcctccctggaagcctgagctttctcaaaagcatctcactgtgaacaccctctgcgaccctttcattcaagtagctttcacctacctgccttttcgcctcctccttacatctttgtcctccattttatcctcaacagaactaaaatccccccctctgtcttttggtgtgtgtttagaagtggaacactcttctcctcctgcccttggacatcagaacaccaggttctttggcctttggaccctgggactggcaccagtggccttctgggggctcttgggcctttggcctcagagttaaccctttctgtaaatgcataatgtctccagaagctttcagctaaaataccaatgtgttattttggagagagaacacatgaactctgagcattcacaaattgcctaagcatgaaccagtttatcaagtcatttaagttgagagaaaggtcctcaaggaaggaattacaaaattgtgctttttatgggacgtcgtgagaaggctcagggaagttatgagggtaagattagtggaaggaagaaaaatctgaagacacttgggaaggcgtgcccaggagcaaggcaagggtcacagtcacattcacagaacctcattagggtggatccacaggacatacttcccactgctcgcagaagtattaccaccctttggaataatcaatcaatcaaaccaactcaacaatctttcttttaatgctagtggcacatattgacataaaaataaaattttgcttcctggtggaacatgaataataaaagtatttttaaagttgttttaatcaaggcttcactatttagaaagtattaataaa

SEQ ID NO: 463896 - DNA, 1475 bp, Homo sapiens
ggggaggggctgagcagggagggggcctcagggcccccccccagctatggactaacggctactggggccgcctcctccaggcggggcccggggggggcctgggattggtgagtggggagcctgggggccctggcgagcctcctggtggcggagaccccggtgggggtagcggggggttcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaaccggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggcgtgtcccctgacaactccatcgaacactcggactatcgcagcaaacttgcccagatccgtcacatataccactcggaactggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctatgatgatgctgcgctcccgtttcctggatgccagacgaaagcgccgtaacttcagcagacaggccactgaggtcctaaatgagtatttctactcccacctgagtaacccatatcctagtgaggaggccaaggaggagcttgccaagaagtgtggcatcaccgtgtctcaggtctccaaccggtttggcaacaagaagattcgctataagaaaaacatcggaaagttccaagaggaggcaaacatctatgctgtcaagacagccgtgtcagtcacccaggggggccacagcagcaccagctccccgacacccccttcctctgcaggctctggcggctctttcaatatctcaggatctggagacatgtttctggggatgcctgggctcaacggagattcctattctgcttcccaggtggcatcactccgacgctcgatggggccagggggctatggggataacctcgggggaggccagatgtacagcccacgggaaatgagggcaaatggcagaagacaagaggctgtgaccccctcttcagtgacatccccaacggagggaccagggagtgttcactctgatacctccaactgatcttgcccctcagggtcacaggggtgggggctctcacaaggcgactcttgaagaggacgcaggcttccagaggacaaaccccaatacaggagaagcacaagacagagaagggccaatggggtcaaccgctgccgc

SEQ ID NO: 463897 - DNA, 1856 bp, Homo sapiens
ctgaactcagggaatggggcccccagctcccattggggtcggcgaacctggtgccaccccttagacaaagtcccagtctcccagaggcttttaccagctggccccattccttctgctgctgggtataataaggtcctctcaacgctgaagtgcctgtgaaacacagcccagaggagttctcattggtcctatgggctttgtcttcctctctgccccacccagataatcgctgctgcccctccactcccaagatgcagctgtgattctccatccccacacatccctcatcaatggttgactgcaaagaagtgagaagccaagcttagattcatgctcatgcctgaacaccctgagagcctggtgctggagggctgggtatccccttggcctgccaccagcacctgcacccacaccaggctggagccacgctctgcgcacagaaggtggccttgatttctcaggcacagctgacctcagagatactggtcctgactctgccaggtctcttatccctagtcttgttgccccagttccttctggattcaaggcgatgttgcctcaaaacaaggaccaggtgctgccacagacctcagtgctccctgggcgccccacttggggcttctcacaacttgtggactcctctcctcacaacctacagcctctctctccccatcagggcctccctccctctcaaccaccgttctcttccactcagtcccgtcgtccctcctcccctccaccagcatccccctctcctggcttccaattcggctcttgtgactcaaattctgactttgctccacatccctattctccctctctcccaagttcccctactttctttcaccagaactacctctctctcccccgctccactctaacaggcagacatggcgctggcatcagtacagggacactgggtccgggtcccctggagtggtggagagatgcgtgccaagcgagaaggatcctgcacagttcagggacccaggggccctggcccaggccctggtggtccagctggggcaccgccgcatcgcacacgacctgcggctactgcttttgcagcacctgtggctaggcagaaccggccaggccccagtcgtggagtatcctatatgcctggtgtgcctccggccccgcagcccctcctgccccctccccaggtacaggactggaccccggctgcttgctttccctcaactactgccctgtgtgcagggccaggaatctgggccactccggataggcatcggcttcggcctccgcctgcctcagggccaggccagggccttgcatctgctgcccgagaaaaggccgaaggaagcagggcctcagggcaaggctactcaggcctgtgggcatcaattgccagcatctcagcctccagcagctcaggcccgggccgacccagtcccaggcacaccctcccagaccaggagcttcaggtctgcaggccttcaatcaccaaactccccacgatgtttctccgggcctccacctcgggcaccaaaacaggtcactacctccctgaagcccaggccttgccctggcccaaagaggccagtttctctggagctcattctccaaaagtcatcagtctagttccagagccacggaggccccctggaacaccccctccaaacccaaccctcccaaccaggccccagatctcggggagtccccgagacaccctgaagggctggctggccggaggtcaggtgtgttctcctgctctgaaccctgggagccccttgtggagtctgctgtctccaggctgaagaggaccaagggcaccaaggccccattcagccctccgtgtatctaataaagtctgaccctgtgaaaaaaatgtt

SEQ ID NO: 463898 - DNA, 922 bp, Homo sapiens
  misc_feature (9)..(9): n is a, c, g, or t
  misc_feature (11)..(11): n is a, c, g, or t
  misc_feature (14)..(15): n is a, c, g, or t
ctttttctntntcnnaggagtgccagcttctcccagggttctgaggccccattcatcatgaggagaaacacagccatgcaaaatcttgcccagcacagtggatacagtgttgatggggtcagcggtcacatccatggcttccatagcctttccaagcccagccagcacaatgcagaattcagaggcagcacccacagaatcccctggagcctggcctcccatggccacaccagaggcagcctcacaggctctgaggcggataatgagggtgtgtaccccttcaaggcacccagaagcaccctgttccaggagtttgggggccacctggtgaacaatagtggtgttccggccaccccactctcagtgcaccagattcctaggacagtcacgttagacaagaacctctatgccatggtggtggccactcctgggcccatagcctcccttcccctgcccaaggcaagtcaggcagaagcatgtcagtggggcagccctcagcagagacctttagtcagtgaaagtagcaggtggtctgttgctgctgccatccccaggcggaatacccttcctgcagtagacaacagccgatgtcaccaagggttgaaagtcataagtggtaaagatgagcctcaccctgaggtcctggatcctggggcaggcatccaggagggacactgtgtgggtaacactggagctggacctggaagcccaggaggagttgtggtagggagcagggatgtgttagagcttcctccggcaagtacacccagcatggtggagggaatgccagccggcctgctgagtccatgcatgagggagtctgttctttcctgagctttctatgcaccaagacctcagccagggacatgaggtccagctgccccctgtcaaccgcagcctcaagcctaaccagaagggtaag

SEQ ID NO: 463899 - DNA, 1037 bp, Homo sapiens
taagaaagcaacaatggctaggtagcaggctgggtggttgcggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgaaaaaaaaaaaaaaaaaaaaaaaaaaaaaaaaaaaaaaaaaaaaaaaaaaaaaaaaaaaaggggggggaaattaaggggggggggaaaaaagggggaaaaaaagagaaaaagtagtgacaaagatgagtaaaaaaaacacaatatttgtaaaaaaggggaaacaggaaggagccacaaagagaggaaaaaataatgaaacagacgtacctttatttttgttgtagtcaaccccggaaaaaaaaaagagagaaagaagaagaaaaaaaagaagaaaaagagagaaaaaagaatgagagaaaagaaaaaaacacaaaacaagaacacaaaagaaagaagaaagaaaaaaaaagaaagaaaaagaaaaaatacacgaacacaaaggaagcgaacgaccacaacgcagagacaaaaggagcgaagaggaccgagagacacacaacacagcacaagcacaaacacagaagcgaagccaggaaacgccgaaggcacgcaaaccaacaaaccagaaa

SEQ ID NO: 463900 - DNA, 6270 bp, Homo sapiens
tctgctctttctcatctaaactgttttcctccaggtttgtgcaatggcatcagctaagctaaatacccttcttcagaccaaagtgattgaaaatcaggatgaagcatgttacattttagggaagctggaacatgttctaagtcaatcaatcaaggaacagactgaaatctactcatttctgattccccttgttcgtaccctggtttccaaaatttatgagcttctcttcatgaacttgcacctaccttctttaccttttaccaatggtagctcctcattttttgaagattttcaagaatattgtaattcaaatgaatggcaagtttacattgaaaaatattatgaagctcatacattttacgatggtcatgagaacatggcactttattggaaggattgttatgaagctttaatggtaaatatgcataaacgagaccgggaaggaggggaaagcaagctcaaatttcaggagctgtttgtggagccatttaatcgaaaagcacgccaagagaacctgaggtataataatatgcttaaacaacttagcagtcaacagttagccactcttagacgctggaaagcaatacagctctatcttacatgtgaaaggggaccttgggctaaaagtgatgagaaagaagaacaggatcaaaaagaaaaattggtattgatggaagactgtgaactcattacaataattgatgtaattcctggcagattagaaatcactactcaacacatttacttctatgatggcagcattgaaaaagaagatggagtaggctttgatttcaagtggcctcattctcaaattcgagagattcatctccggcgttacaatttaagaagatcagcccttgagatttttcatgttgaccaatccaactactttctcaatttcaaaaaagagaaatgggtaaacagagagatatcaaattttgactacctcattcaaataaatacaatggcaggacgaacctataatgaccttgcacagtatcctgtgtttccctggattttacaagattatacttcggaagagttggaccttaataaccctgctgtatttcgagatctttccaaaccaattggggtagttaatgaaaaaaacgccaaagctatgagagaaaaatatgaaaattttgaggatcctatgggaactattgataagtttcactatggtactcactattcaaattctgcgggggtcatgcactatctcattcgtgtagaaccgttcaccaccctccacatccaacttcagagtggaagatctgatttagagctaaatctaaggcatcaccggagagtcaaaccaatccaatgcctatgcctatgtagtcctaaaaatatgtatcatgaggaatggaaggaggagcaataagagactcttacattattacagcagctcaaacaagtctttgataccactgtatttacactgtgggtattataacttacctatgttgtacattttcctaatcctaaggaaaccagcttttccatgaatcttctgttcctcagtaaatcctccacatagctccctatttatacatttttgtctccatgttgccttactgtttaacagccattttgccttccctacccaaaccagagctatgtaaatattgccttttctgttctctttccatgtagcttttatctctcacagttaacctgggttccttatttctgtttatgtacaataagccttggctttcaagaagagactctggccctcagatcactaaacatccccagattttacatgtcaccatcaagaaagtaaaaactggccaaacatgttggcttatgcctttaatccccaacactttgggaggccaggtcaggtggatcacttgagcccatgagtttgagatcagcctaggcaacaaggcaaaaccccatctctacaaaaaatagaaagttagtcgggtgtggtggtgtgcacctgtagtcccagctacttgggaggctgaggtgggaggatagattgaacccaggaggtcgaggctatagtgaaccatgattgcaccactgtactccagactgggtgacacagcaaagctctatctcaaaaaaaaaaaaaaaaaggaaaagaaaagaaatgaaatgaaaactatacctgataagggacttttatatatttgtacctagaatatataaaaaacccttacactcaagacagggtctcgcttttcccttaggctggaatgcagtgctgtgatcactactcactgcagccttgacctcctgggctcaagtaatcctctcagctcagcctcctgagtagctaggactacaggtctgcaccaccatgcctgcaatttttttttttgtagagatggggtctcactttgttgtccaggctggtctcgaactcctggactcaagtgatccttccaccttggcctcccaaagtgctcggattacaggtgggagtcaccatgcccggccagcttcatttttgtgtcatagaaggtttctttcaaagtaagcatagtggcagatttgagtagttgcaacagatatgataacactcacaaagccaaaaatatttattctttgactttttataggaaaaatttggtaactcctgatttagagcatgcaagagtaggcaaattaaaatgacaggatataagttactgtaatatttgaaaatttatgttatgtttttgaagtagagaagtatggagttaaatattaatacctttttaaatgtccaaatcctttttctgtgaggtagttttacatttacttttaagtacaaataaggaaattagcaatatttttattattggtgttctttagggaggttccacagtattaaagggttattaccaacttttttccctgccctaacatgtaatgttagtgtttgacccttcatttattcagtacaattatttgtcatactgtggagaatatatccagggcttaatgtcactttgaccatgaactctggaacaagctgttggaggcagggcatcacagtaaggcagtcagaattggtgactttcagaaaatgaggtaaatctgttgtctgagtctgatcctaaactctcagtcagctattggactggattcttctaaagcagagtatctagaataggagggatgagcagactacatttggataaagaatttataaggtactctttaacaatttatatcagagttagttgctatctttagcaccattgtcctgatggcctccacttctagctatacattgcctctttgaaatgagccatttgggagaaagcaaatatatcaattagaatgcctttaagaataaaaaacttaaaaagcaaagaaaaacagaatgcctttaggaaaaaatttaataaaaccaactcaaaattgtgcaaacaaggaaattttagtgtttcccataataaaaatcctgaggtatggtagtttcagatagtttagcatcatcagcgccaactttttttctgtattttcactctgccattctgagtattttggctttggctagttcctctcatggtcacaaatgcctaacgcagttttaggcatcataggcagatccaacagtatcgcagaaataagtgaggctgttaatccattgtgtcctttcttaagagtgagaaactctttctcataagttctcctcactctccagaactgggtcatataccaacccctagaccagtcacctggaatgggcatgaaatatagggcagagatggacacttgaatgaaataaaggttctgctagcaaataaaaagagggaatgactatcaggtgggcaacgaataacatctgctacactgtgatgggtttaacataaaaccaaagaccctgtgcattctgtcattttatgacatttaaactcctctccaacttgtgatacactggtattttaaggcagcatactggtattttaaggccttcttttttgaagttcttttgtgttaacagtcccccttctcccctgccatgttgtgtaaacaaaaaaaccctcatatttggggaaattttatcaaaatgccatgttctaacctatgagcaaatctttattatgcaagtatctatttagaatagtggtatgtaaatattattcttccatcagacaaatataactcttccagtaggtgagcttaaggtatgagttacaccaaaaagctttaaggagctgtattttactattagagggactgtgtccctctcattattttaagtgtaagaagaaaacttaattttgcattttggtctgattgaaataagggttgtagctatagtttcccccactttttttgcttaacaacttaattcttactctaatttaccttataatagctaatttaaaactcgttatttttgtttttaaattaactggtatgtactccaatagataagaattttaaaagaaaaaatatgttttgcttaggaatgtgccctcattagtgtttgttttacttcgtttattataatctaaaatgatttgatacattttctttttacatgtcttagaatttaacttgggtcgtctacagatttccaaagaattagtaaatgatgtcattctcccgaaatgggctaaatcagctgaagatttcatctataaacataggaaagctttggagtctgaatatgtttcagctcatcttcatgaatggatagatctgatctttggctataaacagaggggaccagctgcagtagaggcactcaacgttttctattattgtagttatgaaggagctgtggatctggatgccttaacagatgagaaagaaagaaaagccttagaagggatgattaataattttgggcaaacaccctgtcaattattaaaggtaagtcaacaacttaagaagtagatttaagtcaacttaagaagtagatttaagtacataacaaaatattgcagtcaagatccatgtatatagccagttactctcagtcacagaaagatttctgtttgctcagaaagtcttatattatttccaagaggaaaaactgagtacctattagggtatgccattaaaactgtcctcatgctgggactcattccacatgtaaaacttctaatagctaacatctgcccaaaaaggcacttgctttccagagcccaaacccagtcttaagaatcaaattgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgaaaaaaaaaaaaaaaaaaaaaaaaaaaaaaaaaaaaaaaaaaaaaaaaaaaaaaaaaaaaggggggggaaattaaggggggggggaaaaaagggggaaaaaaagagaaaaagtagtgacaaagatgagtaaaaaaaacacaatatttgtaaaaaaggggaaacaggaaggagccacaaagagaggaaaaaataatgaaacagacgtacctttatttttgttgtagtcaaccccggaaaaaaaaaagagagaaagaagaagaaaaaaaagaagaaaaagagagaaaaaagaatgagagaaaagaaaaaaacacaaaacaagaacacaaaagaaagaagaaagaaaaaaaaagaaagaaaaagaaaaaatacacgaacacaaaggaagcgaacgaccacaacgcagagacaaaaggagcgaagaggaccgagagacacacaacacagcacaagcacaaacacagaagcgaagccaggaaacgccgaaggcacgcaaaccaacaaaccagaaa

SEQ ID NO: 463901 - DNA, 5986 bp, Homo sapiens
tctgctctttctcatctaaactgttttcctccaggtttgtgcaatggcatcagctaagctaaatacccttcttcagaccaaagtgattgaaaatcaggatgaagcatgttacattttagggaagctggaacatgttctaagtcaatcaatcaaggaacagactgaaatctactcatttctgattccccttgttcgtaccctggtttccaaaatttatgagcttctcttcatgaacttgcacctaccttctttaccttttaccaatggtagctcctcattttttgaagattttcaagaatattgtaattcaaatgaatggcaagtttacattgaaaaatattatgaagctcatacattttacgatggtcatgagaacatggcactttattggaaggattgttatgaagctttaatggtaaatatgcataaacgagaccgggaaggaggggaaagcaagctcaaatttcaggagctgtttgtggagccatttaatcgaaaagcacgccaagagaacctgaggtataataatatgcttaaacaacttagcagtcaacagttagccactcttagacgctggaaagcaatacagctctatcttacatgtgaaaggggaccttgggctaaaagtgatgagaaagaagaacaggatcaaaaagaaaaattggtattgatggaagactgtgaactcattacaataattgatgtaattcctggcagattagaaatcactactcaacacatttacttctatgatggcagcattgaaaaagaagatggagtaggctttgatttcaagtggcctcattctcaaattcgagagattcatctccggcgttacaatttaagaagatcagcccttgagatttttcatgttgaccaatccaactactttctcaatttcaaaaaagagaaatgggtaaacagagagatatcaaattttgactacctcattcaaataaatacaatggcaggacgaacctataatgaccttgcacagtatcctgtgtttccctggattttacaagattatacttcggaagagttggaccttaataaccctgctgtatttcgagatctttccaaaccaattggggtagttaatgaaaaaaacgccaaagctatgagagaaaaatatgaaaattttgaggatcctatgggaactattgataagtttcactatggtactcactattcaaattctgcgggggtcatgcactatctcattcgtgtagaaccgttcaccaccctccacatccaacttcagagtggaagatctgatttagagctaaatctaaggcatcaccggagagtcaaaccaatccaatgcctatgcctatgtagtcctaaaaatatgtatcatgaggaatggaaggaggagcaataagagactcttacattattacagcagctcaaacaagtctttgataccactgtatttacactgtgggtattataacttacctatgttgtacattttcctaatcctaaggaaaccagcttttccatgaatcttctgttcctcagtaaatcctccacatagctccctatttatacatttttgtctccatgttgccttactgtttaacagccattttgccttccctacccaaaccagagctatgtaaatattgccttttctgttctctttccatgtagcttttatctctcacagttaacctgggttccttatttctgtttatgtacaataagccttggctttcaagaagagactctggccctcagatcactaaacatccccagattttacatgtcaccatcaagaaagtaaaaactggccaaacatgttggcttatgcctttaatccccaacactttgggaggccaggtcaggtggatcacttgagcccatgagtttgagatcagcctaggcaacaaggcaaaaccccatctctacaaaaaatagaaagttagtcgggtgtggtggtgtgcacctgtagtcccagctacttgggaggctgaggtgggaggatagattgaacccaggaggtcgaggctatagtgaaccatgattgcaccactgtactccagactgggtgacacagcaaagctctatctcaaaaaaaaaaaaaaaaaggaaaagaaaagaaatgaaatgaaaactatacctgataagggacttttatatatttgtacctagaatatataaaaaacccttacactcaagacagggtctcgcttttcccttaggctggaatgcagtgctgtgatcactactcactgcagccttgacctcctgggctcaagtaatcctctcagctcagcctcctgagtagctaggactacaggtctgcaccaccatgcctgcaatttttttttttgtagagatggggtctcactttgttgtccaggctggtctcgaactcctggactcaagtgatccttccaccttggcctcccaaagtgctcggattacaggtgggagtcaccatgcccggccagcttcatttttgtgtcatagaaggtttctttcaaagtaagcatagtggcagatttgagtagttgcaacagatatgataacactcacaaagccaaaaatatttattctttgactttttataggaaaaatttggtaactcctgatttagagcatgcaagagtaggcaaattaaaatgacaggatataagttactgtaatatttgaaaatttatgttatgtttttgaagtagagaagtatggagttaaatattaatacctttttaaatgtccaaatcctttttctgtgaggtagttttacatttacttttaagtacaaataaggaaattagcaatatttttattattggtgttctttagggaggttccacagtattaaagggttattaccaacttttttccctgccctaacatgtaatgttagtgtttgacccttcatttattcagtacaattatttgtcatactgtggagaatatatccagggcttaatgtcactttgaccatgaactctggaacaagctgttggaggcagggcatcacagtaaggcagtcagaattggtgactttcagaaaatgaggtaaatctgttgtctgagtctgatcctaaactctcagtcagctattggactggattcttctaaagcagagtatctagaataggagggatgagcagactacatttggataaagaatttataaggtactctttaacaatttatatcagagttagttgctatctttagcaccattgtcctgatggcctccacttctagctatacattgcctctttgaaatgagccatttgggagaaagcaaatatatcaattagaatgcctttaagaataaaaaacttaaaaagcaaagaaaaacagaatgcctttaggaaaaaatttaataaaaccaactcaaaattgtgcaaacaaggaaattttagtgtttcccataataaaaatcctgaggtatggtagtttcagatagtttagcatcatcagcgccaactttttttctgtattttcactctgccattctgagtattttggctttggctagttcctctcatggtcacaaatgcctaacgcagttttaggcatcataggcagatccaacagtatcgcagaaataagtgaggctgttaatccattgtgtcctttcttaagagtgagaaactctttctcataagttctcctcactctccagaactgggtcatataccaacccctagaccagtcacctggaatgggcatgaaatatagggcagagatggacacttgaatgaaataaaggttctgctagcaaataaaaagagggaatgactatcaggtgggcaacgaataacatctgctacactgtgatgggtttaacataaaaccaaagaccctgtgcattctgtcattttatgacatttaaactcctctccaacttgtgatacactggtattttaaggcagcatactggtattttaaggccttcttttttgaagttcttttgtgttaacagtcccccttctcccctgccatgttgtgtaaacaaaaaaaccctcatatttggggaaattttatcaaaatgccatgttctaacctatgagcaaatctttattatgcaagtatctatttagaatagtggtatgtaaatattattcttccatcagacaaatataactcttccagtaggtgagcttaaggtatgagttacaccaaaaagctttaaggagctgtattttactattagagggactgtgtccctctcattattttaagtgtaagaagaaaacttaattttgcattttggtctgattgaaataagggttgtagctatagtttcccccactttttttgcttaacaacttaattcttactctaatttaccttataatagctaatttaaaactcgttatttttgtttttaaattaactggtatgtactccaatagataagaattttaaaagaaaaaatatgttttgcttaggaatgtgccctcattagtgtttgttttacttcgtttattataatctaaaatgatttgatacattttctttttacatgtcttagaatttaacttgggtcgtctacagatttccaaagaattagtaaatgatgtcattctcccgaaatgggctaaatcagctgaagatttcatctataaacataggaaagctttggagtctgaatatgtttcagctcatcttcatgaatggatagatctgatctttggctataaacagaggggaccagctgcagtagaggcactcaacgttttctattattgtagttatgaaggagctgtggatctggatgccttaacagatgagaaagaaagaaaagccttagaagggatgattaataattttgggcaaacaccctgtcaattattaaaggtaagtcaacaacttaagaagtagatttaagtcaacttaagaagtagatttaagtacataacaaaatattgcagtcaagatccatgtatatagccagttactctcagtcacagaaagatttctgtttgctcagaaagtcttatattatttccaagaggaaaaactgagtacctattagggtatgccattaaaactgtcctcatgctgggactcattccacatgtaaaacttctaatagctaacatctgcccaaaaaggcacttgctttccagagcccaaacccagtcttaagaatcaaattgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgaaaaaaaaaaaaaaaacaaaaccttcctaacccctattttttctctgactccctctctttctgtcaaaccagccgccctccctctcttaaaaaataggccggcccgctggcccaagcggtttttaaattggggcaggttatcatggcgccccaaattgggctctttgggcattccgccttagggggctgatatacattctggccggtgtttaaacgggggcattga

SEQ ID NO: 463902 - DNA, 891 bp, Homo sapiens
cattgaggacaagacgcgtatgtagtccctatatcagtcaaaaggctttatcatgcggctgcatgggatctgtgaccagcctcctgtcccctttctgactgtgcgtccttcagtgcatgcacaccagcctggcacactctagctccagccactcatgttctgcccgctcctggaacagtaccaagcgctatgccctgagcacatgcaattgatagggaccgagaggccggccggggaactacaggggcagagcttattccagggggtgaggttttcgattcgctattgatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgaaaaaaaaaaaaaaaagaatcaaattatagaatatttaaaatgtagaatcaaattattaaatattactacatatatttctttccctatactggtatctgaaattaaatcattatcttcctgatgacacacaggtttagattaatggaaattaatctaatggtagttttcaaagatgtcttgatctttttcagtatatgaatttagtgatgtagaatgtacaaaaaaatatatcatttattaactagatatgttcttaagcaatcactgtgtttgttaggtactttacctaatcttcatagtaaaaattcagctatcctcattttttaggagttaaagccaagcctcacagaagttatgtcctgaatttatattggtttaaatacaaaacttagtttccataatatgag

SEQ ID NO: 463903 - DNA, 6168 bp, Homo sapiens
tctgctctttctcatctaaactgttttcctccaggtttgtgcaatggcatcagctaagctaaatacccttcttcagaccaaagtgattgaaaatcaggatgaagcatgttacattttagggaagctggaacatgttctaagtcaatcaatcaaggaacagactgaaatctactcatttctgattccccttgttcgtaccctggtttccaaaatttatgagcttctcttcatgaacttgcacctaccttctttaccttttaccaatggtagctcctcattttttgaagattttcaagaatattgtaattcaaatgaatggcaagtttacattgaaaaatattatgaagctcatacattttacgatggtcatgagaacatggcactttattggaaggattgttatgaagctttaatggtaaatatgcataaacgagaccgggaaggaggggaaagcaagctcaaatttcaggagctgtttgtggagccatttaatcgaaaagcacgccaagagaacctgaggtataataatatgcttaaacaacttagcagtcaacagttagccactcttagacgctggaaagcaatacagctctatcttacatgtgaaaggggaccttgggctaaaagtgatgagaaagaagaacaggatcaaaaagaaaaattggtattgatggaagactgtgaactcattacaataattgatgtaattcctggcagattagaaatcactactcaacacatttacttctatgatggcagcattgaaaaagaagatggagtaggctttgatttcaagtggcctcattctcaaattcgagagattcatctccggcgttacaatttaagaagatcagcccttgagatttttcatgttgaccaatccaactactttctcaatttcaaaaaagagaaatgggtaaacagagagatatcaaattttgactacctcattcaaataaatacaatggcaggacgaacctataatgaccttgcacagtatcctgtgtttccctggattttacaagattatacttcggaagagttggaccttaataaccctgctgtatttcgagatctttccaaaccaattggggtagttaatgaaaaaaacgccaaagctatgagagaaaaatatgaaaattttgaggatcctatgggaactattgataagtttcactatggtactcactattcaaattctgcgggggtcatgcactatctcattcgtgtagaaccgttcaccaccctccacatccaacttcagagtggaagatctgatttagagctaaatctaaggcatcaccggagagtcaaaccaatccaatgcctatgcctatgtagtcctaaaaatatgtatcatgaggaatggaaggaggagcaataagagactcttacattattacagcagctcaaacaagtctttgataccactgtatttacactgtgggtattataacttacctatgttgtacattttcctaatcctaaggaaaccagcttttccatgaatcttctgttcctcagtaaatcctccacatagctccctatttatacatttttgtctccatgttgccttactgtttaacagccattttgccttccctacccaaaccagagctatgtaaatattgccttttctgttctctttccatgtagcttttatctctcacagttaacctgggttccttatttctgtttatgtacaataagccttggctttcaagaagagactctggccctcagatcactaaacatccccagattttacatgtcaccatcaagaaagtaaaaactggccaaacatgttggcttatgcctttaatccccaacactttgggaggccaggtcaggtggatcacttgagcccatgagtttgagatcagcctaggcaacaaggcaaaaccccatctctacaaaaaatagaaagttagtcgggtgtggtggtgtgcacctgtagtcccagctacttgggaggctgaggtgggaggatagattgaacccaggaggtcgaggctatagtgaaccatgattgcaccactgtactccagactgggtgacacagcaaagctctatctcaaaaaaaaaaaaaaaaaggaaaagaaaagaaatgaaatgaaaactatacctgataagggacttttatatatttgtacctagaatatataaaaaacccttacactcaagacagggtctcgcttttcccttaggctggaatgcagtgctgtgatcactactcactgcagccttgacctcctgggctcaagtaatcctctcagctcagcctcctgagtagctaggactacaggtctgcaccaccatgcctgcaatttttttttttgtagagatggggtctcactttgttgtccaggctggtctcgaactcctggactcaagtgatccttccaccttggcctcccaaagtgctcggattacaggtgggagtcaccatgcccggccagcttcatttttgtgtcatagaaggtttctttcaaagtaagcatagtggcagatttgagtagttgcaacagatatgataacactcacaaagccaaaaatatttattctttgactttttataggaaaaatttggtaactcctgatttagagcatgcaagagtaggcaaattaaaatgacaggatataagttactgtaatatttgaaaatttatgttatgtttttgaagtagagaagtatggagttaaatattaatacctttttaaatgtccaaatcctttttctgtgaggtagttttacatttacttttaagtacaaataaggaaattagcaatatttttattattggtgttctttagggaggttccacagtattaaagggttattaccaacttttttccctgccctaacatgtaatgttagtgtttgacccttcatttattcagtacaattatttgtcatactgtggagaatatatccagggcttaatgtcactttgaccatgaactctggaacaagctgttggaggcagggcatcacagtaaggcagtcagaattggtgactttcagaaaatgaggtaaatctgttgtctgagtctgatcctaaactctcagtcagctattggactggattcttctaaagcagagtatctagaataggagggatgagcagactacatttggataaagaatttataaggtactctttaacaatttatatcagagttagttgctatctttagcaccattgtcctgatggcctccacttctagctatacattgcctctttgaaatgagccatttgggagaaagcaaatatatcaattagaatgcctttaagaataaaaaacttaaaaagcaaagaaaaacagaatgcctttaggaaaaaatttaataaaaccaactcaaaattgtgcaaacaaggaaattttagtgtttcccataataaaaatcctgaggtatggtagtttcagatagtttagcatcatcagcgccaactttttttctgtattttcactctgccattctgagtattttggctttggctagttcctctcatggtcacaaatgcctaacgcagttttaggcatcataggcagatccaacagtatcgcagaaataagtgaggctgttaatccattgtgtcctttcttaagagtgagaaactctttctcataagttctcctcactctccagaactgggtcatataccaacccctagaccagtcacctggaatgggcatgaaatatagggcagagatggacacttgaatgaaataaaggttctgctagcaaataaaaagagggaatgactatcaggtgggcaacgaataacatctgctacactgtgatgggtttaacataaaaccaaagaccctgtgcattctgtcattttatgacatttaaactcctctccaacttgtgatacactggtattttaaggcagcatactggtattttaaggccttcttttttgaagttcttttgtgttaacagtcccccttctcccctgccatgttgtgtaaacaaaaaaaccctcatatttggggaaattttatcaaaatgccatgttctaacctatgagcaaatctttattatgcaagtatctatttagaatagtggtatgtaaatattattcttccatcagacaaatataactcttccagtaggtgagcttaaggtatgagttacaccaaaaagctttaaggagctgtattttactattagagggactgtgtccctctcattattttaagtgtaagaagaaaacttaattttgcattttggtctgattgaaataagggttgtagctatagtttcccccactttttttgcttaacaacttaattcttactctaatttaccttataatagctaatttaaaactcgttatttttgtttttaaattaactggtatgtactccaatagataagaattttaaaagaaaaaatatgttttgcttaggaatgtgccctcattagtgtttgttttacttcgtttattataatctaaaatgatttgatacattttctttttacatgtcttagaatttaacttgggtcgtctacagatttccaaagaattagtaaatgatgtcattctcccgaaatgggctaaatcagctgaagatttcatctataaacataggaaagctttggagtctgaatatgtttcagctcatcttcatgaatggatagatctgatctttggctataaacagaggggaccagctgcagtagaggcactcaacgttttctattattgtagttatgaaggagctgtggatctggatgccttaacagatgagaaagaaagaaaagccttagaagggatgattaataattttgggcaaacaccctgtcaattattaaaggtaagtcaacaacttaagaagtagatttaagtcaacttaagaagtagatttaagtacataacaaaatattgcagtcaagatccatgtatatagccagttactctcagtcacagaaagatttctgtttgctcagaaagtcttatattatttccaagaggaaaaactgagtacctattagggtatgccattaaaactgtcctcatgctgggactcattccacatgtaaaacttctaatagctaacatctgcccaaaaaggcacttgctttccagagcccaaacccagtcttaagaatcaaattgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgaaaaaaaaaaaaaaaagaatcaaattatagaatatttaaaatgtagaatcaaattattaaatattactacatatatttctttccctatactggtatctgaaattaaatcattatcttcctgatgacacacaggtttagattaatggaaattaatctaatggtagttttcaaagatgtcttgatctttttcagtatatgaatttagtgatgtagaatgtacaaaaaaatatatcatttattaactagatatgttcttaagcaatcactgtgtttgttaggtactttacctaatcttcatagtaaaaattcagctatcctcattttttaggagttaaagccaagcctcacagaagttatgtcctgaatttatattggtttaaatacaaaacttagtttccataatatgag

SEQ ID NO: 463904 - DNA, 5776 bp, Homo sapiens
tctgctctttctcatctaaactgttttcctccaggtttgtgcaatggcatcagctaagctaaatacccttcttcagaccaaagtgattgaaaatcaggatgaagcatgttacattttagggaagctggaacatgttctaagtcaatcaatcaaggaacagactgaaatctactcatttctgattccccttgttcgtaccctggtttccaaaatttatgagcttctcttcatgaacttgcacctaccttctttaccttttaccaatggtagctcctcattttttgaagattttcaagaatattgtaattcaaatgaatggcaagtttacattgaaaaatattatgaagctcatacattttacgatggtcatgagaacatggcactttattggaaggattgttatgaagctttaatggtaaatatgcataaacgagaccgggaaggaggggaaagcaagctcaaatttcaggagctgtttgtggagccatttaatcgaaaagcacgccaagagaacctgaggtataataatatgcttaaacaacttagcagtcaacagttagccactcttagacgctggaaagcaatacagctctatcttacatgtgaaaggggaccttgggctaaaagtgatgagaaagaagaacaggatcaaaaagaaaaattggtattgatggaagactgtgaactcattacaataattgatgtaattcctggcagattagaaatcactactcaacacatttacttctatgatggcagcattgaaaaagaagatggagtaggctttgatttcaagtggcctcattctcaaattcgagagattcatctccggcgttacaatttaagaagatcagcccttgagatttttcatgttgaccaatccaactactttctcaatttcaaaaaagagaaatgggtaaacagagagatatcaaattttgactacctcattcaaataaatacaatggcaggacgaacctataatgaccttgcacagtatcctgtgtttccctggattttacaagattatacttcggaagagttggaccttaataaccctgctgtatttcgagatctttccaaaccaattggggtagttaatgaaaaaaacgccaaagctatgagagaaaaatatgaaaattttgaggatcctatgggaactattgataagtttcactatggtactcactattcaaattctgcgggggtcatgcactatctcattcgtgtagaaccgttcaccaccctccacatccaacttcagagtggaagatctgatttagagctaaatctaaggcatcaccggagagtcaaaccaatccaatgcctatgcctatgtagtcctaaaaatatgtatcatgaggaatggaaggaggagcaataagagactcttacattattacagcagctcaaacaagtctttgataccactgtatttacactgtgggtattataacttacctatgttgtacattttcctaatcctaaggaaaccagcttttccatgaatcttctgttcctcagtaaatcctccacatagctccctatttatacatttttgtctccatgttgccttactgtttaacagccattttgccttccctacccaaaccagagctatgtaaatattgccttttctgttctctttccatgtagcttttatctctcacagttaacctgggttccttatttctgtttatgtacaataagccttggctttcaagaagagactctggccctcagatcactaaacatccccagattttacatgtcaccatcaagaaagtaaaaactggccaaacatgttggcttatgcctttaatccccaacactttgggaggccaggtcaggtggatcacttgagcccatgagtttgagatcagcctaggcaacaaggcaaaaccccatctctacaaaaaatagaaagttagtcgggtgtggtggtgtgcacctgtagtcccagctacttgggaggctgaggtgggaggatagattgaacccaggaggtcgaggctatagtgaaccatgattgcaccactgtactccagactgggtgacacagcaaagctctatctcaaaaaaaaaaaaaaaaaggaaaagaaaagaaatgaaatgaaaactatacctgataagggacttttatatatttgtacctagaatatataaaaaacccttacactcaagacagggtctcgcttttcccttaggctggaatgcagtgctgtgatcactactcactgcagccttgacctcctgggctcaagtaatcctctcagctcagcctcctgagtagctaggactacaggtctgcaccaccatgcctgcaatttttttttttgtagagatggggtctcactttgttgtccaggctggtctcgaactcctggactcaagtgatccttccaccttggcctcccaaagtgctcggattacaggtgggagtcaccatgcccggccagcttcatttttgtgtcatagaaggtttctttcaaagtaagcatagtggcagatttgagtagttgcaacagatatgataacactcacaaagccaaaaatatttattctttgactttttataggaaaaatttggtaactcctgatttagagcatgcaagagtaggcaaattaaaatgacaggatataagttactgtaatatttgaaaatttatgttatgtttttgaagtagagaagtatggagttaaatattaatacctttttaaatgtccaaatcctttttctgtgaggtagttttacatttacttttaagtacaaataaggaaattagcaatatttttattattggtgttctttagggaggttccacagtattaaagggttattaccaacttttttccctgccctaacatgtaatgttagtgtttgacccttcatttattcagtacaattatttgtcatactgtggagaatatatccagggcttaatgtcactttgaccatgaactctggaacaagctgttggaggcagggcatcacagtaaggcagtcagaattggtgactttcagaaaatgaggtaaatctgttgtctgagtctgatcctaaactctcagtcagctattggactggattcttctaaagcagagtatctagaataggagggatgagcagactacatttggataaagaatttataaggtactctttaacaatttatatcagagttagttgctatctttagcaccattgtcctgatggcctccacttctagctatacattgcctctttgaaatgagccatttgggagaaagcaaatatatcaattagaatgcctttaagaataaaaaacttaaaaagcaaagaaaaacagaatgcctttaggaaaaaatttaataaaaccaactcaaaattgtgcaaacaaggaaattttagtgtttcccataataaaaatcctgaggtatggtagtttcagatagtttagcatcatcagcgccaactttttttctgtattttcactctgccattctgagtattttggctttggctagttcctctcatggtcacaaatgcctaacgcagttttaggcatcataggcagatccaacagtatcgcagaaataagtgaggctgttaatccattgtgtcctttcttaagagtgagaaactctttctcataagttctcctcactctccagaactgggtcatataccaacccctagaccagtcacctggaatgggcatgaaatatagggcagagatggacacttgaatgaaataaaggttctgctagcaaataaaaagagggaatgactatcaggtgggcaacgaataacatctgctacactgtgatgggtttaacataaaaccaaagaccctgtgcattctgtcattttatgacatttaaactcctctccaacttgtgatacactggtattttaaggcagcatactggtattttaaggccttcttttttgaagttcttttgtgttaacagtcccccttctcccctgccatgttgtgtaaacaaaaaaaccctcatatttggggaaattttatcaaaatgccatgttctaacctatgagcaaatctttattatgcaagtatctatttagaatagtggtatgtaaatattattcttccatcagacaaatataactcttccagtaggtgagcttaaggtatgagttacaccaaaaagctttaaggagctgtattttactattagagggactgtgtccctctcattattttaagtgtaagaagaaaacttaattttgcattttggtctgattgaaataagggttgtagctatagtttcccccactttttttgcttaacaacttaattcttactctaatttaccttataatagctaatttaaaactcgttatttttgtttttaaattaactggtatgtactccaatagataagaattttaaaagaaaaaatatgttttgcttaggaatgtgccctcattagtgtttgttttacttcgtttattataatctaaaatgatttgatacattttctttttacatgtcttagaatttaacttgggtcgtctacagatttccaaagaattagtaaatgatgtcattctcccgaaatgggctaaatcagctgaagatttcatctataaacataggaaagctttggagtctgaatatgtttcagctcatcttcatgaatggatagatctgatctttggctataaacagaggggaccagctgcagtagaggcactcaacgttttctattattgtagttatgaaggagctgtggatctggatgccttaacagatgagaaagaaagaaaagccttagaagggatgattaataattttgggcaaacaccctgtcaattattaaaggtaagtcaacaacttaagaagtagatttaagtcaacttaagaagtagatttaagtacataacaaaatattgcagtcaagatccatgtatatagccagttactctcagtcacagaaagatttctgtttgctcagaaagtcttatattatttccaagaggaaaaactgagtacctattagggtatgccattaaaactgtcctcatgctgggactcattccacatgtaaaacttctaatagctaacatctgcccaaaaaggcacttgctttccagagcccaaacccagtcttaagaatcaaattgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgaaaaaaaaaaaaaaaa

SEQ ID NO: 463905 - DNA, 5650 bp, Homo sapiens
tgggtcactgggcagggctcgcgggcctgagagcttgcactctaaggagcccaggtgctgtcgatgttgctcagcttctggtcgcaatgcaagggtcccttcctgagctcaccacacgctggggtcactccgggctgtggctaccactgggcctcgcttctgccttctgcaaaaaccacaaactccccagggcagcacatgtgtcacagacgtctttttaacagctttattgagtgaccccagacctgctggggtggaggaaggggtccatctatttaggtctccaggctgccatgctggcgatgtggtcccgtagttgctcagccagtgggcatcagccccgcccttctgcgtgctgcccaccaggaaaacggaaaggccggtccctgctcttagtggtgccccgtgtggtgggacaggtggaggagggacagacagaggaggctcgtgcaggggaacgccagccaaggagggagcgcctgctccaagggagggggcatttgaggcacagatcaaatgattccatgatgacaaactgcctgtctcaactgaccagattccactggcaaacactccgctgaccttgggcagctccctctgctcccacctcctctggcccttgtgcttctggggctttgtggagtagctggacatcaatgataacactaacagtagccggcctgccaccaagttctttacataggggatgcctatgtctgtgcttcattggcgtcatctcacaaggccctgagctggcaggaaattgaggtctcaaggggaaaagccacctgcccccagtgacaaccaggaagtgcaagactctgacccaacgcccatgcctgccatccccaaacatgggctcaaaacccccttcccagggacggctgtgtccacccctcagcaggaggaggagaccccacagcaccgggtgagaggtcagtgctgaagccagggaggcagctctcagcagggcacctgtgtggagccagggaagccagggccacacttgcagggtgaagtggggaactcggaaggctgggcagtggagcaaaatgcttggtgccctgcgggaaccggtggccaaggctacactgggatgaagggagccgtggagctgcagaatctgcgggtggccctcagtggcaggcagccaggccaacaggggctttgggctgcaggtcagcccctcccctgctctggaacttttggagggccattacaaaggacatcagccccaagatactcctctgaaattctgcctgaaaggcccttcacattccctaattggcacttacaacattccagaacattctatggtaccttaagtttctcctccccctccaaagggcccttgaaccttaaggatagggcagaaggggctcctcaccctggcctcgagggcttaagatccagctgaggactcctagcctccctgtgtgctgggcaggaaagtagctccatgtcactgctgtccctgggaaaggaaaaaaggttgaggaagggctcagagccagccttcagaccaggcaggaagggttcagagccagccttcaggccatgcaggcctcctggatgtgcttactaactctgggctcgctgttctctgagctggctgggagttcccctctgcacccccgtttcctcccctgtaaggtgggaataatagcgtatgtctctaggattaagtgagccagtcatgcatgggccgagaaccaggtttggcatattgtagctgctcagtggacgttagctgttatgattggaccacaacgtgcttccgtttcaattctgtgggccttttggaggtcctgctggatgctaagcaccgaaacctcaacccggaacaagaccagaacaacctgagcaacaacaggaccagcgatggctctccctgctggaggattctggaagtcacctggctggaccaagccctctccgtgttctctgtcagcccactccccagagccgctaggcctgatgtgcacaagcagactaataaaggcttgaggacaaaaagggttttgagtgataagtgaaaaaagaaaggagatagggctgggccaacaggccttcccttggtggtggggagccctcagaggtgggaggaaccccagaggtgaagagagggacatggtgggggcacaaaaaaagcttccagagccacaggcctgggcgagtcctgacatggagcccagtctcatacggcctctttccctagtggctggctttgctcctggccctaggtagcccaacagctgggcaaggggtccgtctggtcaggggaaaggtgcaggggcagaaggtagcagagggagaaaaggacaccctgtctgcctctggccccaaagacaagtccgaatggggccagagggaaatggctgggccttggggtgccccagggtcttggaggggaccgggtgttcaggtttcgcacaagtacaggagggaccggcgaccgccctccccccgccccgggaggctccgccagggacaggcgtccccgggattggaggtgacccccgtgggttccgaagccccgcctcggccatgcactgtctactaggcgcgcttggggagcctaggggccgtctcggagaaatggggtggtccccgccaggcggcggcggggcgggccctgggcgccgaagggaggaaagtcgcggcgggggcgcggcccggtctccgtccccacccgcccgccgtcccgccggcccgagccgtggcgcccagagctgcgagccgctcgcccctccgccgctccggcccgggccgccatgtcgctgtggtgagtggggctgggggccgtcgggggcctgggcgggggcgtgggcccggggctccccctcctccgtggccacagacgggcgccgggactcccgggataggagatgcccccgcgcgcgccgcgccggcctcagtttcccgggggcggatgggcgggcgggcgcggcggcggcggcgggagatgttcgcggtacgcggccccggacccgtgggggacgtcgaggggtctcggggcgccgcgctcagctccccggccccgcggccctggacaccgctccaggaccctggcggctgggaccccaggtcttgccggcagctgggtcccctctcccttccagacccctgagggccccctgcgtccgggccactctcctcctctcggggcttccttccgcgggacctcggaccgccgcccgcccggcccctctccgcccctcccgggctttccctacgaatggagcggacccggcaggtggagcgcccgcagcccagggcctcgccgccttcccggtgcaccccccgacctcccccgtcccggcctcggtgggcggcttccctggaacccctagggctggcagggccggatccggagccctccgtttcctccccggagagctggaccttgggtcacaccccccagcctgcacctaaggtgcccctgtcttcctccaaccacatgccccagcaacctggggaccctatggggaaaatgtcgctctatggggctcagcctgcattcaccctggggcctggacctgcaaccggaccagccctcagggcaacccaggcgtctccacgggctgcctgtctctcctggcaccctgctcctcccccttggaggtcagcgccatctctctgctaggctggccctggaaggccactctgctgtccccagagctctcagcccccaggtctccactggggagggtggggcaggtgtcctggcagcccccggagggaagaaaaccgtctaccggagtctgtgcctggccctggccctgctcgtggccgtgacggtgttccaacgcagtctcacccctggtcagtttctgcaggagcctccgccacccaccctggagccacagaaggcccagaagccaaatggacagctggtgaaccccaacaacttctggaagaacccgaaagatgtggctgcgcccacgcccatggcctctcaggggccccaggcctgggacgtgaccaccactaactgctcagccaatatcaacttgacccaccagccctggttccaggtcctggagccgcagttccggcagtttctcttctaccgccactgccgctacttccccatgctgctgaaccacccggagaagtgcaggggcgatgtctacctgctggtggttgtcaagtcggtcatcacgcagcacgaccgccgcgaggccatccgccagacctggggccgcgagcggcagtccgcgggtgggggccgaggcgccgtgcgcaccctcttcctgctgggcacggcctccaagcaggaggagcgcacgcactaccagcagctgctggcctacgaagaccgcctctacggcgacatcctgcagtggggctttctcgacaccttcttcaacctgaccctcaaggagatccacttcctcaagtggctggacatctactgcccccacgtccccttcattttcaaaggcgacgatgacgtcttcgtcaaccccaccaacctgctagaatttctggctgaccggcagccacaggaaaacctgttcgtgggcgatgtcctgcagcacgctcggcccattcgcaggaaagacaacaaatactacatcccgggggccctgtacggcaaggccagctatccgccgtatgcaggcggcggtggcttcctcatggccggcagcctggcccggcgcctgcaccatgcctgcgacaccctggagctctacccgatcgacgacgtctttctgggcatgtgcctggaggtgctgggcgtgcagcccacggcccacgagggcttcaagactttcggcatctcccggaaccgcaacagccgcatgaacaaggagccgtgctttttccgcgccatgctcgtggtgcacaagctgctgccccctgagctgctcgccatgtgggggctggtgcacagcaatctcacctgctcccgcaagctccaggtgctctgaccccagccgggctactaggacaggccagggcacttgctcctgagcccccatggtattggggctggagccacagtgcccaggcctagcctttggtccccaaggggaggtggagggttgaggcctacgtgccactgggtgtggtggggtgcaggtagccagaaagggacctccctgtgtggataattctaggaaactgaggcccaggaacggttggagctgcccagtctggaggccctctctgaggagcgaggcgccaggccctggcagccctcctgacctgggtccgttgctggccccctcagatgtggtgggaggtcctggtgacctctggaggaacgctgtgctcaggtacctgggctaggcctggcctgatgggtctgtggccgcccctcgtcttcacagggaagagtcttctgtgaaatgcctcagtctccccagaggccgggcggccctggcaggagaaactcaaccctgtgcgggctcacaggcaccccccagtccacaccctggtctcctgggagagagggcccagccggctctccgcagccccaggcctgcctggagacgggccgcctctgccacagggcctccactcctggctgtgtcctgtaaggtctggaagggcgaccgtctgactacctcagcgcccctcagaatctccctggggctgcagccctaccccaccccgacacagggcagaagagcagcgctcc

SEQ ID NO: 463906 - DNA, 1215 bp, Homo sapiens
gatggagggaaataactgctcttcccttcccttccgttcaggaggcaggggactcacagaccaagtccttccctggctgcctcccctggcgtcccgttcccatcagaggactgtggcctctggccagggcagggggaggcacctggtgggtctgatgctccagctgctggtgttctccagtggagagaggacgggtccgtatactcaagttctccgtgccgtgggaggctcccaaacaccaaaggctcgtggaaatgaactgagtggacctaagcccagcctaaagcattgggttcacagcgctccagagactcctttccatgggaagagggacgtgggcaaggagctgagaagcagccgtggggatggcttggacatctctgtagaccccgcagccatcaaggcaggagaggatgtggaggcgaggaactctgctttcctcttctggccactgaaagaagcggacacgcaggattccagagagccaagacgagagaagcccaggaggaaaaagaggcccgccaagcagccactccagcaggcggcgccctcggactcggacggctcctcccacggcatcagctcccatgggtcctgccaggggacacaccccgagcccaggacagcccacctccacttccccgcggccgggcgtctaggactcagcagccacgccatcattgccacacctccacctcgagcagccctgccctgtactctccaagccacccacagcagcaaagggctgaggagcgtccctgagacactttaaggccgtctggtggcagctatgtttaagagaccagcgtccttccaggctgttcagacctcagcgttgacactgaaactggcccctccgcggagtctgttgtaggtaactctaattgagcccgaaaccagaataaaaactcttacattggaaacatttcaaaaccattggattgttggattatttgttaccatttttctctgaacacattttagcaatgacatatgaaagtattcagttgtgtttactaacttcaaaaatgaaatcgctccatcaaatttcgtttttctagtcggtaagatccctgaggctagatgaaaatagagcacaggtcatcactagggaaaatattggatgctttttgcaaacagaacagatagggctgagttctgatactctaaaaatttacaatctaattaaaagtggcattcacattcctgaaagct

SEQ ID NO: 463907 - DNA, 452 bp, Homo sapiens
actcctctcccctccatccctgctgcctcccctacccgtttgacgacttggttctggctttttctgactgttctttatcctgttttccccctgcactcacaaaattgtattccatcttctggtagacgccccacccccagaagttttaacctgaaggatgactgtcacaggactttcaaattgtttagcagtcagcatagtcaggatccaagcccgcaatcttgttttaaattaattatcacatctaaattagagattttgtcacccaatattaggactgaaattcagactcggtaacttgtctgagatctgcaagactgaacatcccctactgtatagtttcctgacattttcatttagcctttcctaattatttttgtctatagtctgttgtaggtaactctaattgagcccgaaaccagaataaaaactcttacattggaaacatttca

SEQ ID NO: 463908 - DNA, 930 bp, Homo sapiens
gatggagggaaataactgctcttcccttcccttccgttcaggaggcaggggactcacagaccaagtccttccctggctgcctcccctggcgtcccgttcccatcagaggactgtggcctctggccagggcagggggaggcacctggtgggtctgatgctccagctgctggtgttctccagtggagagaggacgggtccgtatactcaagttctccgtgccgtgggaggctcccaaacaccaaaggctcgtggaaatgaactgagtggacctaagcccagcctaaagcattgggttcacagcgctccagagactcctttccatgggaagagggacgtgggcaaggagctgagaagcagccgtggggatggcttggacatctctgtagaccccgcagccatcaaggcaggagaggatgtggaggcgaggaactctgctttcctcttctggccactgaaagaagcggacacgcaggattccagagagccaagacgagagaagcccaggaggaaaaagaggcccgccaagcagccactccagcaggcggcgccctcggactcggacggctcctcccacggcatcagctcccatgggtcctgccaggggacacaccccgagcccaggacagcccacctccacttccccgcggccgggcgtctaggactcagcagccacgccatcattgccacacctccacctcgagcagccctgccctgtactctccaagccacccacagcagcaaagggctgaggagcgtccctgagacactttaaggccgtctggtggcagctatgtttaagagaccagcgtccttccaggctgttcagacctcagcgttgacactgaaactggcccctccgcggagtctgttgtaggtaactctaattgagcccgaaaccagaataaaaactcttacattggaaacatttca

SEQ ID NO: 463909 - DNA, 576 bp, Homo sapiens
tcccccccccccttaattatcgccccaccaccaacatcaccctggctgaagaatgtcaacaattgggagttttgaaggattccaggctgtgtctctgaagcaagagggagatgaccaaccctctgagactgaccacctatcgatggaggaagaggacccgatgccaagacagatttcaaggcagtcaagtgtgaccgaatcaactctttaccccaatccttatcatcagccttatatctcacggaagtactttgctacacggccgggggccattgagactgccatggaagacttgaaaggtcacgtagctgagacttctggagagaccattcaaggcttctggctcttgacaaacacaccaaggcagggaaaggcaaaaacaacaacaatgagaacacaaaaacaaaaatcccaactcccccaacagcaaccacaaaacaaaaaaactaaagaaaataaacaaacatgcaggcccagaaagaacggatccattaagccagcaccaaggagaacatcttgacactttatggaatttcaaaaagtatgatatgatggcaataaagtggctcttcagca

SEQ ID NO: 463910 - DNA, 575 bp, Homo sapiens
  misc_feature (33)..(33): n is a, c, g, or t
tgtctcttctgtaactgttgtggttttgtgtgntcttccatcagctgaagaatgtcaacaattgggagttttgaaggattccaggctgtgtctctgaagcaagagggagatgaccaaccctctgagactgaccacctatcgatggaggaagaggacccgatgccaagacagatttcaaggcagtcaagtgtgaccgaatcaactctttaccccaatccttatcatcagccttatatctcacggaagtactttgctacacggccgggggccattgagactgccatggaagacttgaaaggtcacgtagctgagacttctggagagaccattcaaggcttctggctcttgacaaacacaccaaggcagggaaaggcaaaaacaacaacaatgagaacacaaaaacaaaaatcccaactcccccaacagcaaccacaaaacaaaaaaactaaagaaaataaacaaacatgcaggcccagaaagaacggatccattaagccagcaccaaggagaacatcttgacactttatggaatttcaaaaagtatgatatgatggcaataaagtggctcttcagca

SEQ ID NO: 463911 - DNA, 1650 bp, Homo sapiens
aaccccttcatgggggtagaggacagaaatctttcagtatgtggtggagcagaatcctcgatgatgaagagactggagagctacccccctcagaccgggggcactgagcttcttgtgcctaaaggatttgtcaacctggctctgggggaaagagaaaggcttcattcagcctgcagcgctcgctgtgggactgctgatgcacgggaagctggggattggtcctgcttcatggaagccgtatctctcagcccagaactcactgggctcagacatttggcaaaagtgcctccagctgaagaatgtcaacaattgggagttttgaaggattccaggctgtgtctctgaagcaagagggagatgaccaaccctctgagactgaccacctatcgatggaggaagaggacccgatgccaagacagatttcaaggcagtcaagtgtgaccgaatcaactctttaccccaatccttatcatcagccttatatctcacggaagtactttgctacacggcttcggagctcccagctagaagggtcttgaagaatattgaatccagaatccaacctttgatgcacacaaatgaggtatgacttggtgccaaggtcaacaagcaacctctgggccacgcaagaactagaagacaggcctggaacccaggaccctcgatgctttccaccacatcccactgcctctgaccttggaaaatgaatgaaaagtcacagaaacaaagatccaaactacttgccatcagtctgcttggataaccttttcctttggtttcagttcatctgctattattgcttagacgtatctaaaaaaaggcctagtgccttctctgaacaaaagtacccctcaaggctaataactagaggtatattatgataatcttggttgtggagactgatattcaaaagcaacttcttatgaaaggaacaatacttagtccacatgggggaaagatatttttaaactctctgtaggactctatatttgcagataccttatcagaaagttgaaagcgatttgggatggggaattatctctaaatttatactcgagaatgtaaattacatacaaactaatgggactaaaactatttgatcttttaatatttaattaatggttccccgtggcgtttttatagtctgtgttctattgtgagcaacgagattttaataagcaggttcaggactttccattgtgtagcaagatgtcattgcttccatgacactaatttggctttcatactctctctctttccctcttctcttgctatagggttccctgtgtcttgctttcacattgggaacaaataaatatattagttgtattgttattgcctgtgtgggcttctttcgggtgtagaaaatagttatctcactgggcaaaaggtttcttgactccttccaaccctgaaatcctgtgaagattgtaaaaaagatgatttttttttttctttatgagagcagaggactaaccacaatgagatatgatatattcccttcattttcagggcttcggtgtaattaatatgtgaaatcggactgtccatgtggaacatatagacggtagaatcaaagtgaagttgaagagtcagcctggtgtcatagagaaagcactgaattcacaatcagaaggtttggctttgaat

SEQ ID NO: 463912 - DNA, 648 bp, Homo sapiens
atatctaaaaggtgtgattgtgtattaacagtggtctgtcagctgaagaatgtcaacaattgggagttttgaaggattccaggctgtgtctctgaagcaagagggagatgaccaaccctctgagactgaccacctatcgatggaggaagaggacccgatgccaagacagatttcaaggcagtcaagtgtgaccgaatcaactctttaccccaatccttatcatcagccttatatctcacggaagtactttgctacacggccgggggccattgagactgccatggaagacttgaaaggtcacgtagctgagacttctggagagaccattcaaggcttctggctcttgacaaaaacggatccattaagccagcaccaaggagaacatcttgacactttatggaatttcaaaaagtatgatatgatggcaataaagtggctcttcagcagaatgtacttgaggtgtctttgtctacaatggttaaagagacaggaggagacagcatcttccctccacacacgttagtgtgaagtggtggtgggcgattgttgttcttaattcttcttattcctcattgagagtagttgcctaaggtatttaaaaaccggtaattcttgttcttcatctttataaaagatacttaaaatatg

SEQ ID NO: 463913 - DNA, 1296 bp, Homo sapiens
ccgccccccgcaggccctagcgggcagacacactgaagtcgctagacatttgaggaacacatccggggaagaagacacaggtggctggtcatcgagagcccgctgggggaagagcacacagacaggcaccggcaggccattgaccagcgggacaaggtgggctcaatgtcatcacaagggtgcttaagagggaaagaggaagccatgagggtcagagtcaaaggaagacttgaagatactacactgcggactttaaagatgaaggaaggggcgaaaaccaagaatgtgggaagcctctagaagctagagaaggcaaggaaacaaattttccactagagcctccagaaggaacacagccctgctgacccactgtaatgtctgacctctagatgtgtaagggtagtaagactgaaagtctcagaaaggcactgttaaattcttattcctcaactatgcaactcaaaactggggtcctcagcagtgagcgaggggtgagagaagacactgtataaacatggcacatcctcctggaaagtcaactttactcaaagctttagaaacccagctcaaactagctgaagcagaaaagacattactgcgcctataagttgaaactttggagggataaatttcagaggtgtggctagatccaacggctctctggaaaactctgtgaaaaaaatgcttcctcaagtccagaaaccagaagctcaggaaattgttgcttggttcctcttgttagaggcagagattattcaacgacctacagggtagcgtttgaacattgttaccaggaatctttactttgccatcttccaagtctgttctcctcagtattggtttcatttacaagcaggccatctctgccctcatggcaatgatggtctttactccaggcttaagacccttactatctactatttccaaagcggagagagaacttcccacacctagtgaccttctgcccaccaatatggagactgtggcatctgtggtagtggcagatgaatcaacagaaccaggcctggctgcaggcaaacttgtcaaagaggtgctagaaaatatggaaaaaggaggatgtcagaggatggggaaggacaggagagaattgggcacgcaaaatctgaacagtgtcagtttgggatatgtcctctggaagactcctatgagctatcccagtaagattaaatggacaggtgacaagatggatctatatttagggagaaaaaatggagctagagatagaaatttgaaagttattaacttttgtactggataccatggaattagatgaaa

SEQ ID NO: 463914 - DNA, 1162 bp, Homo sapiens
cgtgaacttcgtttctcctctccctagcctgggcttatttctcactttagccttcggaatgctttcgaaactgtaatagagcatatcactgcatacaaatccattcttacttcaatcaaaaaagaatatgatgcctttattgagacaataaagaaagaccgaagaactacattttgtcttcatggaaaacttaaaggtttggcagcagagcctacagctttggtatattacaggaaaagaacaatccaacttgaagcaaaaatgaggattatcgaaagtaattcctcgaagattcaatctcaaatagatcacatcaagcagtgtagggcagagtatgacacaaaagaagtaaaatattgtactttctccaaagatccttcaaaacctattccaggcatgactcttcaagaatccatgaatctagatgctctcactaaatacatgaaacatcttgaagataaatatgcagaaattaaacaagctatgttgataaaatatgtgccagctcagaggaaggctgatttagatgaagaaatgattgtgttattaaaacggcgagatgtagctgaaaatctgaacaaaaaattgcagttttgtcatcaaagactgcagataatttcacaggcacttagttcatgggtaaaatctgatatgagcagcccatttcaagactttgtggagcaaattcagaaaaccaaatatttacaaggtgaccaaggcattgttgaagaactaatggaagatgatccacgcagggcaaaagaagctgaaattatgcttcactacattgaaaggcaaatattttaaaagctttaatttttcagaattatattttttcatagattctttttttttctctttttctttgtgtcattataatgcattttaaaatgtgatggctataggtttaatgagttaatctcacttggtgaatatgaaaaggcagcttgttatgcagcaaacagtcctagaagaattcttcgaaacattggtacaatgaatacatttaaggatagtctggcttcaagatcactaatctgcttgattaattctgctgctgagagactttgatgcattcttcagcatgtcaattgcatttttcaactccagaatttatgcctgtctctttctaattatttcaatctcttagttaaatttttcc

SEQ ID NO: 463915 - DNA, 116 bp, Homo sapiens
ttaagggaatccaggacagctttcctgaagctgaagaaagagtaaaagccaggtgaatcaaagtgatagtatgtatgtgttttgggggttgggggtaatataggaggatggtctgc

SEQ ID NO: 463916 - DNA, 1619 bp, Homo sapiens
tgtcccaagatgcagttccacctcccagattccctagttactatctctaagcactgaagtcggtgtttggagaaaaggactcaggtgaggactggagcctaacagatgagacagaatataaacaggaagtctctaaggcagtgtggtggaaggataataccatgatggaggaagtgcacagtattatgggagaacatagcagtggcatctgaccaattttaagggaatccaggacagctttcctgaagctgaagaaagagtaaaagccaggcttatcaaagttttggctttgttgcaagagcaggtcaagatttagctgttcttcagtgaacaagtgtgcagattgtcaaatatgtcagttcatcaaataagaaaacatgcagttctcccacctatcatttgtagaagtgacaaggaatttttggaaagtgtgcaaagatacataattacagaaactgaaagactgggctgtagtgaggaaggacctgctgatgaatattacatcatataccgaaatgtttttgataaggtaatagagcatatcactgcatacaaatccattcttacttcaatcaaaaaagaatatgatgcctttattgagacaataaagaaagaccgaagaactacattttgtcttcatggaaaacttaaaggtttggcagcagagcctacagctttggtatattacaggaaaagaacaatccaacttgaagcaaaaatgaggattatcgaaagtaattcctcgaagattcaatctcaaatagatcacatcaagcagtgtagggcagagtatgacacaaaagaagtaaaatattgtactttctccaaagatccttcaaaacctattccaggcatgactcttcaagaatccatgaatctagatgctctcactaaatacatgaaacatcttgaagataaatatgcagaaattaaacaagctatgttgataaaatatgtgccagctcagaggaaggctgatttagatgaagaaatgattgtgttattaaaacggcgagatgtagctgaaaatctgaacaaaaaattgcagttttgtcatcaaagactgcagataatttcacaggcacttagttcatgggtaaaatctgatatgagcagcccatttcaagactttgtggagcaaattcagaaaaccaaatatttacaaggtgaccaaggcattgttgaagaactaatggaagatgatccacgcagggcaaaagaagctgaaattatgcttcactacattgaaaggcaaatattttaaaagctttaatttttcagaattatattttttcatagattctttttttttctctttttctttgtgtcattataatgcattttaaaatgtgatggctataggtttaatgagttaatctcacttggtgaatatgaaaaggcagcttgttatgcagcaaacagtcctagaagaattcttcgaaacattggtacaatgaatacatttaaggatagtctggcttcaagatcactaatctgcttgattaattctgctgctgagagactttgatgcattcttcagcatgtcaattgcatttttcaactccagaatttatgcctgtctctttctaattatttcaatctcttagttaaatttttcc

SEQ ID NO: 463917 - DNA, 2269 bp, Homo sapiens
agctgctggacacggtccccggcgccgctccaaccagaccgcgaccgctaagcccctcctttcgagaaactctggggccgcccctggaagtggcggggcgaagggaccggaggagggaccggaggagcgaggcgcgcggcgcagcgatggagccggtcagcacgggcgcggaggccggcatggagggcgcgggaggtgacccgtaccggcgacctgcgcggcgcacgcagtggctgctgagcgccctggcgcaccactacgggctggaccgcggcgtggagaacgagatcgtggtgctggccaccggcctggaccagtacctgcaggaggtcttccaccacctggactgccgcggcgccggccgtctgccccgcgccgacttccgagcgctctgcgctgtgctggggctgcgcgcggagggggccaccacggccgggcaggcagcaggtgacgggaactccagagatgtgacccccggggatgcggccgctgagttggccacggacggggactcagataccgatgaagaggcgcgcctggcgctgcgcgccgagccgccggagctcaccttccgccagttccacgcgcgcctctgtggctacttcggcacccgtgcggggccccggctgccccgcggcgctctcagcgagcacatcgagacgcagatccgcctgcgccgtccgcgccgccgccgccgcccgccctgcgcgcctggccccgacagcggtcctgactgtgagcgcgttgcgcggctggaggaggagaatagcagcttgcgcgagttggtggaggacctgcgcgccgcgctgcagagcagtgatgcgcgctgcctagcactgcaggtcggactctggaagagccaggcgagcacccacgagatggggcacggcgggccggaggctgcggtgcgggagctgcgtcaggcgcagggcgccctggctgcggcggaggcccgcgctgggcggctgcgccgtggccaggccgaggtgcggcggcgcgcggaggaggcccggcaggtggtgctgcgcagcctgcaccgcgtgcgagagctggaggcgctggcgcaacaggtgcccggcttgcagcgctgggtgcggcggctggaggcggagctgcaacgctacagtgtggcacagcgacttagtggcaagggcaggactcacagcccagcctgatggccccaaccacaagctcaagttgggtttggtagtatgcacaaatccttctggattctcctaccccagaaacatcggccggacattttactggctggggagggactgtaggctacaattcacctctgcttttgcttttcaagtgccagaagctcagatgtccgtgactattgagctgaatcagccccgtcctctgcagttggcctagagggctgcattctagaggaattaccgggaggaaagggccccatgccccaaacagtagagccccatcacaccctcttaagtgacatcactctggaatgtctctaggtgctctgcagatgtgtctttggggagaaaacagagcaatgactgaactccccctgagaatgacagcttgaagccatttggttagaataaatgacccaacaaacacctttccagcatctcccagtgttcaaagcactttcacagatactgactcacgctgatcttctcatcttccctctaaggttggtattatgtctcctgggtgaatgccagaaagcctaatgcaaactgacctaggtgaaaaggaagttagttcttagaactgaaaagtgtaggcatgtccagcttcagacatggctggattcagttggctctgatttcagacattcttcccataaggtagcaagacagctaccatcatcatcaggattagctcctatcctcccaatcacccccatcagaaacactttctctttcccagtagttccaacataggccacacccatcctggaaccagtcactggtaccagggaaatggagcatgctgactggccagcctagggtcattcgcacccaccacccagcccagccccagcaccactcctggacagctgtcctagcctcctgactggtgtcccagctccatcagaaccacggaccacacagcatcagaataaactgagcccaggcggtgtaatgggcttttgatgcgtccccctggctttgatgtgatgccttgaccgctcccttggttacagcaagttaaccggtcaaacactaagctacagttgctgtacaggtattctgcatatggattaaagtctgtcatcagttgactttag

SEQ ID NO: 463918 - DNA, 1675 bp, Homo sapiens
aggtaaagccttaaatctttccccgttcatacatttcatacctttatttacaaagttgagagagttacatctactgaacaattaagtgctcctcatcacgaaagaaaaggaaagaatgcggactgaatcctgtgccctgaaagtcgaatcagcatatacctgctgtttctatgtcaccaagaggctgattccaggtgggagactctggaagatgaagcgattggatcttgaacccagagcaccagcaaaaggtcctgagttccataacaagctttactccagagtcgctggtgttggggaaatatttgtagtcatttggtccaatgcagagacgatgaccactaggggtcagactttttacattactcctcttgaaagaaggaacccaagtcttggattttttaactggggaaaaactagagaggtcgtctatcctgtcaatggctgggccaggattaaaattgggttttacataactccaaagtccacattgttctcactaagaacacttcttgctgtctcttacttatagatccacccaaatttttaatgattttttttttactatataagttcactgatgaattttccatctgaaactttatataaagcaacttaacagatgctatctttataacaccattataataaaggctcttctatgtaccaatgttacagcaaaccttgaaagaagtggaagagggagaggaggaagacaagaaagaagaaagaggagggggaggaaaaagagggagagaagcagaggaggggagagacagcagagcccttcactgttaatgacccagttagcagctcttggctgcgtttccgacattttgcagacatcaagccccgcgtctctgccaagtacattctgttccctggagcacatccagtgcatctcagattactatctcgagcctgagctgcagcctgcgcgctaattatagacgtgaatggaaagcggccgcttctgaatgatcgcgttgctcgagctgccgttggaagcttagaagcaggtgctaccgtgctagatacaaagcgatctatttaaaagccctctgtcacgcacgcacacttactgacgaatcctctggctctctcctaccaccgcccggtggcggattccggaattggttcaaaaggccttgatcccgaacacccaggacagagacagagtacttttcctacctctttcgcctgcatccttagaaaactcccgtggatgagaagatccccaggcctttacaagctgttgttttacaaaaggagaaactgaggcaggaagaggcggtggatgtgcaccagagcacgtggtgcgtcggtgcatagctgagggcacatggaacattcaccaagataaaccatatgctggaacataaaatttatggatgtcacccatgaagcagagtccttcagaccctcaatcaaaaacaagtctcattttacattaaattggaggactatctggagtctctgaccaccgtgtgacagaaaagagagcagaattgttgcatgatgggtaacactcatcagtaatcgctgtttgccaagccatctgggaggagaccaaagagctataaaataagttcaggcacggtggctcatgcctgtaatcccagcactttgggaggccgaggtgggtgaatcacctgaggtcaggagttcgagacca

SEQ ID NO: 463919 - DNA, 1465 bp, Homo sapiens
aggtaaagccttaaatctttccccgttcatacatttcatacctttatttacaaagttgagagagttacatctactgaacaattaagtgctcctcatcacgaaagaaaaggaaagaatgcggactgaatcctgtgccctgaaagtcgaatcagcatatacctgctgtttctatgtcaccaagaggctgattccaggtgggagactctggaagatgaagcgattggatcttgaacccagagcaccagcaaaaggtcctgagttccataacaagctttactccagagtcgctggtgttggggaaatatttgtagtcatttggtccaatgcagagacgatgaccactaggggtcagactttttacattactcctcttgaaagaaggaacccaagtcttggattttttaactggggaaaaactagagaggtcgtctatcctgtcaatggctgggccaggattaaaattgggttttacataactccaaagtccacattgttctcactaagaacacttcttgctgtctcttacttatagatccacccaaatttttaatgattttttttttactatataagttcactgatgaattttccatctgaaactttatataaagcaacttaacagatgctatctttataacaccattataataaaggctcttctatgtaccaatgttacagcaaaccttgaaagaagtggaagagggagaggaggaagacaagaaagaagaaagaggagggggaggaaaaagagggagagaagcagaggaggggagagacagcagagcccttcactgttaatgacccagttagcagctcttggctgcgtttccgacattttgcagacatcaagccccgcgtctctgccaagtacattctgttccctggagcacatccagtgcatctcagattactatctcgagcctgagctgcagcctgcgcgctaattatagacgtgaatggaaagcggccgcttctgaatgatcgcgttgctcgagctgccgttggaagcttagaagcaggtgctaccgtgctagatacaaagcgatctatttaaaagccctctgtcacgcacgcacacttactgacgaatcctctggctctctcctaccaccgcccggtggcggattccggaattggttcaaaaggccttgatcccgaacacccaggacagagacagagtacttttcctacctctttcgcctgcatccttagaaaactcccgtggatgagaagatccccaggcctttacaagctgttgttttacaaaaggagaaactgaggcaggaagaggcggtggatgtgcaccagagcacgtggtgcgtcggtgcatagctgaggtaaacttctggtctcctgacagcctctccatttgccttaccgggttggaacctgaagcaagtctcactttaacgccgttaatttccaggcatggatctttagccaatgatgagcatcctcctccttt

SEQ ID NO: 463920 - DNA, 2858 bp, Homo sapiens
ggaaaataggagagaccttcacatgaacaagaagaggttgttcctcccgtatcgaagcccatctcaccaagtctccctgtgcacctcgcccctcatctgggctgcatgtgctcacaggcgctccgagtttcatcccaacttgtgtctgcaggggagcccacttcgacctcactcagtggtggagctggccaagttcgggggcagggatctgcgggtattgccttcattctttcacatgactgccagcatccctttgtcccagaccacgtgagcgacagcaccgtctctgcccggatctcagacaacagcctggcaccagtggctgacttcagttatcctgcagaatcctcctcctgcctggacaactctgcagctaagcacaagctccaggtcaagccccgcaaccagcggtcgagtaagatgaggcggctctcatcgcgcgctcagtctgaatccctgagcgacctgacgtgcaccccagaggaggaggaaaacgaggagaagccacttttggaagtcagcccagaagagcgccccagctctgggcagcaggacgtggcgccagacagaggccctgagcctgggccaccggcgcccttgccgccacccggaggggcccgtgccagacgcgcccgcctgcagcactcctccgcgctcacggccagcgtggaggaggggggcgtccccggggaggacccctcaagccgcccggccaccccggagctcgccgagcccgagtcggcccccactctccgcgtggagcccccgtccccgccggagggccccccgaatcccggtcccgacggcggaaagcaggatggggaggcgccccccgcaggcccgtgtgccccggccacggacaaggcggaggaggtggtctgtgctcccgaagacgtcgcgagcccgtttcccaccgccatccctgagggggacacgactccccccgagactgaccccgccgccacctcagaggcgccctctgctcgcgacgggccagaacgcagtgtcccgaaggaagcggagccgacgccgcccgtgctcccggatgaggagaaggggcccccagggccggcgcctgagcccgagagagaagcggagacggagcccgagagaggagcggggaccgagcccgagagaattgggaccgagccctccacggcgcccgccccgagcccgccggcgcccaagagctgcctgaaacaccggcccgcggccgccagcgagggccccgccgcgtccccgccgcttgccgctgcggagtctcccccggtggagcccggccccggttccctcgacgcagaggccgccgccccggagcgccccaaggccgagcgagccgaggcgccaccggcgggcgccgagagggcggcgccagagcggaaggcggagaggggcggtgccgagctgcgaggcgcgaagaagttctcggtgtcctcgtgccgagcgcggcctcgtccgggcgtctcccgcccgctggaacgggccagcggccgcctgcccctcgcgaggagcggcccggtctggaggagcgaggcggctcttgacgacctccagggtctccccgagccccagcacgcgaaacctggccctcggaagctggcggagcgcggccctcaggactcgggggacagggcggccagcccggccgggccgcgcaagagccctcaggaggcggccgccgcgcccggcacgagagagccctgcccagccgcccaggagccggccccgagtgaggacagaaaccccttccccgtcaagctccggtccacctccctctcgctcaaatacagggatggcgcctctcaggaggtgaagggtgtgaagaggtacagtgccgaggtccggttagaaaggtcgctgaccgtgctcccgaaggaggagaagtgtcccctcgggacggcccccgcccttcgaggcaccagggcccccagcgaccaaggaaaggggaaggcccggccccccgagccgctcagctccaagccgcccctgccccggaagccgcttctgcagagcttcacgctcccgcaccagcccgcgccccccgacgccggcccgggagagcgggaacccaggaaggagcccaggacggcggagaaaaggccgctgcgcaggggagctgctgcacagaatgctgtatgagaatgggattctccttgtcccagttttggttaaggcaccaatgcagagatgtaagataccagagagcatgtttgcaggatctgtggagtcaacaaccactcaccacccccaccctcagaatatacggacggtggggaggaataaagcggatttgcaaaacactttctgtggagagcacactgcagtcctgtgagccaccagcgcagaggaaacttccctcatgcagagtctgcaagggtggcttccatgggacttcttagaagctgaacagatgtgccctgcagttgggagacatgaaggactgctgctggactcagaccacctgtgggcatggggcagacaggaccaccacatgacccacttgtgctcccagagccccacatggggagccagccaagaggacaaggggacaatgagaagcggtcacaaccagagtcccagtggtggctgggaatcccccagtgtcagtttcaagtgtctgccaggcccaggcaggacaaaaccttgtaaggctccaaagagtcctgctgatctccctactctccttcttccccagctctcagccctcgggaaaggagtctccgccccaactcagacaccctgcattcaggagtcatagcctcacttcgcccagaggctacacattttaattactgaattaaaactgattataacaaaagtgaccatggtgactgctgggacctgagaaggactgagaa

SEQ ID NO: 463921 - DNA, 3278 bp, Homo sapiens
ggaaaataggagagaccttcacatgaacaagaagaggttgttcctcccgtatcgaagcccatctcaccaagtctccctgtgcacctcgcccctcatctgggctgcatgtgctcacaggcgctccgagtttcatcccaacttgtgtctgcaggggagcccacttcgacctcactcagtggtggagctggccaagttcgggggcagggatctgcgggtattgccttcattctttcacatgactgccagcatccctttgtcccagaccacgtgagcgacagcaccgtctctgcccggatctcagacaacagcctggcaccagtggctgacttcagttatcctgcagaatcctcctcctgcctggacaactctgcagctaagcacaagctccaggtcaagccccgcaaccagcggtcgagtaagatgaggcggctctcatcgcgcgctcagtctgaatccctgagcgacctgacgtgcaccccagaggaggaggaaaacgaggagaagccacttttggaagtcagcccagaagagcgccccagctctgggcagcaggacgtggcgccagacagaggccctgagcctgggccaccggcgcccttgccgccacccggaggggcccgtgccagacgcgcccgcctgcagcactcctccgcgctcacggccagcgtggaggaggggggcgtccccggggaggacccctcaagccgcccggccaccccggagctcgccgagcccgagtcggcccccactctccgcgtggagcccccgtccccgccggagggccccccgaatcccggtcccgacggcggaaagcaggatggggaggcgccccccgcaggcccgtgtgccccggccacggacaaggcggaggaggtggtctgtgctcccgaagacgtcgcgagcccgtttcccaccgccatccctgagggggacacgactccccccgagactgaccccgccgccacctcagaggcgccctctgctcgcgacgggccagaacgcagtgtcccgaaggaagcggagccgacgccgcccgtgctcccggatgaggagaaggggcccccagggccggcgcctgagcccgagagagaagcggagacggagcccgagagaggagcggggaccgagcccgagagaattgggaccgagccctccacggcgcccgccccgagcccgccggcgcccaagagctgcctgaaacaccggcccgcggccgccagcgagggccccgccgcgtccccgccgcttgccgctgcggagtctcccccggtggagcccggccccggttccctcgacgcagaggccgccgccccggagcgccccaaggccgagcgagccgaggcgccaccggcgggcgccgagagggcggcgccagagcggaaggcggagaggggcggtgccgagctgcgaggcgcgaagaagttctcggtgtcctcgtgccgagcgcggcctcgtccgggcgtctcccgcccgctggaacgggccagcggccgcctgcccctcgcgaggagcggcccggtctggaggagcgaggcggctcttgacgacctccagggtctccccgagccccagcacgcgaaacctggccctcggaagctggcggagcgcggccctcaggactcgggggacagggcggccagcccggccgggccgcgcaagagccctcaggaggcggccgccgcgcccggcacgagagagccctgcccagccgcccaggagccggccccgagtgaggacagaaaccccttccccgtcaagctccggtccacctccctctcgctcaaatacagggatggcgcctctcaggaggtgaagggtgtgaagaggtacagtgccgaggtccggttagaaaggtcgctgaccgtgctcccgaaggaggagaagtgtcccctcgggacggcccccgcccttcgaggcaccagggcccccagcgaccaaggaaaggggaaggcccggccccccgagccgctcagctccaagccgcccctgccccggaagccgcttctgcagagcttcacgctcccgcaccagcccgcgccccccgacgccggcccgggagagcgggaacccaggaaggagcccaggacggcggagaaaaggccgctgcgcaggggagctgaaaagagtctgccgcctgcagcaacagggcctggagctgatgggcagcctgcgccaccctggatcaccgtcactcggcagaagcggagggggaccttggaccagccacccaaccaggaagacaagcctggggcacggaccctgaagtctgaaccaggaaagcaagccaaggtgcccgagagaggccaggagcctgtgaagcaagctgactttgttcgcagcaagtctttcctgataacccctgtgaagcccgctgtggaccggaagcagggggcaaagctcaacttcaaggaggggctgcaaagaggaatctcattgtcccatcagaacttggctcagtctgcagtgatgatggagaaggaactgcatcagctgaagagagccagttatgccagtacagatcagccatcctggatggaacttgccagaaagaaatctcaagcttggagtgacatgccccagattataaaataggtgggcagtgtgctgataaagcatgtccactaccctgacaagccacttagttaaaaactgccagtgtattgtggcaaacaaactgtgaaacttaaagattgattttatcatcaagttatgacgaacttggggaagaggaaggaaccaggcaaaacaaagaggataaacacacagccatactcctgggccagagggcccagaaacaagaacaacattgaaaaagtccaggaaccagttcctgtgcccaaaggtacgaatgtgtcttttcgaattcccttgataaagaagcctcagacaaggaagaaaatagaaatgaaattggacacataaataggacacccagcaaaggccagaagagaagcccttctaggagaagggacatctgtgcttccagctgagatcagcccatgtctctggtcgctctcttgcctgtggatcctgtcttctttcatgtttactacgaggcatgacattcatggcaaaacagggatgccgtttccaagagcagctataaaacaatctgttttcctaaagacagccactctgagaaggagatgaaggaacacggcagggttcatcaattcatagactgtttccaaaaataatttttaaacttttccactaggcatctgtgtctttaaccactgcacaatgcattgcctgtttaataaaaggtttcaaacatg

SEQ ID NO: 463922 - DNA, 2253 bp, Homo sapiens
ggaaaataggagagaccttcacatgaacaagaagaggttgttcctcccgtatcgaagcccatctcaccaagtctccctgtgcacctcgcccctcatctgggctgcatgtgctcacaggcgctccgagtttcatcccaacttgtgtctgcaggggagcccacttcgacctcactcagtggtggagctggccaagttcgggggcagggatctgcgggtattgccttcattctttcacatgactgccagcatccctttgtcccagaccacgtgagcgacagcaccgtctctgcccggatctcagacaacagcctggcaccagtggctgacttcagttatcctgcagaatcctcctcctgcctggacaactctgcagctaagcacaagctccaggtcaagccccgcaaccagcggtcgagtaagatgaggcggctctcatcgcgcgctcagtctgaatccctgagcgacctgacgtgcaccccagaggaggaggaaaacgaggagaagccacttttggaagtcagcccagaagagcgccccagctctgggcagcaggacgtggcgccagacagaggccctgagcctgggccaccggcgcccttgccgccacccggaggggcccgtgccagacgcgcccgcctgcagcactcctccgcgctcacggccagcgtggaggaggggggcgtccccggggaggacccctcaagccgcccggccaccccggagctcgccgagcccgagtcggcccccactctccgcgtggagcccccgtccccgccggagggccccccgaatcccggtcccgacggcggaaagcaggatggggaggcgccccccgcaggcccgtgtgccccggccacggacaaggcggaggaggtggtctgtgctcccgaagacgtcgcgagcccgtttcccaccgccatccctgagggggacacgactccccccgagactgaccccgccgccacctcagaggcgccctctgctcgcgacgggccagaacgcagtgtcccgaaggaagcggagccgacgccgcccgtgctcccggatgaggagaaggggcccccagggccggcgcctgagcccgagagagaagcggagacggagcccgagagaggagcggggaccgagcccgagagaattgggaccgagccctccacggcgcccgccccgagcccgccggcgcccaagagctgcctgaaacaccggcccgcggccgccagcgagggccccgccgcgtccccgccgcttgccgctgcggagtctcccccggtggagcccggccccggttccctcgacgcagaggccgccgccccggagcgccccaaggccgagcgagccgaggcgccaccggcgggcgccgagagggcggcgccagagcggaaggcggagaggggcggtgccgagctgcgaggcgcgaagaagttctcggtgtcctcgtgccgagcgcggcctcgtccgggcgtctcccgcccgctggaacgggccagcggccgcctgcccctcgcgaggagcggcccggtctggaggagcgaggcggctcttgacgacctccagggtctccccgagccccagcacgcgaaacctggccctcggaagctggcggagcgcggccctcaggactcgggggacagggcggccagcccggccgggccgcgcaagagccctcaggaggcggccgccgcgcccggcacgagagagccctgcccagccgcccaggagccggccccgagtgaggacagaaaccccttccccgtcaagctccggtccacctccctctcgctcaaatacagggatggcgcctctcaggaggtgaagggtgtgaagaggtacagtgccgaggtccggttagaaaggtcgctgaccgtgctcccgaaggaggagaagtgtcccctcgggacggcccccgcccttcgaggcaccagggcccccagcgaccaaggaaaggggaaggcccggccccccgagccgctcagctccaagccgcccctgccccggaagccgcttctgcagagcttcacgctcccgcaccagcccgcgccccccgacgccggcccgggagagcgggaacccaggaaggagcccaggacggcggagaaaaggccgctgcgcaggggagctggtaagagcccgccgagggtgcgggaagggcagggcctggggagatccacatccacgggcacatcttgctggacactcgccaaatgctcctggtacaaactttgttgcaggggaattggaaggagtcagaattcc

SEQ ID NO: 463923 - DNA, 767 bp, Homo sapiens
gaacccaccaggaggaatgaacaactccagacgtgccgccttaagagctgtaacactcaccacgaaggtctgcagcttcactcctgagccagtgagaccacgaacccaccagaaggaagaaactccaaacacatccgaacatcagaaagaacaaactccggacatgccacctttaagaaccgtaacactcactgcgagggtctgcggcttcgttcttgaagtcagcaaatactgtggtctggggttgcaaatgaaccattcaattgaatcaaaaggcaatgaaatcacattgctgttcatgagtggaatccatgtttctggacgcggatttttggcctcatactctgttatagataaacaaggtacacaaacggattcatcaagaaaacaactcgactgcattccagcctgggcaacagagcaagactctgagaaagaaagaggaagaaagaaagaatgagagagagagagaaggaaagaaggaaagaaagaaggaaggaaggaaggaaggaaggaagaaagaaaggaaagaaagaaagaaagaaagaaagaaggaaggaaggaaggaaagaaagaaaaagaaagaaagaaagaagggagcacagggttgggggtaaggtcacagatcaacaggatcccaaggctccctctccctctccctctccctctcccgacggtctccctctcatgcggagccgaagctggactgtactgctgccatctcggctcactgcaacctccctgcctgatactcctgcctcagtctg

SEQ ID NO: 463924 - DNA, 5250 bp, Homo sapiens
accccagtcattgagggtggccgggacaatccagcaaatacatgtatcagcctatgacccctgtggaacagcttccaagcactgagattcctgccaggcctcgggaacccacaaacaccattcagatctcagtctcgctcaccgaacactttttgaaatttgcatctgtcttccagcctccccttccccctgactcaccgaggtactgtatgatttcagacctttttattgacaactatcaggttaaatgtattaatgggaagatgtgttatgtgcagaagcagccggcaccacattcccacagaatgagccctgaggaggtctctgcacacgatgccttaatttcaaaagagagcaatacaccaaaaatagatcactgctcttctccctcaagttctgaggactctgggatcaatgcgattggggctcactatgtggaatcgtgtgacgaggacacagaagaaggagcagaactgagttcagaggaagattacagtccagagagcagctgggaaccggatgagtgcacccttctctccccctcgcagtctgacctggaagtgattgaaacgatagaaacgactgtgtgagagtccagacaggaagccacagcctcggacccacgccgagcttttgtacctttgtctggtggatccttttttccaatgctgttgatattttctacccaccccgccccgctccaaccaacaaccgtagcagttcagtggtatgctgattagcttctctccgtcttacaactaagacattctttttattataaacagttttcttttgtatcctgacttactttctatgtagcatctggtgtcatgaattgtgaccccgccttaatttcactgggagatttgaaggcggtgaagtgatggtcgcagagaatcttggatcagattgaggaggtaccgaaagggaaggagccggtgttttctcggtagccagtccttcacagagactcttgccattccctttggcatgttcacaggcactcccgtcctgtcctgcttgtcctacgcaagtagcactccctactgagtgtgcactggtagatgccgtttcttcccttccccttctccccacacctgcactgggtctggatcagagctgcctcggcttacttctgggaggtcactggaggccagctcagcccatggtttgtggccagtgtctgtacaaggctccgtgactggggctgagctaaacattcacatgagaagagatgacctcatctgtctcatgctcaatccagccttagctgagcacctgtcccctgcagggggctgtggggacacagcatgaataagacctgattcccaccatgaaggggcccacagtcctatatatgacacattcaactcatggcacccaaaaagctctgggaacccaggggaaggatgaggtttacttggctggggctagctggggaatgtgtttcagcatttgagctggcttcttggtgggttcccaacatttttctgcttttaattgttcttcaagtctgggaaaaactcttaggaagttatataggtatcacatttaggtggcagccacatctgacatcttaaggaaaaaaaataaattaatagttttagttagcatggaaatgctacagacagaagccctttagggattaggactgaatctaataggtttgattaattctgcttcatttggttgtatgaagcattcgtatggtttaagtgaggaatggattagaattcagtgtgatgcatggatttttatgcagctgcaaaagcagttgaaatagtttgctgctaagtcaggagaaaatatccagtgtaatagccattcactttcccacacagtctgtctgttgtatgtgttctctcccctcacatgcacaaaatagtgactaattctttcttatttagctctcttcagaattctacttctactctccatttataccaggcccacattcccaccactaagccaatggagtcaaccagatttctaaagccatggatatacgtggtcacggggccacatttctgcagctggctcagtggcaggcttgggccgtctctcagtaccatctaagacttctgtctaggttcctgtttttttagactcctggaactgccattctggattagacactaattttagtgatgaactagttgttaaatggaatttttggatttaataatagttgataatcaccttatgtatttgcacaatctctttataattaaaaactcgctaagcttcacttgctactatctactatatagaattagagacattccattggattctaagcatcagacactcctggatctcaaaatgaccttttctaaataagcacaagatttatttttgtcctagcactgttgataacactctgaaatatgttattgaactggaattgtttctttatgcttgcattccaaaaccaactgaaacagattgtagtttcactttaaattctaggcctgttctatattatgtgaaggaattctctgtaacgctgatactatgttgctaatttgtgtacttacagacactttagaaaatgtttagactgcaacatgcactataacattgaactcagtcacatgaagtggttaacacttgcacactgactgacagatatgaaagctgtatactttggacccagtaatatgctcattggagcaagggttgggctgtgtggatggataaactgctttcttgggtttacatggaaacctggtaccactcctacttttggaaagttggtataaaagctattaggtagaagcttaattccactaaatgtagaatttagttttcttctctaaccaagattttagaagtttcaagtttcaaatatgcttataacttttccaagaaatgatgattacagtgcttttgtggttacaactgtttggtatattaaaaaataagggtttactatcacatctaggtcttttttactatgtcatttttaagatatgaaataagaatctgaggacagccctgaagaacagtcctttcctgggaggggaagacttgtaattcaagaggaggtgtgaaccagaactgaggaggccagttatattttaggcttttcagtagtacgattttgtcctctcccactgaggaggagggaagaagggggaagccagtgggagttccacacacgtggtcagtgctgttgaagcagtgttctcttagtagcctgaacacttctcaaagcgacttatcactagcggctttaatattgagcttctatatcgttgtgtccacctcactttttaaggctgttcatacctggcaatattcacttactctgctatttttaaaaactattttaaagttttaagcacaatgttgactcttctgtaatttcctaaaattatattgttttcctacagacagctcaactttccttgatatgtaacactttaggaaaataactgccttgtaaaataaacgtgattttttttttcttttataccagaacaaatctgctgttttggagtgtacccaaccccaaaaccaaaactcacgtttgcaaagtgtgaaacatttatatatcaggtctttcctacgtgctaggaaatagcgtatggccattaccccattaaacctttacaagacctcaatgaggtgcagataaactgtactgtccgcagtatctactcagagtcaccactcatgataactcccagaactctggctacattgggtttatagcaaataaaacttgataccccccccccaccaccaccaaatagcatttatttcacacgcagttacagcctttctgttcggcttacacgtgtcatgtggggcagtgttggctgcagttctaactgaagatcaggcatcgagggaggctgctgcccggcagagcttgggggggtcgcttggtcaccaagactcaggggccaggcctcagcgcggcaagtccatactcagaaaagaacagcttcaagggttggagtctattgaacaaccttcctaggaactgctaaataaagtcattatcagtaataaaatccttgttaatattaattatagttcaatggctaccttaagctttctatgcataatctccacagcaaccctgtgagggagattaaagcagccccatttcacagatcaggaaaagagctcaagaagtccacatctttacccagtgtggcacagctcgtacatgagtggcagtcagggtttgaacccggtcactttggctctagagtccgcactcttggcccattgtctgcattactccatccccctaacccagcagataccttcccacagactagtgcctcgtctacctcagtgcacctggtcccaacacagtggaggagaaacactgacaggcttccctctttgtccccttctctgtcctccatacagtgcccccccaccccgcaccctataccatgtctctgcaaatatctctatgctctgatgaggccattgcttcttccatgtttaatcacctcttgactagcattcaagactagctctgcctttcctaaagctaactgatcttttaaagtgattcctgcagacagcgcatctcatctgcgtgtgcactctactgttttaactctctacctaattgtattgccaagtcctagaaggcatctcattgtagcctcttacaaatgctgactgcacacacttttattctgcaataaactttaatttagcatctcatcctcattacaattcagtcactgggaattggtaatgcccttaacccttactgtcccaccctagttctatgctgaatgaagggagtaagaaggatctctggactcagcctccctgcggtagggtcaggaaggggcagttagaggtcagatggaattcttcaggaatcagggagatacgggaaattgatggaaataaaaaggcaaaaggaatgtgccaagattaatagtgtttgttttaaattttctacttttctgaaatgaagatacaattacttttacaatcagaaacgacccaataaatgggtgtgcctatatttgctctgtgaattttcgcattgcaattcacacaggcagtttctaaacatgagggctgaaaatgtagtcctttgtttactgcacagagtcctggttgaggcagatatgagagggtcgtggccgggtaatcagacagtcaggatctacacagtcgcctgaagtagactggtctgggaggcgagtccaaagtggatgctactgaggacatgcaatagttgagggaagcaattggtatcaaagg

SEQ ID NO: 463925 - DNA, 2838 bp, Homo sapiens
cactctgtacatctttctgaactcaatgaattatacactattgctgcttaattgctttcagaaatggacccctgcacaggtgggaatggatgtgttcacatatgtcagagtgagaatggcacggccaggtgtgcctgtcatgcagggtaccagctgcctgaagataaaaacatttgtgaagatataaatgagtgtgctgaaggtctttcttactgtggccactgctgtgtaaactctatgggatctttcacttgtgcctgccaaactggctttgagctgggagctgatagaaaacaatgttacagtaattggcaacagtcacagcccagactctatctttctctcagtgacttcttccttctttttccagttcacgactatactttaccagatcttgacgaatgtgagaatggagaagcctgctgtgcccagctctgcatcaactatttaggaggctacaaatgcagatgtcaggaaggctttcagatcacttccaatggttgtgaatgtgatggtaaattcctgagatttaacaattgtgaagaaggctacagaattggaaatgacagaaaaacttacccctctttagatgatgatgagctagaggaagaagaagaggaatgagaagttgtgaggtttccaggtcttctattcaagagcccacctcaacagcttcattatgttgctacttttctgcctcccacctacaaagatgaagaagatgaggaggaagaggaaaaagatattcatagagaactgactgctttgcacaattttgtctgtttagatcacatctttggacacaattgcagcttgagctgcaaggactgcatgaatggaggaaagtgccaggaaggaaagagtgaatgctcctgcccagcaggttgccgtgtcattctttgtaatgaaaactgtctcgaggatgcctacggagctggctgcacttcagaatgtcagtgtgtggaggagaataccctggaatgcagtgccaaaaatggtagttgcacctgcaaatctggttaccaaggcaacagatgccagaaagatggcctctggggaccagagggctggttctcctctgcaccctgtgaaaatggaggtcagtgcaacaaaaaaactggaaattgtgactgcactcctgattacacaagaaaatcctgtaccatattgagatgcatttcccttaccaatctggctctcagcaggcggtccagcccgatgaagtatcagcaaaatgtcagctcccacagagaagtgcgacagaggcaacagtgcagcagtgacaggcctttcaaaaagctattgtgcaaattcagttttaaaatagggatgtagttgaggactgatgggtatttcattaccaatgcgttcatctcccccatcgtccaagagaatgagagggggtcatggtgcagctgatataaagccattaagttgagtagcggttgatttggtctgtagaagatttgtcttcctatctgtatttttgaaaagttaatattcaaattagctgtcatttttagtacatacctgctaaaggggggccaagaattgttctgttttctacttgatcaccttccagtgtctcaattagatcattaaaaacaaagttaatcatgtcattactttataaacctcattgagctactgatactgttcataatgaagttcgtagcactaaagacccatcatcaacctgtctctagccagcttttgaccatgcttacgtataccctacatattttagtcattcccccaacatcatgtacatttaaaacatggtgccattgttcattgctctttcctgtaatacatgttttcttcttccatttttattccctcaagcatttattcctcaagcatttttattttccagtatatgtaaacaaaatactagagcccttctttccatagcagcaccaatcatattgtattataattagttgcctgctattaagactgcttatcattaatttttgtacaccccacttttcaatatacaaggggtactcaataaagatttgctagattcaattaaagaacatttttgacaacttaaaattccatcgaaataatttactgagtaaaaaaaaaaaaaacttgcaaaacacagcgtttatgatactgaaaaatacccagtaaccaatactcgttaaactggattgaattactcagccttttaatatagcaagaggaaatcaagaaagctgtagcaccacagctttattggtctgtactccatttctgaaaacacttttcatgagaagatttttcaatggattagaagactaacatcagacaatgatgattccttagcttcatctcaagagtccagattatttccttctatactcactttcaatgtatgcaatcattccttttaaatacaacagagttaccttagaaaagtaaacaaatgtaggctggacgccgtggctcacacctgtaatcccagcactttgggaagccgaggcgggaggatcacttgaggtcgggagttcaagaccagcctggccaaccccatctctactgaaaatacaaaaattagcctggagtggtggcacacgcctgtaatcccagctactcaggaggctgaggcaggagaatcacttgaacccgggaggcagaggttgcagtgagctgagattgcgccattgcactccagcctgggcgacaaaaaaaaaaaaaaagaaaaagaaaagtgaacaaatatctctggcttttagtgtctgtatataaaaggaaagagttcgactatataattatataatatataattcaatgtatagagaataacattatgtagtaaatatagacatgctgtatagtgatgtatta

SEQ ID NO: 463926 - DNA, 922 bp, Homo sapiens
caccccacactggtagacgccaggcttctcagactccacccagttctcctaatccaacaggagtgcatgttcccgattacctcccatgaccactggctctcacggtggctgggaaccctggcggggaggcctgcgcctcctcaagctccagtccctctggatggggcaccaagaggcaccctgagaactcagaggacccagaggctcccctcaagcaaattccctgctgaccctggacaccccttgaaggagggggcaagaggctgccacaaggctcatcttataactcccagcaaggactcccagcaaacaagttcagcttgggatctgcccaccaccaagcctggctgggaggtgggggggagcgaggggcggtggagaggcagagtccctgaacagggaaaagacaatcagttgttcccctttctggtgtcagaggcaaagaagcctgaagggctggtggtggtgctggctctgggtttattgactctgtgatcctgtccagctgtcctacagggagttccagagctctcccaaagtgcatgaggaactgcacaagtaggactggggcacaataccagaagctatttgtctcctagaacctggcaccccctccacttaccttacaggagacccacatcactcagttcccaggacacctggtgggagagtctggtgagatttggaggcagacttcctctactcacaacttgtttgaaaatggacataaagagaagaacagacactccatcgccccttcagggcctcctttgtgtcacaaaacctatcccctcctagggcacccttgacattcccctaggtgggcctacacattgttcagaacctgtcccctgtaccaaaataaatataaatgagtttgtttctttaaaagaaatattacagctttaaacttttcccagcc

SEQ ID NO: 463927 - DNA, 888 bp, Homo sapiens
caccccacactggtagacgccaggcttctcagactccacccagttctcctaatccaacaggagtgcatgttcccgattacctcccatgaccactggctctcacggtggctgggaaccctggcggggaggcctgcgcctcctcaagctccagtccctctggatggggcaccaagaggcaccctgagaactcagaggacccagaggctcccctcaagcaaattccctgctgaccctggacaccccttgaaggagggggcaagaggctgccacaaggctcatcttataactcccagcaaggactcccagcaaacaagttcagcttgggatctgcccaccaccaagcctggctgggaggtgggggggagcgaggggcggtggagaggcagagtccctgaacagggaaaagacaatcagttgttcccctttctggtgtcagaggcaaagaagcctgaagggctggtggtggtgctggctctgggtttattgactctgtgatcctgtccagctgtcctacagggagttccagagctctcccaaagtgcatgaggaactgcacaagtaggactggggcacaataccagaagctatttgtctcctagaacctggcaccccctccacttaccttacaggagacccacatcactcagttcccaggacacctggtgggagagtctggtgagatttggaggcagacttcctctactcacaacttgtttgaaaatggacataaagagaagaacagacactccatcgccccttcagggcctcctttgtgtcacaaaacctatcccctcctagggcacccttgacattcccctaggtgggcctacacattgttcagaacctgtcccctgtaccaaaataaatataaatgagtttgtttcttta

SEQ ID NO: 463928 - DNA, 1181 bp, Homo sapiens
gccgtcatctccactgaaggaggcgagactccagcacacagcgaatgtcctcgccattctattcaaagagaagagtcatcctggaacagccgtgctggaactctcagaactcagtgtgcttgagggaatccaggctggagtgcagaggcatgatcttggctcatggcaacctccacctcctgggttcaagcaattctcctgcctcagcctcctgagtagctgggactatgagatttttttttaattgaaagaagcaaggacatcagctgagaaggaggatggagaaggaggtgacagaatctggaagaataggaggtggctgatgcagtcatttattagagaccctcttgaagaccccaaggagatacagaagtgttcaatacacatttgagactagaggacatgctaatgcaaatgttgagtttgagaggactcaggagaaggatttggagagttgagaaagatcagacatcagattagatgccatacaatgaaaagagtccacggccacacagggatgagtgtccagctgttgttgccaagagcattcaccagtagacctgcatggaaatctctgcttcgggtctccttcccattctatggcaattttaacagaagaggtcctaagaggcaaaccgttaaaatggaattttggaactggatcatcaaccagccacctggcaatgaggacatcatccctcgtagtaagtggagtactgataccacctggcgtgctgtggctgcaaaagttaaaacttttacccgtgcagaagttgtgatgggatatcgtcacttctggctctttgtaaccatcctggcatgggtaattgaccctgctcatcagaagaaggaggaagaccccattccaatcaatgtgacccaccaggaggaagaccccattccaatcaatgtgacccaccaggaggaagaccccattccaatcaatgtgacccaccaggaggaagaccccattccaatcaatgtgacccaccaggaggaagaccccattccaatcaatgtgacccaccaggaggaagaccccattccaatcaatgtgacccaccaggaggaagacctcattccaatcaacgtgacccaccaggagctctagactatgtcagccctgcagagctgggctgactaaaagctgacaccagaactgccagctttgccattttctc

SEQ ID NO: 463929 - DNA, 2821 bp, Homo sapiens
tgttgaaatgggcattgtcagccgtgctattggtattttgtaaacgtcatccgttgtctgtcagtaaagttaatttttatcaaatcatttatctagaactaatgagagactgcaagagccctccagtggccaagctaagttctgcagaaataccatcatcagaatgaaaaaggaattgtatgcagttgttaaatcttgacagcgaagagaagggatggctagaattattttagctgtttaaagggccatatgctgtacttgtaggaactatgatctcataggttgaattagacaggatatcatttaatgcagtctgagactcttggcagagaagtggatgaatagaattgctacttgaagagagaaaacactctgagaggattcaagcctaaaactccagctgaatttgaatctccaggtggaagtgaattgtgaaggtgccactcttctctgctggaagtatatgcattgaggccagcgtgtctagtctgtcacaatcctgggtcgtcgggggactgtaccgagcgcccttggagtgctcgcagcagggaagaaggagcgagcagggaggagctgaggagggtcggagcggaatggacacccagagactgagatgagagaggggctataagaagagaaaccagtcgcaggaaaacagaactctcgacaaacgcacgccctctttgcgctctccgtttctctggacctggatggaattgttttactttgcatcgccggactgcgctgcggacggggtggggcggcccaatggcccccctggggttactctgctccccttcacgcttccctcccggccccgccccgcgattggccggcgcgccccggggctgccgccgattggtgctcgccggccggagccgcggggcttaaagagggggcgggggcgcgctgcccagcagcgctgctgtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccggctccgtccgcgcagccgctgagcaattcacgtccagggctctctgggctgcctggtttgggaaatgtcacgttgattcccgcacgtgcccagggccatctccgctgcccccgctacccccgcccctgctgtgggcgcgtcagactgcggggctgcggtgacgccggctcccgctccgcgccgctgggttggatagggacgagcgggcgctcctcggagggcggactccactggggagatacggagcgcgccgccgagggtcgctcgccgccacccctccagcgctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggatgctagtttcattagcacattctaaatcctaatagacaatatgaattttaagaacaactcttgttgcaaagtgcgcatatcagtgacaacaaattagtctggtaatgggttagatataaaatcaccttcttctgaaacaaggaattcatacccccagattggcatatcagatgatgaatttgagggtggatcaccactgcctttgggctggatgttgttttgaccggaacgagctagctctggaaatgtaaagctcattgtctcaagcatggcacctgctgatctcctctaggtcttctcaccacggagccccaagtgccttgtttcccctgttggcagtggtgggaggagcatggggactgaaggctccctttgtgttgctctggactgtttctgtcactcccccagagaagccagcgctaggcctgtgcaaggtcctcagggtcactgaatggggctgaacaaacacacctcattcgaccaaagaagatgaggcacctcctgggtttcgggggcctgggaactggacacagtgtcacagctagtcctggtatgggaactgtgaacactgctaattgaaatcagtttttcctgaccctgaaaatctgtaattatttttgtgaaagcttaaaaaaattatgtctgttgtacaactttatcttctcagcagttacgtttgatggtgtgaggatttggttcctgctgtggaggaagaaataggagccagttgcttctaaagccagatgagtagtacaggagcagcaggctctcagatctgtggtggatttgaggctaatctgtttgtggcttttcaagagtccctgccaaggcaggaggtgcctgtgccctgaattgtgtgatcttatcagctggagtcagatccaactgtgctgaatctggaacctactactttctagctgtgtgaactggggcagttccttaatgtctctggtcccttccataaaatgggaacaataacgcctgcttctcaggttagtaaaaacagtgaaatgatgtgtgaaaattattt

SEQ ID NO: 463930 - DNA, 2603 bp, Homo sapiens
gctaggggaatttgggctaaaaataaggacttttgctcttcttcaggaactatgatctcataggttgaattagacaggatatcatttaatgcagtctgagactcttggcagagaagtggatgaatagaattgctacttgaagagagaaaacactctgagaggattcaagcctaaaactccagctgaatttgaatctccaggtggaagtgaattgtgaaggtgccactcttctctgctggaagtatatgcattgaggccagcgtgtctagtctgtcacaatcctgggtcgtcgggggactgtaccgagcgcccttggagtgctcgcagcagggaagaaggagcgagcagggaggagctgaggagggtcggagcggaatggacacccagagactgagatgagagaggggctataagaagagaaaccagtcgcaggaaaacagaactctcgacaaacgcacgccctctttgcgctctccgtttctctggacctggatggaattgttttactttgcatcgccggactgcgctgcggacggggtggggcggcccaatggcccccctggggttactctgctccccttcacgcttccctcccggccccgccccgcgattggccggcgcgccccggggctgccgccgattggtgctcgccggccggagccgcggggcttaaagagggggcgggggcgcgctgcccagcagcgctgctgtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccggctccgtccgcgcagccgctgagcaattcacgtccagggctctctgggctgcctggtttgggaaatgtcacgttgattcccgcacgtgcccagggccatctccgctgcccccgctacccccgcccctgctgtgggcgcgtcagactgcggggctgcggtgacgccggctcccgctccgcgccgctgggttggatagggacgagcgggcgctcctcggagggcggactccactggggagatacggagcgcgccgccgagggtcgctcgccgccacccctccagcgctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggatgctagtttcattagcacattctaaatcctaatagacaatatgaattttaagaacaactcttgttgcaaagtgcgcatatcagtgacaacaaattagtctggtaatgggttagatataaaatcaccttcttctgaaacaaggaattcatacccccagattggcatatcagatgatgaatttgagggtggatcaccactgcctttgggctggatgttgttttgaccggaacgagctagctctggaaatgtaaagctcattgtctcaagcatggcacctgctgatctcctctaggtcttctcaccacggagccccaagtgccttgtttcccctgttggcagtggtgggaggagcatggggactgaaggctccctttgtgttgctctggactgtttctgtcactcccccagagaagccagcgctaggcctgtgcaaggtcctcagggtcactgaatggggctgaacaaacacacctcattcgaccaaagaagatgaggcacctcctgggtttcgggggcctgggaactggacacagtgtcacagctagtcctggtatgggaactgtgaacactgctaattgaaatcagtttttcctgaccctgaaaatctgtaattatttttgtgaaagcttaaaaaaattatgtctgttgtacaactttatcttctcagcagttacgtttgatggtgtgaggatttggttcctgctgtggaggaagaaataggagccagttgcttctaaagccagatgagtagtacaggagcagcaggctctcagatctgtggtggatttgaggctaatctgtttgtggcttttcaagagtccctgccaaggcaggaggtgcctgtgccctgaattgtgtgatcttatcagctggagtcagatccaactgtgctgaatctggaacctactactttctagctgtgtgaactggggcagttccttaatgtctctggtcccttccataaaatgggaacaataacgcctgcttctcaggttagtaaaaacagtgaaatgatgtgtgaaaattattt

SEQ ID NO: 463931 - DNA, 3448 bp, Homo sapiens
ggtgttctcagtctgacagagatttgagttctccctggcatggaggtctcaggatcttgcccagtgagggacctcccaactggggcctccagccacctccgccagtgttccggggctgacagagatttgaattctccctggcatggaggtcttgaggtcctgcccagtgaggaaactctcaaccgtggcctccagccacccgcccctgctgttctcaggctgagagagatctgaattctccctggcatgtagttctcaagatcctgtccaatgagggtccttttagctggggtctccagccaatcccaccggtgttctcaggctgacagagatttgagttctccctggcatggaggtctttaggtcctgcctgcccagtgagggacctcccaactggggcctccagccacctccaccagtgttctggggctgacagaggtttgagttctccctggcatggcggtcttggggtcccgcccagtgagggacctcccaaccggggcctccagccacctccgccagtgttctggggctgacagagatttgaattctcccaggcatggagttcttgaggtcccacccagttagggttctcctaactgggacctctggccacccccacctgtgttctcatgctgacagaggtttgaattcttcctggcatggaggtctccagttcctgcccagtgagtgtcctttcaactcaggcctctagccaactccccccacccctgccagtgttctggggctgacagagatttgaattctccttggcatggaggtatcagggtcctgctcagtgagggacctcccaacaggggcctgcaaccacccccgccagtgttctggggctgacagagatttgaattctccctggcatggaggtcttggggtctggcccactgagggatctcctaaccagggcctccagccacccccgccagtgttctggggctgacagagatttgaattctcccaggtaagcagttcttggttcttgaagtcccgcccagtaagggttctcctaactggggcctctggccacccccacctgtgttctcatgctgacagagatttgaattcttcctggcatggaggtctccacttcctgcccagtgtgggtcttttcaactcaggcctccagccacccgcccctggtgttctcaggctgacagatttgaattctccctggcacatagttcttgaggtcctgcccaatgagggtccttttatctggggtctccagccaaccccactggtgttctggggctgacagaggtttgagttctccctggcatggcagtcttggggtcccgcccagtgagggacctcccacccggggcctccagccacccccgccagtgttctggggctgagatttgaattctccctggcatggaggtctcggggtctgacccagtgaaggacctcccaactagggcctccagctacccccgccagtgttctggggctgacagagatttgagttctccctggcatggaggtcttggggtcccgcccagtgagggacctcccacccggggcctccagccacccccaccggtgttctcgggctgacagagatttgaattctccctggtatggaggtctccaggtctggcccagtgaaggacctcggcctccagccacccctgccagtgttttggggctgacagagatttgaattctccctggcatggaggtcttgaggtcctgcccagtgagggacctctcaaccgtggtctccagccacccccaccggtgttctcgggctgacagagatctgaattctccctggcatgtagttctcaaggtcccacccaatgaaggtccttttagccagagtctcctgccaatcccaccagtgttctcaggctgacagagatttgagttctccgtggcatggaggtcttggggtcttgcccagtgagggaccacccaactggggcctccagccaccctcactggtgttctgggactgacagagatttgaattctcccaggcatggagttcttgaggtcccacccagttagggttctcctaactgagacttctggccaccccctcctgtgttctcatgctgacagaggtttgaattcttcctggcatggaggtctccagttcctgcccagtgagggtcctttcaactcaggcctccagccaactccccccacccccgccaatgttctggggctgacagagatttcaattctccctggcatggaggtctcggggtcccgcccagtgaggacctcccagctagggcctgcaaccaccctgctagtgttctggggctgacagagatgtgaattctctctggcatggaggtctcggggtctggcccagtgagggacctcccatccggggcctctagccacccccgccagtgtcctggggctttcagagatttgaattctccctggcatggagttcttgaggtcccacccagtgagggttctcctaactgggccctctggccacccctacctgtgtactcacactgtagtacatgagtactacatgtacttgaattatccctggcatggaggtctccagttcctgcccagtgaaggtcctttcaacttgggcccccagccaccaccccgccccctcccccagtgtcctcaggctgccagacatttcaattattcctggcatggaggtctcaaggtcctgcctggtgagggatcaccccactgggacctccagtcactcctgctggtggaacttatcccagggagaattcaaatctccgtcagcctgagagcacctgccggagtagcagcaggccccagttgggaggtcccacccagcgaggaggaatggattggggacccacttaaagaggcagtctggccacattttggtagagcagctgtgctgcgtgggggatcccttctgccctcagttggtttgggttctcaaaagcccaacaggctggaatagctaagttacccaagcaacaaagatggtggcctgccctgtcccctaggaagtcagtctcaggtaggtaaaacactgttgctggtggctggctggagttgtttccttgattatatgagtaatgcgagtacctggttgtttcagttgaaggtactgtattgacttgctcctttcattcctctccatgagagccgtgcaccctacctgcttctagtcagtcatcttggccacacacccccataatcacattttttaagtaaatcattctttaaaactctaacaaaatatttaaacatttaaaaagtgtggagctttagaaatgcctgattacgtcttaagtttgagacacgtagcagttatgtacattggcaattccagattttgcaacttataaggaaaggacttatatcttattcagtctttgtgtgtctaaactatcttcacctgtaaaatgagtataatgaagtactttatagagttgtacatgttatatgtaaaaatata

SEQ ID NO: 463932 - DNA, 1198 bp, Homo sapiens
ggtgttctcagtctgacagagatttgagttctccctggcatggaggtctcaggatcttgcccagtgagggacctcccaactggggcctccagccacctccgccagtgttccggggctgacagagatttgaattctccctggcatggaggtcttgaggtcctgcccagtgaggaaactctcaaccgtggcctccagccacccgcccctgctgttctcaggctgagagagatctgaattctccctggcatgtagttctcaagatcctgtccaatgagggtccttttagctggggtctccagccaatcccaccggtgttctcaggctgacagagatttgagttctccctggcatggaggtctttaggtcctgcctgcccagtgagggacctcccaactggggcctccagccacctccaccagtgttctggggctgacagaggtttgagttctccctggcatggcggtcttggggtcccgcccagtgagggacctcccaaccggggcctccagccacctccgccagtgttctggggctgacagagatttgaattctcccaggcatggagttcttgaggtcccacccagttagggttctcctaactgggacctctggccacccccacctgtgttctcatgctgacagaggtttgaattcttcctggcatggaggtctccagttcctgcccagtgagtgtcctttcaactcaggcctctagccaactccccccacccctgccagtgttctggggctgacagagatttgaattctccttggcatggaggtatcagggtcctgctcagtgagggacctcccaacaggggcctgcaaccacccccgccagtgttctggggctgacagagatttgaattctccctggcatggaggtcttggggtctggcccactgagggatctcctaaccagggcctccagccacccccgccagtgttctggggctgacagagatttgaattctcccaggtaagcagttcttggttcttgaagtcccgcccagtaagggttctcctaactggggcctctggccacccccacctgtgttctcatgctgacagagatttgaattcttcctggcatggaggtctccacttcctgcccagtgtgggtcttttcaactcaggcctccagccacccgcccctgtgcgaggctagtgacgggtacctgagcgtcgaattctgtaa

SEQ ID NO: 463933 - DNA, 5979 bp, Homo sapiens
cgccggccgcattggtgagggggcgcgggctgcttggccagggcagttccctcagctccgggttggagccggagccggagccggatcccgcgcacaccgccacgtcaacctaaacctacaccgccctctccaccccaccgccgcagcgcccgctgggcccgcagcgggtctccccaggcagcgtcctccacgcctttcccacaatgctccgcgccaggccccgccccggctcgccgtggagaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttggatggtcttgttaatgtaggatggatggactgtgccacccaggataacctttgtaaaagcttagatattacaacaagtactactgcttattttcctcctggagccactttaaataacaaagagaaaaacagtattttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcagtatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgctgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcatagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaacctgttagaatatgctttattgtgttttgaggagttttcctttttttcttttcaatatcactttatcctgctcaccagtatttcctcataagggttattatagccataattaatgttaaaatagactttgttcttcatattctcccatctttttcgctactatatactctgtctggattctgctgtatgcctgttggcatatatggaacagtcaccacttgtcacacttaacaccagctttttgaattatgatcagtaatggcaagagcctttcattctcgaatgtttaaagcctaggagttctacaaaattggcttctttctacaagaatcccaaaatggaatgcctaaagaagtcttacttgggtaaatacttactaaaatatactggttatgtgcatatcaccacactggacactgaggagtgttcaaaaggaatctaagacatggtccccatcttccaactgtctgtaattcactgttttgtcattgagctcataagaaatcaacagacaaggtggatgagaactgtaaatcatcaaataagttataaaaccaccaaaaaataggagaaaatgggagtaaaaacaaaatgtataaaaagtattaaaatttgaaaaatatcttggaaataaggatggacagtttaagtacttatctcaaaaggaaaaatgttagcaattggttgtagcaatacgtccgtctgtaagtgatggtcatatttgtgttcttttgtcccagagaacaaaaggaagtgagcttatcccacagcacaagtaacgtctatttatctcagaggaaatccagggaagttcctacttgggaaaacggaaaggtagactattcagaagttttctaaaatggacttcaagctctatgactttatgatcacttagtatgtctacggattttttggggaagagagatttcacgttaaaggtcattttgtgtcttctttaaaactcttgattccttttagagttttttaaattgtgataaagtacatgtaacaaaatttattaatcattttaaagtagcatacagttcagtagtgttaagtaatttcacattgttcaacccatctccgtgactttatcttgcaaaactgaaattttatatccataaagcaaaacctttttatttaccaatgctgctagaccctgacaaccaccaccctactttctatcaatatgactaccatagatatttaatgtaagtgaaatcatacaccatttatctttttgtgattccttattttacttagcgtaagtcctcgagactcacccatgttgtagcatgtgtcataattttcttgttttgagacggagtcttactctgtccccctggctggagtgcagtggtgtgatctcagctcactgcaacctccacctcccagagttcaagaccagcctggccaacatggtgaaacgccgtctctactaaaaatacaaaaaaaaatggccaggcgtggtggtgcacgcctgtaatcccagctacttgggagtctgagacaggaaaatcgcttgaacccgggaggcagaggttacagtgagctgaggtcac

SEQ ID NO: 463934 - DNA, 1823 bp, Homo sapiens
atatttttgataattgccaaaatacactttttttgaaaaaagacatttggaattgtttgaaaaactatttaccttctataatcattttcctaaaaatactacattggaaattgaaaaaacaaaagatatcaaatataatgaatatttattcaaaaagattacaatgtgattttctttttctagtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcagtatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaag

SEQ ID NO: 463935 - DNA, 429 bp, Homo sapiens
gtttcttaggtggaaatgttatgtttttattaaatacttaaaagataacaagtgtttttaattttagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaag

SEQ ID NO: 463936 - DNA, 4771 bp, Homo sapiens
cgccggccgcattggtgagggggcgcgggctgcttggccagggcagttccctcagctccgggttggagccggagccggagccggatcccgcgcacaccgccacgtcaacctaaacctacaccgccctctccaccccaccgccgcagcgcccgctgggcccgcagcgggtctccccaggcagcgtcctccacgcctttcccacaatgctccgcgccaggccccgccccggctcgccgtggagaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttggatggtcttgttaatgtaggatggatggactgtgccacccaggataacctttgtaaaagcttagatattacaacaagtactactgcttattttcctcctggagccactttaaataacaaagagaaaaacagtattttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcagtatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgctgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcatagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaacctgttagaatatgctttattgtgttttgaggagttttcctttttttcttttcaatatcactttatcctgctcaccagtatttcctcataagggttattatagccataattaatgttaaaatagactttgttcttcatattctcccatctttttcgctactatatactctgtctggattctgctgtatgcctgttggcatatatggaacagtcaccacttgtcacacttaacaccagctttttgaattatgatcagtaatggcaagagcctttcattctcgaatgtttaaagcctaggacctcaacagcttcatgaaagtctgggaaatgcactataagctttcggtccggctc

SEQ ID NO: 463937 - DNA, 4417 bp, Homo sapiens
cgccggccgcattggtgagggggcgcgggctgcttggccagggcagttccctcagctccgggttggagccggagccggagccggatcccgcgcacaccgccacgtcaacctaaacctacaccgccctctccaccccaccgccgcagcgcccgctgggcccgcagcgggtctccccaggcagcgtcctccacgcctttcccacaatgctccgcgccaggccccgccccggctcgccgtggagaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttggatggtcttgttaatgtaggatggatggactgtgccacccaggataacctttgtaaaagcttagatattacaacaagtactactgcttattttcctcctggagccactttaaataacaaagagaaaaacagtattttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcagtatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgctgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcatagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaa

SEQ ID NO: 463938 - DNA, 4459 bp, Homo sapiens
cgccggccgcattggtgagggggcgcgggctgcttggccagggcagttccctcagctccgggttggagccggagccggagccggatcccgcgcacaccgccacgtcaacctaaacctacaccgccctctccaccccaccgccgcagcgcccgctgggcccgcagcgggtctccccaggcagcgtcctccacgcctttcccacaatgctccgcgccaggccccgccccggctcgccgtggagaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttggatggtcttgttaatgtaggatggatggactgtgccacccaggataacctttgtaaaagcttagatattacaacaagtactactgcttattttcctcctggagccactttaaataacaaagagaaaaacagtattttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcagtatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgctgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcatagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaaacaaaaaaaagggcggccgctttagagtaaccaatcgagggg

SEQ ID NO: 463939 - DNA, 2296 bp, Homo sapiens
ccataaagaagatttgatgctcttcgtaactcgcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcagtatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgctgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcatagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaa

SEQ ID NO: 463940 - DNA, 3281 bp, Homo sapiens
cgccggccgcattggtgagggggcgcgggctgcttggccagggcagttccctcagctccgggttggagccggagccggagccggatcccgcgcacaccgccacgtcaacctaaacctacaccgccctctccaccccaccgccgcagcgcccgctgggcccgcagcgggtctccccaggcagcgtcctccacgcctttcccacaatgctccgcgccaggccccgccccggctcgccgtggagaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttggatggtcttgttaatgtaggatggatggactgtgccacccaggataacctttgtaaaagcttagatattacaacaagtactactgcttattttcctcctggagccactttaaataacaaagagaaaaacagtattttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcagtatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaag

SEQ ID NO: 463941 - DNA, 1565 bp, Homo sapiens
gtttcttaggtggaaatgttatgtttttattaaatacttaaaagataacaagtgtttttaattttagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgctgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcatagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaa

SEQ ID NO: 463942 - DNA, 949 bp, Homo sapiens
cacaccactgagtccaacaatatgacattctggaaaaggcaaaactattgagacaataaaaagattagtggttgccagaagttaggagggctggaagaaatgaacaggtagggtacagaggatttttagggcggtgaagctattctgcgagatactacaacagtggatacatgccattatacacttgcaccaatagaatgcacaagatgaagaatgaactccaatgtaaactattaacttggggtaataatgatgtgtcaatgtaggttcatagattataaaaaatgtgccactctggtatgggatgctgatagttgactcaggtggtgcacaccacctgagtcccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcatagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaa

SEQ ID NO: 463943 - DNA, 1698 bp, Homo sapiens
cgccggccgcattggtgagggggcgcgggctgcttggccagggcagttccctcagctccgggttggagccggagccggagccggatcccgcgcacaccgccacgtcaacctaaacctacaccgccctctccaccccaccgccgcagcgcccgctgggcccgcagcgggtctccccaggcagcgtcctccacgcctttcccacaatgctccgcgccaggccccgccccggctcgccgtggagaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttggtaagcatcaatcattttgtaaaactatatcaccatgtaaagaaacacatttagaaattgatttgaaacattttcttcccttatttcttgaacatttaactcacctatttgtaatcttattttctgatgactgtattcatagctatgtgttttttcctgaataattagttacgttcaataaattttaacgtggta

SEQ ID NO: 463944 - DNA, 640 bp, Homo sapiens
tgtccaccatgtcgagctttactaccagagttacgaagagcatcaaatcttctttatggtcagcttaagtttggtacactagattgtacagttcatgagggactctgtaacatggtaaggcaaagtatcaaaaattattctaattaattttataaaatgaagaccttttggctgtttattattaaaacattaaaataacttagaaataatacatcttctatttagagtagtaacaaattatttaaacaaaataatatttttagaaagtggtatcaaatatgattggattaaaccatgcatagctaatcaatgcattgaatgtaaataaggtcttatttatcaaactcaggcaactattttcattaacttcataaaatgcttatatgattttccaattattgaagattgttatatttctttaatatttttgacattttataatttttttcctttggctttcttcatacttctaagtatatttgctggaaagaagttaaaacaatgaacaagccttttgaaatctttgtttaaatgaaattattttctcaggtaaatattcactcctcagttgcaggaagaactaaaaattatataccgtagaatgatagtacgtgctatctcgtataatatactttgggca

SEQ ID NO: 463945 - DNA, 2155 bp, Homo sapiens
cgccggccgcattggtgagggggcgcgggctgcttggccagggcagttccctcagctccgggttggagccggagccggagccggatcccgcgcacaccgccacgtcaacctaaacctacaccgccctctccaccccaccgccgcagcgcccgctgggcccgcagcgggtctccccaggcagcgtcctccacgcctttcccacaatgctccgcgccaggccccgccccggctcgccgtggagaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttggatggtcttgttaatgtaggatggatggactgtgccacccaggataacctttgtaaaagcttagatattacaacaagtactactgcttattttcctcctggagccactttaaataacaaagagaaaaacagtattttgctgcttcattgagagaatcagaccagcagagagagagagttatatgacaaaatatgctgaggataaaatattgacaaataaagaagatttgttagaagggccttttatactcgtttgtgttttaaataagagactcgggccgaaaacaagtttaagataagatctgtatcattgtattttactctaaaaactcctaagtggtttggtttttagatgaaaacctctataatgagcaaaagtccattccaattttccacttctaagttcctcttaattaatcttaattattggttggggaatgaagtgtctttgatagtctattattcttccttctagtgttataaaaattcttaagtgaatgtgtaaaacattggcattctgtaaaacatgattagcattaaaattaagctaaagataatgtggtttttcttgatgattgggaggtcactcaggatttttctgagcatttttatagaatacacatcatagttaattaaaaattccagttaatgca

SEQ ID NO: 463946 - DNA, 3654 bp, Homo sapiens
cgccggccgcattggtgagggggcgcgggctgcttggccagggcagttccctcagctccgggttggagccggagccggagccggatcccgcgcacaccgccacgtcaacctaaacctacaccgccctctccaccccaccgccgcagcgcccgctgggcccgcagcgggtctccccaggcagcgtcctccacgcctttcccacaatgctccgcgccaggccccgccccggctcgccgtggagaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttggatggtcttgttaatgtaggatggatggactgtgccacccaggataacctttgtaaaagcttagatattacaacaagtactactgcttattttcctcctggagccactttaaataacaaagagaaaaacagtattttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcagtatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattatt

SEQ ID NO: 463947 - DNA, 5018 bp, Homo sapiens
cgccggccgcattggtgagggggcgcgggctgcttggccagggcagttccctcagctccgggttggagccggagccggagccggatcccgcgcacaccgccacgtcaacctaaacctacaccgccctctccaccccaccgccgcagcgcccgctgggcccgcagcgggtctccccaggcagcgtcctccacgcctttcccacaatgctccgcgccaggccccgccccggctcgccgtggagaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttggatggtcttgttaatgtaggatggatggactgtgccacccaggataacctttgtaaaagcttagatattacaacaagtactactgcttattttcctcctggagccactttaaataacaaagagaaaaacagtattttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcagtatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgctgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcatagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaacctgttagaatatgctttattgtgttttgaggagttttcctttttttcttttcaatatcactttatcctgctcaccagtatttcctcataagggttattatagccataattaatgttaaaatagactttgttcttcatattctcccatctttttcgctactatatactctgtctggattctgctgtatgcctgttggcatatatggaacagtcaccacttgtcacacttaacaccagctttttgaattatgatcagtaatggcaagagcctttcattctcgaatgtttaaagcctaggagttctacaaaattggcttctttctacaagaatcccaaaatggaatgcctaaagaagtcttacttgggtaaatacttactaaaatatactggttatgtgcatatcaccacactggacactgaggagtgttcaaaaggaatctaagacatggtccccatcttccaactgtctgtaattcactgttttgtcattgagctcataaggtacttacattactacctataaatgtttcctgtacttgttagttgttgagaaacattttaggcagtaaataaaatagtaaatattatgtgtcctaaaaat

SEQ ID NO: 463948 - DNA, 4364 bp, Homo sapiens
cgccggccgcattggtgagggggcgcgggctgcttggccagggcagttccctcagctccgggttggagccggagccggagccggatcccgcgcacaccgccacgtcaacctaaacctacaccgccctctccaccccaccgccgcagcgcccgctgggcccgcagcgggtctccccaggcagcgtcctccacgcctttcccacaatgctccgcgccaggccccgccccggctcgccgtggagaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttggatggtcttgttaatgtaggatggatggactgtgccacccaggataacctttgtaaaagcttagatattacaacaagtactactgcttattttcctcctggagccactttaaataacaaagagaaaaacagtattttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcagtatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgctgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcatagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaa

SEQ ID NO: 463949 - DNA, 3061 bp, Homo sapiens
atagatggcgtcttcatgagtacaggaaattttgtcaactccatacaaactgcttttgctgctggtattggctggctgatcactttttgttcaaaaggaggagattgtttgacttcacagacacgactcaggcttagtggcatgttggatggtcttgttaatgtaggatggatggactgtgccacccaggataacctttgtaaaagcttagatattacaacaagtactactgcttattttcctcctggagccactttaaataacaaagagaaaaacagtattttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcagtatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgctgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcatagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaa

SEQ ID NO: 463950 - DNA, 2355 bp, Homo sapiens
gttgaacgtccttctgggtgtccattgttagcccctacacagcacggaaaaactcactccgcgtttccaaatacaacccggctcgtgccgagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcagtatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgctgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcatagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaa

SEQ ID NO: 463951 - DNA, 1647 bp, Homo sapiens
cgcgggtccccgcttgatcaaggtggacggctatgccactgaagcattatctccttttgctggtgggctgccaagcctggggtgcagggttggcctaccatggctgccctagcgagtgtacctgctccagggcctcccaggtggagtgcaccggggcacgcattgtggcggtgcccacccctctgccctggaacgccatgagcctgcagatcctcaacacgcacatcactgaactcaatgagtccccgttcctcaatatttcagccctcatcgccctgaggattgagaagaatgagctgtcgcgcatcacgcctggggccttccgaaacctgggctcgctgcgctatctcagcctcgccaacaacaagctgcaggttctgcccatcggcctcttccagggcctggacagccttgagtctctccttctgtccagtaaccagctgttgcagatccagccggcccacttctcccagtgcagcaacctcaaggagctgcagttgcacggcaaccacctggaatacatccctgacggagccttcgaccacctggtaggactcacgaagctcaatctgggcaagaatagcctcacccacatctcacccagggtcttccagcacctgggcaatctccaggtcctccggctgtatgagaacaggctcacggatatccccatgggcacttttgatgggcttgttaacctgcaggaactggctctacagcagaaccagattggactgctctcccctggtctcttccacaacaaccacaacctccagagactctacctgtccaacaaccacatctcccagctgccacccagcatcttcatgcagctgccccagctcaaccgtcttactctctttgggaattccctgaaggagctctctctggggatcttcgggcccatgcccaacctgcgggagctttggctctatgacaaccacatctcttctctacccgacaatgtcttcagcaacctccgccagttgcaggtcctgattcttagccgcaatcagatcagcttcatctccccgggtgccttcaacgggctaacggagcttcgggagctgtccctccacaccaacgcactgcaggacctggacgggaatgtcttccgcatgttggccaacctgcagaacatctccctgcagaacaatcgcctcagacagctcccagggaatatcttcgccaacgtcaatggcctcatggccatccagctgcagaacaaccagctggagaacttgcccctcggcatcttcgatcacctggggaaactgtgtgagctgcggctgtatgacaatccctggaggtgtgactcagacatccttccgctccgcaactggctcctgctcaaccagcctaggttagggacggacactgtacctgtgtgtttcagcccagccaatgtccgaggccagtccctcattatcatcaatgtcaacgttgctgttccaagcgtccatgtacctgagggcctgactgccttctcagtgcctggccccgagccaggtgctggggtgcagagctgcttgcagagacaccacagcaagactgcagtaccacgggctcagtcgggtgggtgcaactgactagaaaacagagcggaagagcccaaacattcaacacagtacaagagggatccgagga

SEQ ID NO: 463952 - DNA, 446 bp, Homo sapiens
  misc_feature (3)..(3): n is a, c, g, or t
canaacacatttcacacaataaccaacaaaaacataataaaaatttccacaccccacaacataagaaatttggcccaaaagaccaaaaattcggcacagtcggcaaaagaactcaattaattggtattgtatatctaatatgtgatatttgaactgaataaaacttacagtgttgtaaatgttctttaataaataatcacacctaagtaataggctagactgatgagaaattagatcaaatcagtgcctaggcctttgtgtttgtgtcgtagggatgtactaacacatcaccacagactgacggcttttcacaataaatcagttttcttcgctcacatttctggacattagaaatccaaagccaaggtgccagtagggccgggctttctctgaaggccccaggaaaactcctccttcatctcctccagctggtgtggctgctggcc

SEQ ID NO: 463953 - DNA, 3063 bp, Homo sapiens
ggactttaattttaatttattatttgttttattagagtgtctgtgttcaatatgggatattagggcgttgggtactatgaccacaggaaatttagacaggctacagttaaagtgaagcataccttacccatccaccccccattttatatttagttgcctttttaaaaagattataggggtacaatgtttagatttagtgggatctccaggtataactgtaatttgagccccagtgttaagactatgaagctttgtcaatgggtacattttagcaaatgttacaattaatttagaacctaagttatggagacacaaaagccaataggcacccttttatgttttggttaaatgtttcagtatatacatcttatttatttgtaatattagtatataatttgttgtatacatttttagtgtataagcattggatttctaattggatcagattagggaccttccgtttagctgcatatgtacatatacatgtacaatttattatatatttgcgttaaaatagcctatctgcatgtgtatatatgtgtgtatgtgtatgtatatgcactcacacgcataaatacacagtctatttagttacctttaatgttttttcccttgtacctaggctttttctcgctttttcctttttttctgattttgtggcaatttagttggaaggaggcggtcccagcatgttgacaggcagggtgttcagagtgcccaggcacactggtggggggtggttacaggctcacgtagctcaggggcttctgcaggtctcaggggagtgggaacaaagtgtcccaccccttccccttttcctcaaacctcaagccactggtctctatggatagatcctttgcatcccaccggattgaggaatgagtcacaacagctgcaaggctcttaaagcaacatttaaaccttttggcggctgtcatttctgtgaggagggtgcctctcaccagccgcatggccggaggatccctgcagcgctttggagaccaacacccagatcctttgcccaggagtgcgattaattcctcactggatgctgggggagggcccctcaggtgagcagcccaccactgacttcagcgttgctggctcggttatcagactctcatccaacacaagctcacagggaaagccgttccttgctccttgtggagggagctaccgtcattgccctgagaccaccagccaagaaagtaggtatgtccaggtagggaattcagagggacccagtgcatccaattatacaattatacccagaaggtcctgtgtaggggactgcgattgacatcaccctagtctgcagcaccaaggactgaatgagctcagtcctcttataatttaggctggactgtcacagacactggcagacacagcatacgtggtgcagccaaagtgcaaacatgccagcagcggccatgctccccagggtgggggtccagttagtaagccacgcgcagccaagaggcgaggcatgccctgtgccacacacggactcaccctgctcactgtgcccgtggtatcgaaatgtacccacgtttaattcataaaggagaggctgctgtcattgaaagaaaagtttgttacttgcatttctggagaaaaggagcgcaccaggccacgcagggccacaggaggaggacgcaccagagtggtcaggaggcagaactaggcgagcagctttccactgtgtctccatggcaaaggcgaagatgggcgggggcagagtgtaggattggcaggtttgaatgtcttgggcagtagctacaggggtggtctccagctgcctggtgcctggccctgggtgatcagggtgaggggatactgccttctgcagtggaagagtcaaatcgaggagatggactctgagttggttagtgtgcaaaggtgcactcccaagggacccctttgctatctctaagaattggcctgccctgggaagggcagtctctccccagtcagtgaggtccccaagatgtgaaaacattatacattataaaaaagcatgattaatataagctcattctagcatttcaggttacagcttctagaagaggtttgtagtctcaaatgagtaggtttttcctctagagaggggcgggcctggaccttcaagcaccccttggtgtgtttaggagctcaggagcagaagcacctgcctgcagccctgcagctaaggaagttctctcagtcactcagagcagggaggggctgagagagtcatgtgaggctcccggggtactacgacagccctcgaggtgaaggattggccctgatcataatagagaaccctgaggaagtttactgtcatgagtctcggctggttggcgcatgtgacctttgaaggatgaagatggagtttgcaacatgagtatctctaaccttttgcttttcagggatcattttcaaaaattgcattggggccttcgttatttaccatagtattttcactttcatagttttgtcacctttttgtactgtgaacagttcaaccagtgaccgacttctctctcatgctgtttaccccacacacaatttcccactcaattctgaaaataagaacctgttaataggttggaaagctgtgtactctattcatatattgttctttcatgctagtggagagtggtgtcattagcatcttaattttagagttgtgaaatgattttaccaattaggaattgaatgtgtattttttttctgtttaataagaagagcaaatttgaataaataagctggtgtagataaacttaataatcatgctttttcttgtttggagataggtgatgtgttgtcatatcctgtgatacaggtcactcatctggccttctgtttctgaagtttaagtctggtttgaatatgtaataatactactcagcatttcttgttgcctaagtgagacgaaacttaaatgttatgatatttacttcatgtattcttgtactgttcatttcaattaattggtattgtatatctaatatgtgatatttgaactgaataaaacttacagtgttgtaaatgttctttaataaataatcacacctaagtaat

SEQ ID NO: 463954 - DNA, 3007 bp, Homo sapiens
ggactttaattttaatttattatttgttttattagagtgtctgtgttcaatatgggatattagggcgttgggtactatgaccacaggaaatttagacaggctacagttaaagtgaagcataccttacccatccaccccccattttatatttagttgcctttttaaaaagattataggggtacaatgtttagatttagtgggatctccaggtataactgtaatttgagccccagtgttaagactatgaagctttgtcaatgggtacattttagcaaatgttacaattaatttagaacctaagttatggagacacaaaagccaataggcacccttttatgttttggttaaatgtttcagtatatacatcttatttatttgtaatattagtatataatttgttgtatacatttttagtgtataagcattggatttctaattggatcagattagggaccttccgtttagctgcatatgtacatatacatgtacaatttattatatatttgcgttaaaatagcctatctgcatgtgtatatatgtgtgtatgtgtatgtatatgcactcacacgcataaatacacagtctatttagttacctttaatgttttttcccttgtacctaggctttttctcgctttttcctttttttctgattttgtggcaatttagttggaaggaggcggtcccagcatgttgacaggcagggtgttcagagtgcccaggcacactggtggggggtggttacaggctcacgtagctcaggggcttctgcaggtctcaggggagtgggaacaaagtgtcccaccccttccccttttcctcaaacctcaagccactggtctctatggatagatcctttgcatcccaccggattgaggaatgagtcacaacagctgcaaggctcttaaagcaacatttaaaccttttggcggctgtcatttctgtgaggagggtgcctctcaccagccgcatggccggaggatccctgcagcgctttggagaccaacacccagatcctttgcccaggagtgcgattaattcctcactggatgctgggggagggcccctcaggtgagcagcccaccactgacttcagcgttgctggctcggttatcagactctcatccaacacaagctcacagggaaagccgttccttgctccttgtggagggagctaccgtcattgccctgagaccaccagccaagaaagtaggtatgtccaggtagggaattcagagggacccagtgcatccaattatacaattatacccagaaggtcctgtgtaggggactgcgattgacatcaccctagtctgcagcaccaaggactgaatgagctcagtcctcttataatttaggctggactgtcacagacactggcagacacagcatacgtggtgcagccaaagtgcaaacatgccagcagcggccatgctccccagggtgggggtccagttagtaagccacgcgcagccaagaggcgaggcatgccctgtgccacacacggactcaccctgctcactgtgcccgtggtatcgaaatgtacccacgtttaattcataaaggagaggctgctgtcattgaaagaaaagtttgttacttgcatttctggacaggaggcagaactaggcgagcagctttccactgtgtctccatggcaaaggcgaagatgggcgggggcagagtgtaggattggcaggtttgaatgtcttgggcagtagctacaggggtggtctccagctgcctggtgcctggccctgggtgatcagggtgaggggatactgccttctgcagtggaagagtcaaatcgaggagatggactctgagttggttagtgtgcaaaggtgcactcccaagggacccctttgctatctctaagaattggcctgccctgggaagggcagtctctccccagtcagtgaggtccccaagatgtgaaaacattatacattataaaaaagcatgattaatataagctcattctagcatttcaggttacagcttctagaagaggtttgtagtctcaaatgagtaggtttttcctctagagaggggcgggcctggaccttcaagcaccccttggtgtgtttaggagctcaggagcagaagcacctgcctgcagccctgcagctaaggaagttctctcagtcactcagagcagggaggggctgagagagtcatgtgaggctcccggggtactacgacagccctcgaggtgaaggattggccctgatcataatagagaaccctgaggaagtttactgtcatgagtctcggctggttggcgcatgtgacctttgaaggatgaagatggagtttgcaacatgagtatctctaaccttttgcttttcagggatcattttcaaaaattgcattggggccttcgttatttaccatagtattttcactttcatagttttgtcacctttttgtactgtgaacagttcaaccagtgaccgacttctctctcatgctgtttaccccacacacaatttcccactcaattctgaaaataagaacctgttaataggttggaaagctgtgtactctattcatatattgttctttcatgctagtggagagtggtgtcattagcatcttaattttagagttgtgaaatgattttaccaattaggaattgaatgtgtattttttttctgtttaataagaagagcaaatttgaataaataagctggtgtagataaacttaataatcatgctttttcttgtttggagataggtgatgtgttgtcatatcctgtgatacaggtcactcatctggccttctgtttctgaagtttaagtctggtttgaatatgtaataatactactcagcatttcttgttgcctaagtgagacgaaacttaaatgttatgatatttacttcatgtattcttgtactgttcatttcaattaattggtattgtatatctaatatgtgatatttgaactgaataaaacttacagtgttgtaaatgttctttaataaataatcacacctaagtaat

SEQ ID NO: 463955 - DNA, 2623 bp, Homo sapiens
ggactttaattttaatttattatttgttttattagagtgtctgtgttcaatatgggatattagggcgttgggtactatgaccacaggaaatttagacaggctacagttaaagtgaagcataccttacccatccaccccccattttatatttagttgcctttttaaaaagattataggggtacaatgtttagatttagtgggatctccaggtataactgtaatttgagccccagtgttaagactatgaagctttgtcaatgggtacattttagcaaatgttacaattaatttagaacctaagttatggagacacaaaagccaataggcacccttttatgttttggttaaatgtttcagtatatacatcttatttatttgtaatattagtatataatttgttgtatacatttttagtgtataagcattggatttctaattggatcagattagggaccttccgtttagctgcatatgtacatatacatgtacaatttattatatatttgcgttaaaatagcctatctgcatgtgtatatatgtgtgtatgtgtatgtatatgcactcacacgcataaatacacagtctatttagttacctttaatgttttttcccttgtacctaggctttttctcgctttttcctttttttctgattttgtggcaatttagttggaaggaggcggtcccagcatgttgacaggcagggtgttcagagtgcccaggcacactggtggggggtggttacaggctcacgtagctcaggggcttctgcaggtctcaggggagtgggaacaaagtgtcccaccccttccccttttcctcaaacctcaagccactggtctctatggatagatcctttgcatcccaccggattgaggaatgagtcacaacagctgcaaggctcttaaagcaacatttaaaccttttggcggctgtcatttctgtgaggagggtgcctctcaccagccgcatggccggaggatccctgcagcgctttggagaccaacacccagatcctttgcccaggagtgcgattaattcctcactggatgctgggggagggcccctcaggtgagcagcccaccactgacttcagcgttgctggctcggttatcagactctcatccaacacaagctcacagggaaagccgttccttgctccttgtggagggagctaccgtcattgccctgagaccaccagccaagaaagtaggtatgtccaggtagggcaggaggcagaactaggcgagcagctttccactgtgtctccatggcaaaggcgaagatgggcgggggcagagtgtaggattggcaggtttgaatgtcttgggcagtagctacaggggtggtctccagctgcctggtgcctggccctgggtgatcagggtgaggggatactgccttctgcagtggaagagtcaaatcgaggagatggactctgagttggttagtgtgcaaaggtgcactcccaagggacccctttgctatctctaagaattggcctgccctgggaagggcagtctctccccagtcagtgaggtccccaagatgtgaaaacattatacattataaaaaagcatgattaatataagctcattctagcatttcaggttacagcttctagaagaggtttgtagtctcaaatgagtaggtttttcctctagagaggggcgggcctggaccttcaagcaccccttggtgtgtttaggagctcaggagcagaagcacctgcctgcagccctgcagctaaggaagttctctcagtcactcagagcagggaggggctgagagagtcatgtgaggctcccggggtactacgacagccctcgaggtgaaggattggccctgatcataatagagaaccctgaggaagtttactgtcatgagtctcggctggttggcgcatgtgacctttgaaggatgaagatggagtttgcaacatgagtatctctaaccttttgcttttcagggatcattttcaaaaattgcattggggccttcgttatttaccatagtattttcactttcatagttttgtcacctttttgtactgtgaacagttcaaccagtgaccgacttctctctcatgctgtttaccccacacacaatttcccactcaattctgaaaataagaacctgttaataggttggaaagctgtgtactctattcatatattgttctttcatgctagtggagagtggtgtcattagcatcttaattttagagttgtgaaatgattttaccaattaggaattgaatgtgtattttttttctgtttaataagaagagcaaatttgaataaataagctggtgtagataaacttaataatcatgctttttcttgtttggagataggtgatgtgttgtcatatcctgtgatacaggtcactcatctggccttctgtttctgaagtttaagtctggtttgaatatgtaataatactactcagcatttcttgttgcctaagtgagacgaaacttaaatgttatgatatttacttcatgtattcttgtactgttcatttcaattaattggtattgtatatctaatatgtgatatttgaactgaataaaacttacagtgttgtaaatgttctttaataaataatcacacctaagtaat

SEQ ID NO: 463956 - DNA, 3029 bp, Homo sapiens
ggactttaattttaatttattatttgttttattagagtgtctgtgttcaatatgggatattagggcgttgggtactatgaccacaggaaatttagacaggctacagttaaagtgaagcataccttacccatccaccccccattttatatttagttgcctttttaaaaagattataggggtacaatgtttagatttagtgggatctccaggtataactgtaatttgagccccagtgttaagactatgaagctttgtcaatgggtacattttagcaaatgttacaattaatttagaacctaagttatggagacacaaaagccaataggcacccttttatgttttggttaaatgtttcagtatatacatcttatttatttgtaatattagtatataatttgttgtatacatttttagtgtataagcattggatttctaattggatcagattagggaccttccgtttagctgcatatgtacatatacatgtacaatttattatatatttgcgttaaaatagcctatctgcatgtgtatatatgtgtgtatgtgtatgtatatgcactcacacgcataaatacacagtctatttagttacctttaatgttttttcccttgtacctaggctttttctcgctttttcctttttttctgattttgtggcaatttagttggaaggaggcggtcccagcatgttgacaggcagggtgttcagagtgcccaggcacactggtggggggtggttacaggctcacgtagctcaggggcttctgcaggtctcaggggagtgggaacaaagtgtcccaccccttccccttttcctcaaacctcaagccactggtctctatggatagatcctttgcatcccaccggattgaggaatgagtcacaacagctgcaaggctcttaaagcaacatttaaaccttttggcggctgtcatttctgtgaggagggtgcctctcaccagccgcatggccggaggatccctgcagcgctttggagaccaacacccagatcctttgcccaggagtgcgattaattcctcactggatgctgggggagggcccctcaggtgagcagcccaccactgacttcagcgttgctggctcggttatcagactctcatccaacacaagctcacagggaaagccgttccttgctccttgtggagggagctaccgtcattgccctgagaccaccagccaagaaagtaggtatgtccaggtagggaattcagagggacccagtgcatccaattatacaattatacccagaaggtcctgtgtaggggactgcgattgacatcaccctagtctgcagcaccaaggactgaatgagctcagtcctcttataatttaggctggactgtcacagacactggcagacacagcatacgtggtgcagccaaagtgcaaacatgccagcagcggccatgctccccagggtgggggtccagttagtaagccacgcgcagccaagaggcgaggcatgccctgtgccacacacggactcaccctgctcactgtgcccgtggtatcgaaatgtacccacgtttaattcataaaggagaggctgctgtcattgaaagaaaagtttgttacttgcatttctggagaaaaggagcgcaccaggccacgcagggccacaggaggaggacgcaccagagtggtcaggaggcagaactaggcgagcagctttccactgtgtctccatggcaaaggcgaagatgggcgggggcagagtgtaggattggcaggtttgaatgtcttgggcagtagctacaggggtggtctccagctgcctggtgcctggccctgggtgatcagggtgaggggatactgccttctgcagtggaagagtcaaatcgaggagatggactctgagttggttagtgtgcaaaggtgcactcccaagggacccctttgctatctctaagaattggcctgccctgggaagggcagtctctccccagtcagtgaggtccccaagatgtgaaaacattatacattataaaaaagcatgattaatataagctcattctagcatttcaggttacagcttctagaagaggtttgtagtctcaaatgagtaggtttttcctctagagaggggcgggcctggaccttcaagcaccccttggtgtgtttaggagctcaggagcagaagcacctgcctgcagccctgcagctaaggaagttctctcagtcactcagagcagggaggggctgagagagtcatgtgaggctcccggggtactacgacagccctcgaggtgaaggattggccctgatcataatagagaaccctgaggaagtttactgtcatgagtctcggctggttggcgcatgtgacctttgaaggatgaagatggagtttgcaacatgagtatctctaaccttttgcttttcagggatcattttcaaaaattgcattggggccttcgttatttaccatagtattttcactttcatagttttgtcacctttttgtactgtgaacagttcaaccagtgaccgacttctctctcatgctgtttaccccacacacaatttcccactcaattctgaaaataagaacctgttaataggttggaaagctgtgtactctattcatatattgttctttcatgctagtggagagtggtgtcattagcatcttaattttagagttgtgaaatgattttaccaattaggaattgaatgtgtattttttttctgtttaataagaagagcaaatttgaataaataagctggtgtagataaacttaataatcatgctttttcttgtttggagataggtgatgtgttgtcatatcctgtgatacaggtcactcatctggccttctgtttctgaagtttaagtctggtttgaatatgtaataatactactcagcatttcttgttgcctaagtgagacgaaacttaaatgttatgatatttacttcatgtattcttgtactgttcatttcaattaattggtattgtatatctaatatgtgatatttgaactgaataaaacttacagtgttgta

SEQ ID NO: 463957 - DNA, 3009 bp, Homo sapiens
ggactttaattttaatttattatttgttttattagagtgtctgtgttcaatatgggatattagggcgttgggtactatgaccacaggaaatttagacaggctacagttaaagtgaagcataccttacccatccaccccccattttatatttagttgcctttttaaaaagattataggggtacaatgtttagatttagtgggatctccaggtataactgtaatttgagccccagtgttaagactatgaagctttgtcaatgggtacattttagcaaatgttacaattaatttagaacctaagttatggagacacaaaagccaataggcacccttttatgttttggttaaatgtttcagtatatacatcttatttatttgtaatattagtatataatttgttgtatacatttttagtgtataagcattggatttctaattggatcagattagggaccttccgtttagctgcatatgtacatatacatgtacaatttattatatatttgcgttaaaatagcctatctgcatgtgtatatatgtgtgtatgtgtatgtatatgcactcacacgcataaatacacagtctatttagttacctttaatgttttttcccttgtacctaggctttttctcgctttttcctttttttctgattttgtggcaatttagttggaaggaggcggtcccagcatgttgacaggcagggtgttcagagtgcccaggcacactggtggggggtggttacaggctcacgtagctcaggggcttctgcaggtctcaggggagtgggaacaaagtgtcccaccccttccccttttcctcaaacctcaagccactggtctctatggatagatcctttgcatcccaccggattgaggaatgagtcacaacagctgcaaggctcttaaagcaacatttaaaccttttggcggctgtcatttctgtgaggagggtgcctctcaccagccgcatggccggaggatccctgcagcgctttggagaccaacacccagatcctttgcccaggagtgcgattaattcctcactggatgctgggggagggcccctcaggtgagcagcccaccactgacttcagcgttgctggctcggttatcagactctcatccaacacaagctcacagggaaagccgttccttgctccttgtggagggagctaccgtcattgccctgagaccaccagccaagaaagtaggtatgtccaggtagggaattcagagggacccagtgcatccaattatacaattatacccagaaggtcctgtgtaggggactgcgattgacatcaccctagtctgcagcaccaaggactgaatgagctcagtcctcttataatttaggctggactgtcacagacactggcagacacagcatacgtggtgcagccaaagtgcaaacatgccagcagcggccatgctccccagggtgggggtccagttagtaagccacgcgcagccaagaggcgaggcatgccctgtgccacacacggactcaccctgctcactgtgcccgtggtatcgaaatgtacccacgtttaattcataaaggagaggctgctgtcattgaaagaaaagtttgttacttgcatttctggagaaaaggagcgcaccaggccacgcagggccacaggaggaggacgcaccagagtggtcaggaggcagaactaggcgagcagctttccactgtgtctccatggcaaaggcgaagatgggcgggggcagagtgtaggattggcaggtttgaatgtcttgggcagtagctacaggggtggtctccagctgcctggtgcctggccctgggtgatcagggtgaggggatactgccttctgcagtggaagagtcaaatcgaggagatggactctgagttggttagtgtgcaaaggtgcactcccaagggacccctttgctatctctaagaattggcctgccctgggaagggcagtctctccccagtcagtgaggtccccaagatgtgaaaacattatacattataaaaaagcatgattaatataagctcattctagcatttcaggttacagcttctagaagaggtttgtagtctcaaatgagtaggtttttcctctagagaggggcgggcctggaccttcaagcaccccttggtgtgtttaggagctcaggagcagaagcacctgcctgcagccctgcagctaaggaagttctctcagtcactcagagcagggaggggctgagagagtcatgtgaggctcccggggtactacgacagccctcgaggtgaaggattggccctgatcataatagagaaccctgaggaagtttactgtcatgagtctcggctggttggcgcatgtgacctttgaaggatgaagatggagtttgcaacatgagtatctctaaccttttgcttttcagggatcatttttttgtcacctttttgtactgtgaacagttcaaccagtgaccgacttctctctcatgctgtttaccccacacacaatttcccactcaattctgaaaataagaacctgttaataggttggaaagctgtgtactctattcatatattgttctttcatgctagtggagagtggtgtcattagcatcttaattttagagttgtgaaatgattttaccaattaggaattgaatgtgtattttttttctgtttaataagaagagcaaatttgaataaataagctggtgtagataaacttaataatcatgctttttcttgtttggagataggtgatgtgttgtcatatcctgtgatacaggtcactcatctggccttctgtttctgaagtttaagtctggtttgaatatgtaataatactactcagcatttcttgttgcctaagtgagacgaaacttaaatgttatgatatttacttcatgtattcttgtactgttcatttcaattaattggtattgtatatctaatatgtgatatttgaactgaataaaacttacagtgttgtaaatgttctttaataaataatcacacctaagtaat

SEQ ID NO: 463958 - DNA, 3021 bp, Homo sapiens
  misc_feature (2981)..(2981): n is a, c, g, or t
  misc_feature (2998)..(2998): n is a, c, g, or t
ggactttaattttaatttattatttgttttattagagtgtctgtgttcaatatgggatattagggcgttgggtactatgaccacaggaaatttagacaggctacagttaaagtgaagcataccttacccatccaccccccattttatatttagttgcctttttaaaaagattataggggtacaatgtttagatttagtgggatctccaggtataactgtaatttgagccccagtgttaagactatgaagctttgtcaatgggtacattttagcaaatgttacaattaatttagaacctaagttatggagacacaaaagccaataggcacccttttatgttttggttaaatgtttcagtatatacatcttatttatttgtaatattagtatataatttgttgtatacatttttagtgtataagcattggatttctaattggatcagattagggaccttccgtttagctgcatatgtacatatacatgtacaatttattatatatttgcgttaaaatagcctatctgcatgtgtatatatgtgtgtatgtgtatgtatatgcactcacacgcataaatacacagtctatttagttacctttaatgttttttcccttgtacctaggctttttctcgctttttcctttttttctgattttgtggcaatttagttggaaggaggcggtcccagcatgttgacaggcagggtgttcagagtgcccaggcacactggtggggggtggttacaggctcacgtagctcaggggcttctgcaggtctcaggggagtgggaacaaagtgtcccaccccttccccttttcctcaaacctcaagccactggtctctatggatagatcctttgcatcccaccggattgaggaatgagtcacaacagctgcaaggctcttaaagcaacatttaaaccttttggcggctgtcatttctgtgaggagggtgcctctcaccagccgcatggccggaggatccctgcagcgctttggagaccaacacccagatcctttgcccaggagtgcgattaattcctcactggatgctgggggagggcccctcaggtgagcagcccaccactgacttcagcgttgctggctcggttatcagactctcatccaacacaagctcacagggaaagccgttccttgctccttgtggagggagctaccgtcattgccctgagaccaccagccaagaaagtaggtatgtccaggtagggaattcagagggacccagtgcatccaattatacaattatacccagaaggtcctgtgtaggggactgcgattgacatcaccctagtctgcagcaccaaggactgaatgagctcagtcctcttataatttaggctggactgtcacagacactggcagacacagcatacgtggtgcagccaaagtgcaaacatgccagcagcggccatgctccccagggtgggggtccagttagtaagccacgcgcagccaagaggcgaggcatgccctgtgccacacacggactcaccctgctcactgtgcccgtggtatcgaaatgtacccacgtttaattcataaaggagaggctgctgtcattgaaagaaaagtttgttacttgcatttctggagaaaaggagcgcaccaggccacgcagggccacaggaggaggacgcaccagagtggtcaggaggcagaactaggcgagcagctttccactgtgtctccatggcaaaggcgaagatgggcgggggcagagtgtaggattggcaggtttgaatgtcttgggcagtagctacaggggtggtctccagctgcctggtgcctggccctgggtgatcagggtgaggggatactgccttctgcagtggaagagtcaaatcgaggagatggactctgagttggttagtgtgcaaaggtgcactcccaagggacccctttgctatctctaagaattggcctgccctgggaagggcagtctctccccagtcagtgaggtccccaagatgtgaaaacattatacattataaaaaagcatgattaatataagctcattctagcatttcaggttacagcttctagaagaggtttgtagtctcaaatgagtaggtttttcctctagagaggggcgggcctggaccttcaagcaccccttggtgtgtttaggagctcaggagcagaagcacctgcctgcagccctgcagctaaggaagttctctcagtcactcagagcagggaggggctgagagagtcatgtgaggctcccggggtactacgacagccctcgaggtgaaggattggccctgatcataatagagaaccctgaggaagtttactgtcatgagtctcggctggttggcgcatgtgacctttgaaggatgaagatggagtttgcaacatgagtatctctaaccttttgcttttcagggatcattttcaaaaattgcattggggccttcgttatttaccatagtattttcactttcatagttttgtcacctttttgtactgtgaacagttcaaccagtgaccgacttctctctcatgctgtttaccccacacacaatttcccactcaattctgaaaataagaacctgttaataggttggaaagctgtgtactctattcatatattgttctttcatgctagtggagagtggtgtcattagcatcttaattttagagttgtgaaatgattttaccaattaggaattgaatgtgtattttttttctgtttaataagaagagcaaatttgaataaataagctggtgtagataaacttaataatcatgctttttcttgtttggagataggtgatgtgttgtcatatcctgtgatacaggtcactcatctggccttctgtttctgaagtttaagtctggtttgaatatgtaataatactactcagcatttcttgttgcctaagtgagacgaaacttaaatgttatgatatttacttcatgtattcttgtactgttcattacggtcttctaaacctnacacgcgccctttgggntggaaaaaccttacccttgtggt

SEQ ID NO: 463959 - DNA, 3009 bp, Homo sapiens
ggactttaattttaatttattatttgttttattagagtgtctgtgttcaatatgggatattagggcgttgggtactatgaccacaggaaatttagacaggctacagttaaagtgaagcataccttacccatccaccccccattttatatttagttgcctttttaaaaagattataggggtacaatgtttagatttagtgggatctccaggtataactgtaatttgagccccagtgttaagactatgaagctttgtcaatgggtacattttagcaaatgttacaattaatttagaacctaagttatggagacacaaaagccaataggcacccttttatgttttggttaaatgtttcagtatatacatcttatttatttgtaatattagtatataatttgttgtatacatttttagtgtataagcattggatttctaattggatcagattagggaccttccgtttagctgcatatgtacatatacatgtacaatttattatatatttgcgttaaaatagcctatctgcatgtgtatatatgtgtgtatgtgtatgtatatgcactcacacgcataaatacacagtctatttagttacctttaatgttttttcccttgtacctaggctttttctcgctttttcctttttttctgattttgtggcaatttagttggaaggaggcggtcccagcatgttgacaggcagggtgttcagagtgcccaggcacactggtggggggtggttacaggctcacgtagctcaggggcttctgcaggtctcaggggagtgggaacaaagtgtcccaccccttccccttttcctcaaacctcaagccactggtctctatggatagatcctttgcatcccaccggattgaggaatgagtcacaacagctgcaaggctcttaaagcaacatttaaaccttttggcggctgtcatttctgtgaggagggtgcctctcaccagccgcatggccggaggatccctgcagcgctttggagaccaacacccagatcctttgcccaggagtgcgattaattcctcactggatgctgggggagggcccctcaggtgagcagcccaccactgacttcagcgttgctggctcggttatcagactctcatccaacacaagctcacagggaaagccgttccttgctccttgtggagggagctaccgtcattgccctgagaccaccagccaagaaagtaggtatgtccaggtagggaattcagagggacccagtgcatccaattatacaattatacccagaaggtcctgtgtaggggactgcgattgacatcaccctagtctgcagcaccaaggactgaatgagctcagtcctcttataatttaggctggactgtcacagacactggcagacacagcatacgtggtgcagccaaagtgcaaacatgccagcagcggccatgctccccagggtgggggtccagttagtaagccacgcgcagccaagaggcgaggcatgccctgtgccacacacggactcaccctgctcactgtgcccgtggtatcgaaatgtacccacgtttaattcataaaggagaggctgctgtcattgaaagaaaagtttgttacttgcatttctggagaaaaggagcgcaccaggccacgcagggccacaggaggaggacgcaccagagtggtcaggaggcagaactaggcgagcagctttccactgtgtctccatggcaaaggcgaagatgggcgggggcagagtgtaggattggcaggtttgaatgtcttgggcagtagctacaggggtggtctccagctgcctggtgcctggccctgggtgatcagggtgaggggatactgccttctgcagtggaagagtcaaatcgaggagatggactctgagttggttagtgtgcaaaggtgcactcccaagggacccctttgctatctctaagaattggcctgccctgggaagggcagtctctccccagtcagtgaggtccccaagatgtgaaaacattatacattataaaaaagcatgattaatataagctcattctagcatttcaggttacagcttctagaagaggtttgtagtctcaaatgagtaggtttttcctctagagaggggcgggcctggaccttcaagcaccccttggtgtgtttaggagctcaggagcagaagcacctgcctgcagccctgcagctaaggaagttctctcagtcactcagagcagggaggggctgagagagtcatgtgaggctcccggggtactacgacagccctcgaggtgaaggattggccctgatcataatagagaaccctgaggaagtttactgtcatgagtctcggctggttggcgcatgtgacctttgaaggatgaagatggagtttgcaacatgagtatctctaaccttttgcttttcagggatcattttcaaaaattgcattggggccttcgttatttaccatagtattttcactttcatagttttgtcacctttttgtactgtgaacagttcaaccagtgaccgacttctctctcatgctgtttaccccacacacaatttcccactcaattctgtctttcatgctagtggagagtggtgtcattagcatcttaattttagagttgtgaaatgattttaccaattaggaattgaatgtgtattttttttctgtttaataagaagagcaaatttgaataaataagctggtgtagataaacttaataatcatgctttttcttgtttggagataggtgatgtgttgtcatatcctgtgatacaggtcactcatctggccttctgtttctgaagtttaagtctggtttgaatatgtaataatactactcagcatttcttgttgcctaagtgagacgaaacttaaatgttatgatatttacttcatgtattcttgtactgttcatttcaattaattggtattgtatatctaatatgtgatatttgaactgaataaaacttacagtgttgtaaatgttctttaataaataatcacacctaagtaat

SEQ ID NO: 463960 - DNA, 2285 bp, Homo sapiens
ggtggaagtttaggctcaagtgggtcccgtatcggatgagcagctgcacggcctgtgggagccctgggcaacatttaaaccttttggcggctgtcatttctgtgaggagggtgcctctcaccagccgcatggccggaggatccctgcagcgctttggagaccaacacccagatcctttgcccaggagtgagcagcccaccactgacttcagcgttgctggctcggttatcagactctcatccaacacaagctcacagggaaagccgttccttgctccttgtggagggagctaccgtcattgccctgagaccaccagccaagaaagtaggtatgtccaggtaggggctggactgtcacagacactggcagacacagcatacgtggtgcagccaaagtgcaaacatgccagcagcggccatgctccccagggtgggggtccagttagtaagccacgcgcagccaagaggcgaggcatgccctgtgccacacacggactcaccctgctcactgtgcccgtggtatcgaaatgtacccacgtttaattcataaaggagaggctgctgtcattgaaagaaaagtttgttacttgcatttctggagaaaaggagcgcaccaggccacgcagggccacaggaggaggacgcaccagagtggtcaggaggcagaactaggcgagcagctttccactgtgtctccatggcaaaggcgaagatgggcgggggcagagtgtaggattggcaggtttgaatgtcttgggcagtagctacaggggtggtctccagctgcctggtgcctggccctgggtgatcagggtgaggggatactgccttctgcagtggaagagtcaaatcgaggagatggactctgagttggttagtgtgcaaaggtgcactcccaagggacccctttgctatctctaagaattggcctgccctgggaagggcagtctctccccagtcagtgaggtccccaagatgtgaaaacattatacattataaaaaagcatgattaatataagctcattctagcatttcaggttacagcttctagaagaggtttgtagtctcaaatgagtaggtttttcctctagagaggggcgggcctggaccttcaagcaccccttggtgtgtttaggagctcaggagcagaagcacctgcctgcagccctgcagctaaggaagttctctcagtcactcagagcagggaggggctgagagagtcatgtgaggctcccggggtactacgacagccctcgaggtgaaggattggccctgatcataatagagaaccctgaggaagtttactgtcatgagtctcggctggttggcgcatgtgacctttgaaggatgaagatggagtttgcaacatgagtatctctaaccttttgcttttcagggatcattttcaaaaattgcattggggccttcgttatttaccatagtattttcactttcatagttttgtcacctttttgtactgtgaacagttcaaccagtgaccgacttctctctcatgctgtttaccccacacacaatttcccactcaattctgaaaataagaacctgttaataggttggaaagctgtgtactctattcatatattgttctttcatgctagtggagagtggtgtcattagcatcttaattttagagttgtgaaatgattttaccaattaggaattgaatgtgtattttttttctgtttaataagaagagcaaatttgaataaataagctggtgtagataaacttaataatcatgctttttcttgtttggagataggtgatgtgttgtcatatcctgtgatacaggtcactcatctggccttctgtttctgaagtttaagtctggtttgaatatgtaataatactactcagcatttcttgttgcctaagtgagacgaaacttaaatgttatgatatttacttcatgtattcttgtactgttcatttcaattaattggtattgtatatctaatatgtgatatttgaactgaataaaacttacagtgttgtaaatgttctttaataaataatcacacctaagtaataggctagactgatgagaaattagatcaaatcagtgcctaggcctttgtgtttgtgtcgtagggatgtactaacacatcaccacagactgacggcttttcacaataaatcagttttcttcgctcacatttctggacattagaaatccaaagccaaggtgccagtagggccgggctttctctgaaggccccaggaaaactcctccttcatctcctccagctggtgtggctgctggcc

SEQ ID NO: 463961 - DNA, 206 bp, Homo sapiens
  misc_feature (32)..(32): n is a, c, g, or t
  misc_feature (37)..(37): n is a, c, g, or t
ggcggttagcaacaaaaaaaaaaaaaaaggancgtcnatggcaacatgttccactgatgagaaaaccggcaaagacaggttaggcagaagaaaagagagatgagacaacggactgtgccaacaaactaaaattttacctgctgctatggataaaatagctttctttttagaaatactcatgttaataaactcctacatgcgacata

SEQ ID NO: 463962 - DNA, 204 bp, Homo sapiens
  misc_feature (48)..(48): n is a, c, g, or t
aacaatatgaagtcattaacagaaccaaagctgttcgagcaaacgttntactagtttacaaaaccggcaaagacaggttaggcagaagaaaagagagatgagacaacggactgtgccaacaaactaaaattttacctgctgctatggataaaatagctttctttttagaaatactcatgttaataaactcctacatgcgacata

SEQ ID NO: 463963 - DNA, 1161 bp, Homo sapiens
acgttggagagctgttatctgaattcatctgggaaaaaaaagggtttattcttaataatggggagtctcgggtatgtctttatcagcagcatgaaaacaagtaaattggtaccagtagagtggggtgttgctgaaaagatacccgatgactttggaactggagacttgttgaatggctttgataaaaatgctgatagtgatatgaacagtaagatccagactgaggtggtctcagatggagatgaggaacttgttggaaactggagcaaaggtgactcttactatgttttagcaaagagactggaggcattttgcccctgccctagagatctgtggaactttgaacttgagagagatgatttagggtatctggcagaagaaatttctaagcagaaaagcattcaagaggtgacttgggtactgttaaaagcattccattttaaaagtggagctgtgagaaggggaccaccatcctccagaccccagaatggtagatccaccgacagcttgccctgtgcacctggaaaagctgcagacaatcagtgccagcccataaaagcagtcaagagagaggctctaccctgcaaagccacaggggcagagctgcccaagaccatgggaaccccctcttgcatcagtgtaacctggatctggaatataggcataaaagagaaggcaagaaatgaagctgaaatgggatatgtgcccttgactaatgaaggttcctccttaatctgcgaagtttctgcaaagcttgctgagagacacccacagagtggaaaccaggcagaagagaagactcacatgcccacctcaccggccaaagaacccttgagagcaacagcacaacggatgtcagagccaggacatccaagaacaggtctaccaatcctgcaagaaacaccaaactgaatttcaagatatcgtgaaaacaacttactgaagcttggagttggaacaattctagcttattgaggagctcttcaaattagaaggcaacatgttccactgatgagaaaaccggcaaagacaggttaggcagaagaaaagagagatgagacaacggactgtgccaacaaactaaaattttacctgctgctatggataaaatagctttctttttagaaatactcatgttaataaactcctacatgcgacata

SEQ ID NO: 463964 - DNA, 2720 bp, Homo sapiens
ctcccctccccagtccccagccccttgtgagctccgttccactttccgtccctgtgcactgggctactctagacacctcttggagccaggaaggggactgggctggggtgggaaccacaggtaggcatcggaggggctgccagtagacctggtttgggtggcgctgccggtagagctggttggggcggggctgcaggtggagctggttggggcggggctgcaggtggaggtggttggggcggggctgcaggtggagatggttggggcggggctgcaggtggaggtggttggggcggggctgcaggtggaggcggttgaggggagcaaggtgggaggtggagcagctgctatttaagagggggtggtggtgccggttctgcaattaggttactgtgtcttgctggggcttggtcttgtttgctgaaggggcagcagggctctaccatggagggtgtagggggtctctggccttgggtgctgggtctgctctccttgccagggagctccttccctgaggtcatctagaccttggcaccagttggggttgagcagggaggctgggaaggctccttggctttgtgctggagcctactcttcctagggactgagtcttaccgtctgatcccccacacccaccccatgtcctgctgtctggtctcaccggtgggtgctccaggcatctgtgtatgcccctgtctgtctggaccaggtgtgatcctaggagcgcccctggcctccagctgcgcaggagcctgtggtaccagcttcccagatggcctcacccctgagggaacccaggcctccggggacaaggacattcctgcaattaaccaagggctcatcctggaagaaaccccagagagcagcttcctcatcgagggggacatcatccggccgagtcccttccgactgctgtcagcaaccagcaacaaatggcccatgggtggtagtggtgtcgtggaggtccccttcctgctctccagcaagtacggtgagtgagcatggcgcgctccctccctgcctcagccccttcttcctaatgcggcaggtgttcctctcttcccttttcctcttacaccatcacatcccttccacctccccacccgaagaacctgtccacagatgcccttctgttgctgaaggtctcctgagtagggagggttaaaatctgatgggaaggtatgtcgagtggggatctggttccccttgagaccatgcggtgcagaggacagtgacctacccaaggccacacagccagggtctgtctggggcccagcttcttcctggcaccactaagctgccctttcttgatgctattttgggagagtgagttcagagctctgctcccagaccctcaggtagagctcaaagaccaccagggctctgggggctcagccaggtggtgtcttccagatgagcccagccgccaggtcatcctggaggctcttgcggagtttgaacgttccacgtgcatcaggtttgtcacctatcaggaccagagagacttcatttccatcatccccatgtatgggtgcttctcgagtgtggggcgcagtggagggatgcaggtggtctccctggcgcccacgtgtctccagaagggccggggcattgtccttcatgagctcatgcatgtgctgggcttctggcacgagcacacgcgggccgaccgggaccgctatatccgtgtcaactggaacgagatcctgccaggtgagccaggccacacgcaggacaggctggtgccggggaggggacagcacggcttgggcccaagtcgcctggtccccatgggctttgaaatcaacttcatcaagtctcagagcagcaacatgctgacgccctatgactactcctctgtgatgcactatgggaggctcgccttcagccggcgtgggctgcccaccatcacaccactttgggcccccagtgtccacatcggccagcgatggaacctgagtgcctcggacatcacccgggtcctcaaactctacggctgcagcccaagtggccccaggccccgtgggagaggtaatcactaacctactttgcctctccggatttgcctagacatttcccataagtggaatcataacacatagcctcttgtgtctggcttcttaatgttttcaaggttcatccatgttgtagcatgtatcaataacatcgctgaataacattccgttggatagatatgccatacttagtcaccagttgagggacacttgggtttttactttgcagctattatgaatagagctactatggtcatttatgtacaagattttgtgtcaacatgtcatttcttttggcggtatacgagggttccgatttctcccatccttgctgacacttcttatctatcattttggttagaaccagcctagtgagtgtgaagtagtatctcattgtagttctgagttgcatttccctaataactaatgatgaacatcttttaatgtgcttgttggtcatctgcatctttggagaatgttcatatcctctgtctgtttttcttcaattgggttctctcttctgagttgtaagagttctttatatattctagacacatgtccctcatcagatgttgcccttaaatatttcatcacttcctatgttttttgtttttcccactttttaataatgtcctttgaacactaacatcttaaatttggaagtccaactgaccaattttgtcactcctttttggtgtctatgac

SEQ ID NO: 463965 - DNA, 997 bp, Homo sapiens
gtgtccacagctgccccaaacagcacacctacattgtgtgagtggttgaatcctccctctcctctcttcccctcccctccccagcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgtgacaagagcgagactctatccgaaaaacaaaacaaaaaaagggctgggcacggtagttcacacttgcaatcccagcactctgggaggccgaggcgggcggatcacgaggtcaagagatccacaccatcctggccaacaggtgaaaccccatctc

SEQ ID NO: 463966 - DNA, 1277 bp, Homo sapiens
ttccctgactgggggcggtacagatcctcgccattgtgcatggctggtgtgcatgcaaggagtagtgtcaaacacgttgggcggccaaatcagtgttgtaattagtaaaggcattataaccactggatccaccatggtggagcacaattactatgtgtctgcctacagaatcctgtacagtgatgatgggcagaaatggactgtgtacagagagcctggtgtggagcaagataaggatgtgcgtaataactttttgccaccaattattgcacgttttattagagtgaatcctacccaatggcagcagaaaattgccatgaaaatggagctgctcggatgtcagtttattcctaaaggtcgtcctccaaaacttactcaacctccacctcctcggaacagcaatgacctcaaaaacactacagcccctccaaaaatagccaaagatgtagcgctggctgcagttcttgtccctgtgctggtcatggtcctcactactctcattctcatattagtgtgtgcttggcactggagaaacaggaacgtagttgaaatcactgatgagtgtggctttatgacaaggagtaaaggagcagataccattaatatgctgtggaaaatagggaggatgagaatgataataaaaacagctgcagcttattgaatccagagctcattctaagcactttatacgtaatgaataagtaaccagaagctttgtcacttatgtgtataaaatcctttatagtacaacctatggctaatattgatgccataaatttgttgtcctagcaatatagggcatctaacttctatttagaaaagatgatttatttatttttttatttctaaatcatgtgatgattagagcattttcagggagaaaggtgtttaatcagtatttttttttatttcttttccattcaagtgtttcattaacatcttcaacactcattatcttttccacaaattttttattatgctgtactttgaaataatgaaataagtatacctacgctttaaaatgaggatgcatttagtatcaaaaatatagtcttatactggagaatgtttcccagtaggaaaagcacatggcttgggctttttatgaaaaccacatttgtggtgctcacttcggcagcacatatactaacattggaacgacacagagaagattagcatggcccctgtgcaaggatgacacgcaaattcatgaagcgttccatatttttaattgaccacatagttgaaagtaaagcactcatcagcaaatgtaacag

SEQ ID NO: 463967 - DNA, 1004 bp, Homo sapiens
  misc_feature (649)..(649): n is a, c, g, or t
  misc_feature (664)..(664): n is a, c, g, or t
  misc_feature (677)..(677): n is a, c, g, or t
  misc_feature (684)..(685): n is a, c, g, or t
  misc_feature (697)..(697): n is a, c, g, or t
  misc_feature (705)..(705): n is a, c, g, or t
  misc_feature (717)..(717): n is a, c, g, or t
  misc_feature (720)..(720): n is a, c, g, or t
  misc_feature (736)..(736): n is a, c, g, or t
  misc_feature (742)..(742): n is a, c, g, or t
  misc_feature (750)..(750): n is a, c, g, or t
  misc_feature (773)..(774): n is a, c, g, or t
  misc_feature (777)..(777): n is a, c, g, or t
  misc_feature (779)..(779): n is a, c, g, or t
  misc_feature (858)..(858): n is a, c, g, or t
  misc_feature (860)..(860): n is a, c, g, or t
  misc_feature (879)..(879): n is a, c, g, or t
  misc_feature (886)..(886): n is a, c, g, or t
  misc_feature (894)..(894): n is a, c, g, or t
  misc_feature (911)..(911): n is a, c, g, or t
  misc_feature (914)..(914): n is a, c, g, or t
cttactgaagatcctcaaaaccaacagcacacagcttccagcgcatgctcctttccccaagaccctgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttanaagtgtggaaaattnatgccagttttanaaagaannaagcaagcgcanaaagatanatcagaattcangtnaagagaagattaatantggacnagaagtcnaaatcgatcagagaacatgttcnnaanangagttcactagccatgctttagattctcatatcttagatcattgtgcaaatccaggcatcaacagaggctgtatcaacntncataggtgactgattggcntcttgcnaagatganactgatgaaagctcacnagnagaacacgagccacacagtggcgaacgtacagagacccatgcaacacggacggacacgaacatggcaaagcctaacaggggctgcaccaa

SEQ ID NO: 463968 - DNA, 1374 bp, Homo sapiens
cttactgaagatcctcaaaaccaacagcacacagcttccagcgcatgctcctttccccaagaccctgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggtgagctatcctaaacatggtggctgatttttggctgtcttccacaaagagattatttccatttttcatagtctgtgaaagtttagcattactgtagtctttgtaatagagaatactgggaggcttttacagtaaaatctagagttttgctgacagtctatcccaaaagatgttttttgaaaattagtattgaaaaccattaaagtttataagaaagaagaaaacaccttgttttacttgtaagagatataaaccttagatttgctttgcttttacatatatttagttccaaaagagaattgcttccagaacatgaaccaaagaacaagtgacagtttgtgtcttctacaaataacacttcctcaccatcctgcttttgctctgctttcttctctttcttcattttttgaaataaagccaaaataacatctaaatactccttcagttgttaggacaacagctttgtctccaatatgtatttagcatctgaatcctaaatattcagctgctgcctaagctgaaggttgaaaatagattgcagcaaggctttaggttttttccacactgctttttggttaggtttctagagttaaccgcttaaaaacatttttctatcagttttacgtatcttagaaataatctttttaaaaacaactgtgatacgctacctaattgtctaacttttatttattggcaagcatgttgatttccaaaacgttattcaaaaacgagtcaaagttgtatgaaccctcagcctagaaaacaataagaccagacctaaaagaa

SEQ ID NO: 463969 - DNA, 1044 bp, Homo sapiens
  misc_feature (3)..(3): n is a, c, g, or t
  misc_feature (8)..(10): n is a, c, g, or t
  misc_feature (12)..(12): n is a, c, g, or t
  misc_feature (15)..(15): n is a, c, g, or t
  misc_feature (18)..(18): n is a, c, g, or t
agncagannngnacnttnacagtaagcaaaagtgacaatggtaatatggtttggctctgcgttcccatccaaatctcatcttgaatcaataatccccacgtgtcaagggcgggaccaggtggaaatatgggtgactcacgggggtaatttccgccatgctgttcttgtgataccccagaatggtagatccactgacagcttgcactgtatgcctggaaaggctgcagacactcaacaccagcccatgaaagtagctgggaggggggctgtaccttgcaaagccacaggggtggagctgcctaaggctatgggagcccaccttttgcctcagtgtaacctggatgccactccagccatgtggaactgtgagtccattaaatctcttcgtctttataaattacccagtctcaggtatttcttcatagcagtaagaaaatgggctaatacaccaatccttccttccttcaacaggaattttgataccttcacataagattaccacacaggataaaattgtataatataggggatagcatttgtaaactctaaattagtacatactctttagaaattatgattatttagaatgcttaaaacttccagtgtttacttgagaaaagttaatatttattgattcttcagcatgtgccaaaggcttttgaatactttgcatgctttatctcatttaaacccctaacaacctattgggatagatgttattagttatcttttacagaagaggaaactgtggctcaaatgttgtttaacttgctcaaggtcatgtatctagtaagcagttaagtcactgttaaaattcaggcactatgactgcagagtctgtcttcctaacaaatgtgccatgctacctaaagaatcatggcatttcctgtcattaactgctatgataatgggcacttttgttattccaataagcttaggcaataaatatactgagcgtcacataggcaaggcagtatttaataagatcaatgaaattgttatgtaataaatcagaatgaaaatttatatttcattatatatact

SEQ ID NO: 463970 - DNA, 949 bp, Homo sapiens
  misc_feature (3)..(3): n is a, c, g, or t
  misc_feature (8)..(10): n is a, c, g, or t
  misc_feature (12)..(12): n is a, c, g, or t
  misc_feature (15)..(15): n is a, c, g, or t
  misc_feature (18)..(18): n is a, c, g, or t
agncagannngnacnttnacagtaagcaaaagtgacaatggtaatatggtttggctctgcgttcccatccaaatctcatcttgaatcaataatccccacgtgtcaagggcgggaccaggtggaaatatgggtgactcacgggggtaatttccgccatgctgttcttgtgataccccagaatggtagatccactgacagcttgcactgtatgcctggaaaggctgcagacactcaacaccagcccatgaaagtagctgggaggggggctgtaccttgcaaagccacaggggtggagctgcctaaggctatgggagcccaccttttgcctcagtgtaacctggatgccactccagccatgtggaactgtgagtccattaaatctcttcgtctttataaattacccagtctcaggtatttcttcatagcagtaagaaaatgggctaatacaccaatccttccttccttcaacaggaattttgataccttcacataagattaccacacaggataaaattgtataatataggggatagcatttgtaaactctaaattagtacatactctttagaaattatgattatttagaatgcttaaaagataatgggaggatatatgtaggttaaaagcaaataaaagcattttatataagggacttcagcatacttggattctggtgtttagggggtcctctaaccaatgccctgtgaatgctgagggatgactgtgctggcatttttatgttgggagatcaggaaaggctcaaaggacatgagatttgagttgacatctgaatgaaaagaccagtcttgggaagattagggaacataggtgagagaactaatgctaagatgctgagaagatacaactgtgcccagtttgaggaactgaaaaagaccatgtgtctggcaagtgctgggtgagggagagagtggtatgaggagacattgcc

SEQ ID NO: 463971 - DNA, 537 bp, Homo sapiens
gcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatttgccgggggaagacatttccctccatccac

SEQ ID NO: 463972 - DNA, 386 bp, Homo sapiens
ttcctgcccttccgtgcatcttctccagtggatatggactggggaggggctgtaaggggagaagtggctgtgggggcgctgagggagggacagctccaagtgccaaaagggctctgtgtttaaagaacatggacacaggccagcagaagccaggctgccccacttcacagatggtttagaagaatttcgtttgaatttatttcagagaaacaagttgtctttttaattcaggcaattaactgtgctctgcagttatctgcagtggttgggttgcttttttttttttttgagacggagtctcgctttgtcacccaggcagaggttgcagtgagccgagattgtgccactgcactccagcctgggcgacaagagggaaactccgtcta

SEQ ID NO: 463973 - DNA, 1068 bp, Homo sapiens
ggcacgagcggcacgagcggcacgaaatgtggacaatacgcaggaagggacgccgtgccttacagcgaccggcagggactcggccgtccgcgagcccagccgcccgccccgctccggccaggatgttggaggcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaattggcgtcctgaggacggcgggagcctctcggggaaagcccgtgtgttcttccccatttcctatagcaaatgaaaagcaggctctgaggaagaagcccctgaggctgaacccataagagaaggagatttgacaccggacaggcagccaggtgtgaggttctgtgtagatcaagagtgtcttaggccgggcgcgggggctcacgcctggaatcccagcactttgcgaggccgaggcggggcgggtcgcttgaggtcaggagttggagactagcctgaccaacacggtgaaaccctgtctctactaaaatacaaaaattagccaggcatggtggtgcatgcttgtaatcccagctactctggaggctgaggtggagaatcgcttgaacccaggaggcagaggttgcagtgagccgagattgtgccactgcactccagcctgggcgacaagagggaaactccgtcta

SEQ ID NO: 463974 - DNA, 326 bp, Homo sapiens
gcaggaggtgtccctggaggagtacgtaagaaagcaccgcatcagtgtaacccatgtgatacagggtcccggatgacaaactctgtaggggctgaggaaagatgcttgaatgccaagactctcttcccgtttgctcccaggttttcactggtgcctacctagcagctattgacttagtgaactttatgttcattctcttcccagtctgtggatccaaattcaagtctaattcaggtgagtgtgtggctgtcttttcctgtctttattcacccattcattcatcagcacgccgaatgcctactccttatcactcccagagcgggccc

SEQ ID NO: 463975 - DNA, 1089 bp, Homo sapiens
cgcctctaacaagccgtaggtagcaaggacgtgatggcccacccgaaatgtggacaatacgcaggaagggacgccgtgccttacagcgaccggcagggactcggccgtccgcgagcccagccgcccgccccgctccggccaggatgttggaggcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaattggcgtcctgaggacggcgggagcctctcggggaaagcccgtgtgttcttccccatttcctatagcaaatgaaaagcaggctctgaggaagaagcccctgaggctgaacccataagagaaggagatttgacaccggacaggcagccaggtgtgaggttctgtgtagatcaagagtgtcttaggccgggcgcgggggctcacgcctggaatcccagcactttgcgaggccgaggcggggcgggtcgcttgaggtcaggagttggagactagcctgaccaacacggtgaaaccctgtctctactaaaatacaaaaattagccaggcatggtggtgcatgcttgtaatcccagctactctggaggctgaggtggagaatcgcttgaacccaggaggcagaggttgcagtgagccgagattgtgccactgcactccagcctgggcgacaagagggaaactccgtcta

SEQ ID NO: 463976 - DNA, 1077 bp, Homo sapiens
  misc_feature (1077)..(1077): n is a, c, g, or t
gccttcagctgggcctgactggaagggcgtgggcatttggaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcttcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggataccccctgaagtcctggcccagaagccctacagcaaggctgtggattgctggtccataggtgtcatcgcctacatcttccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccgccaactggctgttgctgtcgagactgctcggtggagcccggcactccttttgccggaaggctttgggggcagcctggtccccttn

SEQ ID NO: 463977 - DNA, 1390 bp, Homo sapiens
gccttcagctgggcctgactggaagggcgtgggcatttggaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcttcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaaggtggggctcaagggggtgtgccttgtccttcctggaatttttggccttcttgagagcttccttgattttcttatgacagccatgaagccacagtggcttttggggatccattatttctcagaaggtgcttggagcggcagaaggttctaccagcctctaaccatctctgattgccccttctcttccctcctgcccttcaagccagagaatctgctgtactacagcctggatgaagactccaaaatcatgatctccgactttggcctctccaagatggaggacccgggcagtgtgctctccaccgcctgtggaactccgggataccccctgaagtcctggcccagaagccctacagcaaggctgtggattgctggtccataggtgtcatcgcctacatcttccaaagatttcatccggcacttgatggagaaggacccagagaaaagattcacctgtgagcaggccttgcagcacccatggattgcaggagatacagctctagataagaatatccaccagtcggtgagtgagcagatcatgatctccgactttggcctctccaagatggaggacccgggcagtgtgctctccaccgcctgtggaactctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 463978 - DNA, 1278 bp, Homo sapiens
  misc_feature (1278)..(1278): n is a, c, g, or t
gccttcagctgggcctgactggaagggcgtgggcatttggaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcttcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaaggtggggctcaagggggtgtgccttgtccttcctggaatttttggccttcttgagagcttccttgattttcttatgacagccatgaagccacagtggcttttggggatccattatttctcagaaggtgcttggagcggcagaaggttctaccagcctctaaccatctctgattgccccttctcttccctcctgcccttcaagccagagaatctgctgtactacagcctggatgaagactccaaaatcatgatctccgactttggcctctccaagatggaggacccgggcagtgtgctctccaccgcctgtggaactccgggataccccctgaagtcctggcccagaagccctacagcaaggctgtggattgctggtccataggtgtcatcgcctacatcttccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccgccaactggctgttgctgtcgagactgctcggtggagcccggcactccttttgccggaaggctttgggggcagcctggtccccttn

SEQ ID NO: 463979 - DNA, 2155 bp, Homo sapiens
acaaccattaacctaccttttgtctatatggccatgtctttttaccatatatgttttacactgcatcagttttcaatccaacatgccaagctgagagagtttttaaaatatttatttttatttttttgcaccgtccaattaccaggccctatgctcctcgcaccaatctagtaagactgtgtgtgtcaaggagaaaattatgtttatttcagggattgaggatattaattaatttatttatttatttatttattattttcttaagacagagtcttgctctgttgcccaggctggagtgcagtggcacaacctcagctcactgcagctttcgcctcctgggttcaaacgattcttctgcctcagcctcccgagacctgggactacaggcacatggaccacacctggctaatttttgtatttttagtagagacagggtgtcaccatggtggtcaggctggtctcgaactcatgacctcatgatccgcctgtcccggcctcccaaagcgctgggattgcaggcatgagccaccatgcctggccctccttattaatttaaaagattctgcaggcatgaaacttttgcagaataaactgtgtaagtaatcattctatattttatttttaccagatacatttctgagactgggaagtaaacagtcttggccaaatttttatgtttgttgctaggtgaccaaagtcctcttgtgatgccattgctactcaggttggaaaccactgtggtgatctcaattactttacctgagtagactactgaagcagcatttgaagctgcagtcttgaaacacatgcaggctggaaaagtcgctaaagaattacttatttgagatggcacatgtttctgcagaaactcaagatgtttctcctaaagatgaatcaactggttcaaaagcctcctctgggtctccattgtgtgaacacataatccctggggattcagacttaaggtcaatgactgaatcaatgattttcaggttttgccacaaggatccttgataaaaaggccacattatactttatgtctctgagccagataaagataatgattttccttctctgacctttcccagtaaactttggaaaatagctgaaagtgaccaattcaagtctaattcataggataagaatgaaacttgcatagtgactaatgaagaactcttcaagaaagaaaatttggaaataaaggctccttacagaatatttcaaactgacagtatgaaaatcttaatttgacagctcaacctttatggatttagtaaaattcaacagaattttcacagatctgcttttctagccaactttctggcagaagaaaaagaaatttctgttttaagcaagttaaagttgtattatcatccgaatttcaaacgtggctgtccccaacttttaataagaacgaaaagaagaattaagattaaaaacacttctcttgtatctacttcactgaatatttcaagaaacactttagagcaggggctaacacagataaacataattctgtcttagctgctgaaactagtgaagaaagttcattttcaacatctacaaatttaaatatgactctaacaaggaaatcttctgtcagccagggcattgctggttcacctgacccaattagaagtggtttccctcctcttccatttcaacctcagttggacaatcagaacaaattacaacaaatcaacatgctattttaaatcaattgacaaatattcatatgcactctcatagcaccgacatgtaagcaaatggccacgttgtgaattttgttacaaccacagcttctcaatactacatcatatctccctcctttggggctgatagtgaaaccacctactttttcccaccagatatcctgaggtattagccaatgaggctcctcattctaacctgctaccagcaggcaacctgtggttgtaaatgactgcgacagctgatacatcagttgcctttcgttacaggccagctcttcaaccatctttactggaaaaatatcaccctagttacaactgatcttccaccaaaagagtaccagattatgcatgacaacagagactgaaatttatgttgacaagaacattaaaaattcctgcaataatcttactgaacaataaaattacatgttgacctttatggt

SEQ ID NO: 463980 - DNA, 1643 bp, Homo sapiens
acaaccattaacctaccttttgtctatatggccatgtctttttaccatatatgttttacactgcatcagttttcaatccaacatgccaagctgagagagtttttaaaatatttatttttatttttttgcaccgtccaattaccaggccctatgctcctcgcaccaatctagtaagactgtgtgtgtcaaggagaaaattatgtttatttcagggattgaggatattaattaatttatttatttatttatttattattttcttaagacagagtcttgctctgttgcccaggctggagtgcagtggcacaacctcagctcactgcagctttcgcctcctgggttcaaacgattcttctgcctcagcctcccgagacctgggactacaggcacatggaccacacctggctaatttttgtatttttagtagagacagggtgtcaccatggtggtcaggctggtctcgaactcatgacctcatgatccgcctgtcccggcctcccaaagcgctgggattgcaggcatgagccaccatgcctggccctccttattaatttaaaagattctgcaggcatgaaacttttgcagaataaactgtgtaagtaatcattctatattttatttttaccagatacatttctgagactgggaagtaaacagtcttggccaaatttttatgtttgttgctaggtgaccaaagtcctcttgtgatgccattgctactcaggttggaaaccactgtggtgatctcaattactttacctgagtagactactgaagcagcatttgaagctgcagtcttgaaacacatgcaggctggaaaagtcgctaaagaattacttatttgagatggcacatgtttctgcagaaactcaagatgtttctcctaaagatgaatcaactggttcaaaagcctcctctgggtctccattgtgtgaacacataatccctggggattcagacttaaggtcaatgactgaatcaatgattttcaggttttgccacaaggatccttgataaaaaggccacattatactttatgtctctgagccagataaagataatgattttccttctctgacctttcccagtaaactttggaaaatagctgaaagtgaccaattcaagtctaattcataggataagaatgaaacttgcatagtgactaatgaagaactcttcaagaaagaaaatttggaaataaaggctccttacagaatatttcaaactgacagtatgaaaatcttaatttgacagctcaacctttatggatttagtaaaattcaacagaattttcacagatctgcttttctagccaactttctggcagaagaaaaagaaatttctgttttaagcaagatatcctgaggtattagccaatgaggctcctcattctaacctgctaccagcaggcaacctgtggttgtaaatgactgcgacagctgatacatcagttgcctttcgttacaggccagctcttcaaccatctttactggaaaaatatcaccctagttacaactgatcttccaccaaaagagtaccagattatgcatgacaacagagactgaaatttatgttgacaagaacattaaaaattcctgcaataatcttactgaacaataaaattacatgttgacctttatggt

SEQ ID NO: 463981 - DNA, 1532 bp, Homo sapiens
acaaccattaacctaccttttgtctatatggccatgtctttttaccatatatgttttacactgcatcagttttcaatccaacatgccaagctgagagagtttttaaaatatttatttttatttttttgcaccgtccaattaccaggccctatgctcctcgcaccaatctagtaagactgtgtgtgtcaaggagaaaattatgtttatttcagggattgaggatattaattaatttatttatttatttatttattattttcttaagacagagtcttgctctgttgcccaggctggagtgcagtggcacaacctcagctcactgcagctttcgcctcctgggttcaaacgattcttctgcctcagcctcccgagacctgggactacaggcacatggaccacacctggctaatttttgtatttttagtagagacagggtgtcaccatggtggtcaggctggtctcgaactcatgacctcatgatccgcctgtcccggcctcccaaagcgctgggattgcaggcatgagccaccatgcctggccctccttattaatttaaaagattctgcaggcatgaaacttttgcagaataaactgtgtaagtaatcattctatattttatttttaccagatacatttctgagactgggaagtaaacagtcttggccaaatttttatgtttgttgctaggtgaccaaagtcctcttgtgatgccattgctactcaggttggaaaccactgtggtgatctcaattactttacctgagtagactactgaagcagcatttgaagctgcagtcttgaaacacatgcaggctggaaaagtcgctaaagaattacttatttgagatggcacatgtttctgcagaaactcaagatgtttctcctaaagatgaatcaactggttcaaaagcctcctctgggtctccattgtgtgaacacataatccctggggattcagacttaaggtcaatgactgaatcaatgattttcaggttttgccacaaggatccttgataaaaaggccacattatactttatgtctctgagccagataaagataatgattttccttctctgacctttcccagtaaactttggaaaatagctgaaagtgaccaattcaagtctaattcataggataagaatgaaacttgcatagtgactaatgaagaactcttcaagaaagaaaatttggaaataaaggctccttacagaatatttcaaactgacagtatgaaaatcttaatttgacagctcaacctttatggatttagtaaaattcaacagaattttcacagatctgcttttctagccaactttctggcagaagaaaaagaaatttctgttttaagcaaggccagctcttcaaccatctttactggaaaaatatcaccctagttacaactgatcttccaccaaaagagtaccagattatgcatgacaacagagactgaaatttatgttgacaagaacattaaaaattcctgcaataatcttactgaacaataaaattacatgttgacctttatggt

SEQ ID NO: 463982 - DNA, 2192 bp, Homo sapiens
tcctgccaggactgggtccttccctgcaaggcagcaagttcctttctggcccagggccagcctttattattgccatataagccttctggtagtaccaagatgtattatgttccacaattaagacaaattcctccatctccggattccaaatcagataccaccgttgaaagctcccattcaggatccaatgatgccattgctccagacttcccagctcaggtgctaggcacaagagatgatgacctctcagccactgttaacattaaacataaagaaggaatctacagtaagagggtagtgactaaggcatccttgccagtgggagaaaaacccttgcagaatgaaaatgcagatgcctcagttcaagtgctaatcactggggatgagaacctctcagacaaaaaacagcaagagattcacagtacaagggcagtgactgaggctgcccaggctaaagaaaaagaatctttgcagaaagatactgcagattccagtgctgctgctgctgcagagcactcagctcaagtaggagacccagaaatgaagaacttgccagacactaaagccattacacagaaagaggagatccataggaagaagacagttcccgaggaagcctggccaaacaataaagaatccctacagatcaatattgaagagtccgaatgtcattcagaatttgaaaatactacccgttctgtcttcaggtcagcaaagttttacattcatcatcccgtacacctaccaagtgatcaagatatttgccatgaatctttgggaaagagtgttttcatgagacattcttggaaagatttctttcagcatcatccagacaaacatagagaacacatgtgtcttcctcttccttatcaaaacatggacaagactaagacagattataccagaataaagagcctcagcatcaatgtgaatttgggaaacaaagaagtgatggatactactaaaagtcaagttagagattatccaaaacataatggacaaattagtgatccacaaagggatcagaaggtcaccccagagcaaacaactcagcacactgtgagtttgaatgaactgtggaacaagtatcgggagcgacagaggcaacagagacagcctgagttgggtgacaggaaagaactgtccttggtggaccgacttgatcgtttggctaaaattcttcagaatccaatcacacattctctccaggtctcagaaagtacacatgatgatagcagaggggaacgaagtgtgaaggaatggagtggtagacaacagcagagaaataagcttcagaaaaagaagcggtttaaaagcctagagaaaagccataaaaatacaggcgagcttaaaaaaagcaaggtgctttctcatcatcgagctgggaggtctaatcaaattaaaattgaacagattaaatttgataaatatattctgagtaaacagccaggttttaattatataagcaacacttcttcggattgtcggccctcagaggagagtgagctgctcacagatactaccaccaacatcctttccggcaccacttctactgtcgaatcagatatattgacccaaacagatagagaggtggctctgcacgaaaggagtagctctgtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtacatggctacagattccatctggcaatgtgactgccctcttcatggactttttagttaagctttgcacacaggtgaaaaaaacaagccatttgccctttcctctctataccatttcttaccaactggaaaagagtgagaaagtgtagtacagtgctattgtgagttgtcattattttcatcaacattcatttacgaattaccttttgaatgaagggctttgctgctagatccttcacagtctgcaaagtttacccctgaaatgggggagctttgagggtaactaccccagctctcttttgggtaactatttgcatggaataccttttttatccttttaatttctaactctttgtgtctttggatgtaaa

SEQ ID NO: 463983 - DNA, 2764 bp, Homo sapiens
caggttcaataaactcaggttcaagcagtcaagggtcttgctcaaggtcacacagttcatggcaggtccaactcaagttccactctctttctgcctgggagctcagtgagtgatccaaatgacctaaggaggaggagctgagaccagaatggacattcttttctggaaatcagaggacaagaaagatccaaaccaaagaccaaactgagctaggttcctgatctggggtgtggagaggccaactaaaggacacaggaatgtgacatgaccttgatggtacctgacacattacaggtcctgggaaaactgttgtgggggttaaatatgaaaatgcatgctaagcagttatcctggggcctgggctcagtaaacattgctactacacttattcaagtgactttgccttcttgttctggggagtcaggccccctgggaaatcgtgtgtcctcagaggatgcactttccaaagcctgtaacattcgggcggccagcagcacgggcacctgccatcttgcggacacgagctgcccgtctgattggtttctatgctgcaaagctgagattaaaaatcaaaataagttctgcaatgaactaaagctggtaagagttggagctgagacccgaatccaggacttcctggctctggagcacaaatttgaagcagccttcttcacctgcaggagccaggcctgcatcagtcacctgtttataaggccagcaagtctgatcacctcttgcaatcaacaaacagaccacaatactgactctaccaaggaagttcagaggaacagcgtgaactggggataccatcgagggctccagacaccaaacctgcaacagtgatacatctctctcccactaagattttagacttctagagggttacttgaataagagagtttttatttttatgagagatcttcagtgggtcccagaaaaaaacaagccatcgacgtaatcattcttagaaacttctgagtactgatgcattcctgagctgtcagctgctgctcctctccctccctctccacaccagctgcacacacacacacacatacacaaacacacacacacacacacacacacacacacacacacactctcaccttctggtaaagactctgagcaccaaaaaatttgaactgttcctggctttagccaacagaatattgaaagcaattgttttcagcaaagtcttgcccaaatgtggaagatgaatgttttcagtggacaggcccaacaccaagctcctaaggagcaccttcctacctaagggaggtagatgtacaacctgcattgacagacacagggccgtcagctctgagggcaaatgccccttgcatggcttgtcaagaaataaaattttctcccacctcagaactaggggtaggggtgagggacttgagggagaagtatgtttcttgttttctgatttctagggatttttaaacagccctcagttttttttaaaaataagctatatttccaaatccttcctaaactgatatattttctaagaaaagagaagccagctgtgatttcaactatacatatttgtgtgtgaatatataaatgtatgtatatatgtacatatatgtgtgtatatgtatagtatatatgtgtgtacatatacatatatatatagttgaaatcatagctgaagcctctgaagacaattcacaaatacacacacacacatatacatgcatatgtaattgcatatacagttgtatactacctatatctatatattgactgatatacatgtatacatatatatacatacatttatgtattgaaaactaacaaaatttatcttcctaactgagcatgaagccgcttgcatggactcagctttacccatctttctgtatacctagggatgtgtgaaatatcagactaccttgctgaagtgaccctacaggccaccttgtagcccagaaaaaaaaagtccagtagaaatgagccataaatgagaagctgtaattgcaataaatacctgtgaattcatattctaaagtgaatagctcttggaactcttgttttaaaagttatttagcaaacacttattgaacacttaatatgagccaaaccccttcaagtagggtgtggcctttgcattcctaagtattggtttacagctcattagccctttgacaaggcagctggggttgaagagaaaggtaaccctggagtgtcccaagccattgtcacctggaggtaatgcatctccacagtgttagggaaagcccgtgagaacataagctttattcacaagcaccaaaggtttccatggaggcagaaggaagataaggttggagaagcagctgcctaaatgacctgtgggcctgaatatgaggggtgcccagcccccagggacaccccacttcttgtgcactttcaaagagttttcaaggtggaagaaagcagagttgactggggttgcggactaagctgacacaagtagggtggggacagtgtggcaggctccagcaagcaccagatcagtaccttcagccctagtacttctcagctaactagtggtaaaggtgggcctgggccccaggaccttatggaaatagacatgaaggtccatttggatggatggactgagttttaaaagcctctgcttttgctaatggatggtaaagcccatatgctgttgcaccctctcccagcctctcttcacagggacctacagactcctccaccagaaccctccccagcagacagcaactccccttcagttggtctgtgggcactc

SEQ ID NO: 463984 - DNA, 676 bp, Homo sapiens
ttaggagatgtcctcgccccacccgatctgcctctcttgtggtttgcaggacagcctcctgctgcaggaggtgggaagcgagccagtcagagcccctggagtggaggccccacgaccttctcatctgcaggtcgcgtctcctgtggcggtggcagcagcagctgcccatatgtgtggagcacttaagtgcctgggccctggaccccataccgttctcatgccgggtgccctttactccctgattccacagggctggtcccattgtcctcaggcccagagaggcgggctgggatccaggtctgccacgccagctgcactcagtccccgtgctggtgctgtgagaatgttgtctagacccaaatgggcaggaaaacacttggaggaccacccaggagaccccagggcccagctccctcagagctgtcatgtgcttggcatagtcctttcaaagtctccaattagaatttgataacagtaattcagcgtcataattgatctctgttttttaaaaacattattcttggatatgataataaaagcagtttaattgaaaataataggtgacatttccagagagcttaatttgtgctaggcaccaagcccagggcttggcctatctcatttaatcaccacaacaaccctacaagtagataccattattgtcccatgttatagg

SEQ ID NO: 463985 - DNA, 1006 bp, Homo sapiens
  misc_feature (1)..(1): n is a, c, g, or t
  misc_feature (3)..(3): n is a, c, g, or t
  misc_feature (6)..(7): n is a, c, g, or t
nanctnnagtactcgcttctttgccagatcagttgttatgacatgaataagaagtataattaccttccatttagtgaatctattatgtacctctcatttcacatactgtatcttaacaatacacattccctgatgcgcaaacagcagggaaccctaagtgtcggtccctatctcctaggtccacaccgccttccgtcacaccaggctctctccagactggctgagagggtggagctgggagcctctgaggctgcatcgacattcgccaccagggggtgctgccgcaccgttcccggcgccgcctctgccccgcgagggactggggcgttttccaccgggcgcgtgtctggggctgtgactcagaatcctcaaactcagagttcgcagacggaggaactcatgctcaaacgtctgaacaaaaatatacagagcatgaaatttttactccagaaatagtgcacctctctcccccttggggaaaagcgttttccctacttccgtaggagttaactcgccaaggcttttaggagacgccgcacagctgtgctcccgctcgttgaaaaaaagatgccaaaagtgtagaatttgaccacaaacaaccgagcttcacaacggagtgtggcttgtgtgccaggccctgtgctgggggtgcaaaaggccccccgtgtccagcctggcagcagtgacttcggggtccctcctgcaagcttggctacagggcagaagaagccatcagatatgcatttgtctccggtgagcagagggaacaccgagttctgtccttttcccacacctaggaagacaagctatcaatttacgttgccaggctgaaattcaacagaactgttttagggttttgccgtccacaaggaatttccttgtgggaaattgtgatggagggcctggcctcacacgtgcctggtagcaggatggcaacccgatggcgacttcaggcttcacacccacagacgaccgtaatcagagaaagtaaaaaagaaagaaaaaa

SEQ ID NO: 463986 - DNA, 3718 bp, Homo sapiens
agctgggtcctgcttcctcctggtcttgtcgatgaggatttttagaccgtggagactgcgctgccctgccctgcacctaccctcactctccgtgttctcactaaggtggaaattgccttccctcactactgacgagaccatgtgtaaaagcgtgaccacagatgagtggaagaaagtcttctatgagaagatggaggaggcaaagccggctgacagctgggacctcatcatagaccccaacctcaagcacaatgtgctgagccctggttggaagcagtacctggaattgcatgcttcaggcaggttccactgctcctggtgctggcacacctggcagtcgccctacgtggtcatcctcttccacatgttcctggaccgcgcccagcgggcgggctcggtgcgcatgcgcgtcttcaagcagctgtgctatgagtgcggcacggcgcggctggacgagtccagcatgctggaggagaacatcgagggcctggtggacaacctcatcaccagcctgcgcgagcagtgctacggcgagcgtggcggccagtaccgcatccacgtggccagccgccaggacaaccggcggcaccgcggagagttctgcgaggcctgccaggagggcatcgtgcactggaagcccagcgagaagctgctggaggaggaggcgaccacctacaccttctcccgggcgcccagccccaccaagtcgcaggaccagacgggctcaggctggaacttctgctctatcccctggtgcttgttttgggccacggtcctgctgctgatcatctacctgcagttctctttccgtagctccgtataagattccgtggttgggcccagagcctgtcgagggtgccagttagctgatgcgagggtagaggagagacgtgggttgagaatagtgtaaacttctagcgctggtgatgtcactgactcagtggggatcttggacaaattatacagtttttccatctataaaactcagggtttgggcaagatcattggtttatcatagtgaaacccaggaccccaaagttctgcgtaggtgcctcagggacttttggatttggaaagtaggctaagctagtgggtgtctccaactcctgatctaaacacccatcctccaactcctacctcctcctcttgcttcgatcagaacagctttactttagatagggttccatttaagatttttgtaccaaaaaaaaaaaaaaaaaaagtttaactacttttaaaaaacatctctgcttgctacagaagttttcagccctggctgtacttcagaaattctggggagattttaaagaaatataagtacttagcctctaccccagaccaatgggatcaaaatttgggggaagtgggacctgagcatctgaattagaataaaacacccaggtttgctgctacaatggctgtgttctgctctgagagtctttgtcactgagctctgccacccttgctgggacactcataaaacttgttataattactcatccctgctaggatcatattatgcttgtgacgatattcggagtctccttctcacttcaccactcattctttctatgtcttgaacttacatatcccagagcaaatcagtttaaattaaggtacttgaagtagggacggcgttttgtttttatttttgttttgttttaagatgatagcatggggtcatgtgaaggggcctgaacactgcattgggagctgtgggtcctcattttattttaattgggttctgctgggacttttgggggggtcattattctctctgggtcttagatgctcttatgatatgaagcattctgaagtctgtctttgtgccatcctgtattagcccatataaagcatttttacacactttccaatgacaagttctccagcctgtatttgagcacccccagtgacaggagatcattaccacccaaggcagctcatgccatctttggatagttctgccttttaaagaagactttttccttttaagcctccctcaaaagggtttgaattttttcactttctggttctggttctcacaagtgggatcccacaggggaggatgtttcctattccccatacagatcttttctcagcactgcagccagggcaatccttttaacctaagtcagatcctgccattcttgtgctcccttttgtgttctgtaaaagccaaatcctgcaaggccaaacgtggtgtggcttcagccgtgttactgatatcctctagtactctttgccctcatttctgtagctaccctggtttctttgctgttccccaaatacacaggcatgtatgtgcttagggccttattctacctgttccctctgcctggaatggtctttcccaagaaattcacttgcctcactttgtgacctccctcaagtgttggctcaagtctcaactcagatgctcttctcaggccttctacttcatgctgtcacctgttcccccaccccaccctctcgctcctggttcgccttgcgcttaccttagcctgtgttttcagaaagcagaagtcaaggcagaggtttatgtgatagtatttgactggggagcatgacctcagaaagctggagtaaggcagagggagcacagcaaagcaggagggaaatccaatggaaggaggtcttgtcaagttggccatctccgctggtgaagggttgttcagtcccagaaaaccatctgagaagccggatgaaatgcatctccagatcacttgggagtaaagggctatctatcccctggctcctgtcttccaatagctgaaggttgccccataggatgttaacttccctccactctgggttgtggtacactaattgaatgaaaacatgaatgaataagtactgaaagagtatcagaagacaaggttagtgtccttgctctgactttctcaaggtttctctgcctctgcctgcctcctgaatgttggtattctttaggctccaattccaagtcttagtctctttgatcttctcatatttgtccatgtcctctggctgattgaatctattctgagtgttctttaatatctgtatgctaatgactcaaatatacatctcaaggcatgaattttcttcttgacttcttacatttatgttctccttgacatctctgtttgactgtttcacaggcatttcaaagtcaacatgtcctaactgattctaaagtatgttttccctctggtgttccataagattttttattttaactatttttaattgcacaattcagtgacattaagtacattcacattgctgtgtaaccatcactgctgtttatctccagaaccgtttcatcaacccaaactgaaactatcaaatcatttcacagccccacgacaaccaccattcaagtttctgtctatgagtttgactattttacctagtttactttaatatatagggagtcatttattttcttcccctcatatttatttcaagcaatgacttcatgtttccagtggcatagtagccacaatatttgtccttctgcatctggcttatttcacttagcataatattttcaaggtatgtaatattaaagcatgtatcgcaacttccttcctttttaaggttgaattgtatttccttgaatgtatataccacattttgtttatttattttgtcttagcccattttctgttcttacaacagaatacccgaaactgtgtaatttataaagcaaagaaatatatttcttacagttatg

SEQ ID NO: 463987 - DNA, 1113 bp, Homo sapiens
ggccacatcatctgatttcttactaggtaatatgccttccaagtccactgactctgttggaaaaattagaggaaagcctcttccattactcttattttttgaggccctctttatcacaagtcatgcttttccatgtcctgttgatgcagctctaaccctggaaggaatcaaatgtggattatcagaaaaacggttagatttagttaccaattgggttacacaggaaagactgacattttctgaggaggctggggatgtgatttgtgattatggggagcaggatacttataacaaggccaagtgcctggctttagctcagattatctacagtgaatgtggcctgcacaagaaagctattctttgcttgtgtaaacagggtcagactcatagggtcatggagtacatacagcagttgaaggactttactaccgatgacctgttgcagctattaatgtcatgtccccaagttgaattaattcagtgtctcactaaagagttgaatgagaaacaaccatctttatcttttggtcttgctatacttcatctgttctctgcagacatgaaaaaagttggcattaagctacttcaagaaatcaataaaggtgggatagatgcagtagaaagtcttatgataaatgattccttttgctccatagaaaagtggcaagaagtggcaaatatatgttcacagaatggctttgacaaattatctaatgacatcacgtctattcttcgatctcaggctgcagttacagaaatttctgaagaggatgacgcagtcaacctaatggaacatgtgttttggtagttctatatcttaaccagctgagggagcttgtacaacaccttatgtatgctggttgggaaaaactgattttaacgtaactaacttataaataaatctagagtaagaagatctcagaaataaatcacacttttgttatgatgacatttagatttgtctttgaaatatttatactattgcttccttttccccatatggtcatttcttatattgaatcttgataaaatccaagattataactttgtgtgaaaagataacaattcactggccgtcggtttaaccgtgtgactgggccctggcgtttccct

SEQ ID NO: 463988 - DNA, 914 bp, Homo sapiens
ccggccagtcggttctaccatcaggaaagactgacattttctgaggaggctggggatgtgatttgtgattatggggagcaggatacttataacaaggccaagtgcctggctttagctcagattatctacagtgaatgtggcctgcacaagaaagctattctttgcttgtgtaaacagggtcagactcatagggtcatggagtacatacagcagttgaaggactttactaccgatgacctgttgcagctattaatgtcatgtccccaagttgaattaattcagtgtctcactaaagagttgaatgagaaacaaccatctttatcttttggtcttgctatacttcatctgttctctgcagacatgaaaaaagttggcattaagctacttcaagaaatcaataaaggtgggatagatgcagtagaaagtcttatgataaatgattccttttgctccatagaaaagtggcaagaagtggcaaatatatgttcacagaatggctttgacaaattatctaatgacatcacgtctattcttcgatctcaggctgcagttacagaaatttctgaagaggatgacgcagtcaacctaatggaacatgtgttttggtagttctatatcttaaccagctgagggagcttgtacaacaccttatgtatgctggttgggaaaaactgattttaacgtaactaacttataaataaatctagagtaagaagatctcagaaataaatcacacttttgttatgatgacatttagatttgtctttgaaatatttatactattgcttccttttccccatatggtcatttcttatattgaatcttgataaaatccaagattataactttgtgtgaaaagataacaattcactggccgtcggtttaaccgtgtgactgggccctggcgtttccct

SEQ ID NO: 463989 - DNA, 1302 bp, Homo sapiens
ggccacatcatctgatttcttactaggtaatatgccttccaagtccactgactctgttggaaaaattagaggaaagcctcttccattactcttattttttgaggccctctttatcacaagtcatgcttttccatgtcctgttgatgcagctctaaccctggaaggaatcaaatgtggattatcagaaaaacggttagatttagttaccaattgggttacacaggaaagactgacattttctgaggaggctggggatgtgatttgtgattatggggagcaggatacttataacaaggccaagtgcctggctttagctcagattatctacagtgaatgtggcctgcacaagaaagctattctttgcttgtgtaaacagggtcagactcatagggtcatggagtacatacagcagttgaaggactttactaccgatgacctgttgcagctattaatgtcatgtccccaagttgaattaattcagtgtctcactaaagagttgaatgagaaacaaccatctttatcttttggtcttgctatacttcatctgttctctgcagacatgaaaaaagttggcattaagctacttcaagaaatcaataaaggtgggatagatgcagtagaaagtcttatgataaatgattccttttgctccatagaaaagtggcaagaagtggcaaatatatgttcacagaatggctttgacaaattatctaatgacatcacgtctattcttcgatctcaggctgcagttacagaaatttctgaagaggatgacgcagtcaacctaatggaacatgtgttttggtagttctatatcttaaccagctgagggagcttgtacaacaccttatgtatgctggttgggaaaaactgattttaacgtaactaacttataaataaatctagagtaagaagatctcagaaataaatcacacttttgttatgatgacatttagatttgtctttgaaatatttatactattgcttccttttccccatatggtcatttcttatattgaatcttgataaaatccaagattataactttgtgtgaaacagtgtagggcatttttatctaaggacataagctaatgtccagatatattactttctggtgatgtaatatgatagcaagaactgaggaaggtgagaaattggcatagctattaaactgactgacattcaaaccaagctttattacagaaagctacagagatgataggattgaaaacatgaccttttgccagaaagctagtgggaaatgggatcattaaccttgaagaaatattacagatgaaccat

SEQ ID NO: 463990 - DNA, 1143 bp, Homo sapiens
ggccaggctggttcatgccggacacctaaccccctgctaccacatgctgttttccacactgggtgctggcctgtgggaacctgcacaagtcgggggcaacatggtcccaggaagtctttgacaggctgccccctgctggctgctgcgggaaccacatggcagatggctcctggtgtcccctggaaggtcttgctctgtcacccaggctggagtgtgtggtgcgatcatgcctcacagcagccttgacatccccaggctcagatgatcctcccacctcagcctcctgagtagccgcgactacaggcgcatgccaccacacccaggtgaggaacctgctcagggtcccccagccccagcgccgggtctacccacgactgggagcggaggatggcgaccgtgcgcggggcagggaagcgagggccgggagtgccctccggtggcgaaagccaggaattaccgcgcacctattctggaccagagtaaaaatcgcctggaaaacatcttggccttcacagggacagtacggagaaaggcaagcagccgccaaggccggggtatccgcctgcacttagcggggctctcggaagccggcctggggatgagccaggcgtcctcgggcctggtgctggcgcctggcgcgccctctgctggataccgccgccttgtcaacagggggctctggcatagcatctgggtgtctgactccatcacctctggggaagaaagcaaaggtggtgagaagacgctggaaccggccagccctggaggcggggtcggctggggcacctccttcctggcctctgcgcctactagacgcctaggctgggtgggctggaggctccaggagagagcggtggcaaaagagtggtgtctgctgccccagagcgttcatttcagaggctggagagggaagaaaatcaagaaggaaggaggtggccgcgagcagctgtttttagctgagaaaggagaaatcagtgaagggggctcttaccatgttctggaagcatcctgatgggggtcggggggctaggaccctgcaaagagcacacgaggccacagggcagggctctggctcttgggtcaacgttaacagtcctcttgtcagggacaggaggaaagtcacctggagggggatgttggatt

SEQ ID NO: 463991 - DNA, 1271 bp, Homo sapiens
cctgagtagctgcagttctaacaaatttcctttcgaagtccatgctgctggcctgtgatcacctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccaccaaggagtgtggaatgtccttgagtgtattatttatgcaagtcacagtcacgttgccatcatggcagctatgtgaaacactaataaatgtgtttttactttttattcccgttaaaactgatgtaaaacaggataaaggcttgttatagtcacttataagtatctgggtctaagtaatttccttagatgtttctaaagaaacattttcag

SEQ ID NO: 463992 - DNA, 2175 bp, Homo sapiens
acagttaatcaactggcccatgcccttcacatggacaaagatttgaaagctggctgtcttgtacgtgtgttttgcccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggcattattcagtggaagagagggaagaccaaattgatagactggactttattcgaaaccagatgaaccttttaacactggatgttaagaaaaaaatcaaggaggttaccgaggaggtgccaaacaaagtttcatgtgcaatgacagatgaaatttgtcgactgtctgttttggttgatgaattttgttcagagtttcatcctaatccagatgtattaaaaatatataaaagtctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccacccgccgcatctcttcttcacggcgcctgcgctcttcctcctgcctgagctccagttgctttcgtttttgcacctcttggttgtgcggctcttccatcctccgaagttcttcttggcgcctcatcaaatcctgtctcattagcatgacctggtgctcatggcgtgcagcttccatctccatctccagcttctcacgagcctagcagaagggggtggtgtctccaaccccccagcactgaggaagagcggggctcttct

SEQ ID NO: 463993 - DNA, 923 bp, Homo sapiens
gattgaatgggcgttgtgagtgagcaaacgtgaagcagggactccgggcctgacagcgctggctgctctcttggccatcctccccagatgtaccgtcccaggtgtattaaatgtcacctggaaatgtggtgacaactccatgacccagcaggaggaattctggcccctgcacaggaagctcagagccagaggggccaccaagggggttttctctgctccctcgcagccagaccccagtgtcttccaggggagggcagccctagtgggctgccccacagccacctgctactctcatcctcattggcagctgcagcctccagggattccacaccctccccagcagacagattccaagggtaccaactgtccacaggagccagattggccatcccttcctagcctctccctgcccctgagagtaaatcccttcctcaatcccacccccaaactctgcgtgcctgccccacaggtccagcagtgcctcacggggcagacacccaagaacaccgtccagccgggaggacacatcttcatctccttggataggcaggtgggccaggcccaccctgagctgaggcctgaaggtgccggaggaagaagaaagctgccctggggtggagcggaggctgctcctcagagcaacacagcccaggccccagctcaaggagggcgaagacaccagccttgcgcttgatggtaaccccgcttggctaacattcttccctgctgacttgaggccccagctcaaggagggcgaagacaccagccttgcgcttgatggtaaccccgcttggctaacattcttccctgctgacttgaggccccagctcaaggagggcgaagacaccagccttgcgcttgatggtaaccccgcttggctaacattcttccctgctgacttgaggccccagctcaaggagggc

SEQ ID NO: 463994 - DNA, 626 bp, Homo sapiens
gtaatccaaatccatgaaattacagatacaccttggctttctaccattctagtgcactgctctgtaaatgggaggtggctcaaatattaattgagttgggaggaagcagtggttaatctctatactatactaatgggtctgggtgaaatgacctcttatgatcttttccagtaaaatattcaacaaacaacataagtctgttatcttcaacaatatataatctatcaggatagctattttttaaatcacaggtgatttgggaggaaggtctcttgagaggagcattctgccattctggtgtagctgtttctgttctctccagcagctattttaggtatttaattattttagagtgtgtgcttgcatgtgttttgtctcaatgtatgccaattttttgcctagtcctcctgacatcttaatctatctgccaacgctacatgccgtcaagccaaggaagaatttccttctcactgttgcttctctgaccaaggaagacataagcacaaccaatcaccagactgatgaaattccttccagtttcagaaaagattatcaccaatccctacattataaaattcatactaataaagcacaaacattgaattctaacattatatgctatgtga

SEQ ID NO: 463995 - DNA, 872 bp, Homo sapiens
  misc_feature (39)..(40): n is a, c, g, or t
  misc_feature (42)..(46): n is a, c, g, or t
agcgccgactgcatgccacctgcgagaggaagaggccgnnannnnnggttctgggagggtggggacagaatttccccggtgctaatgcggcactgaatcgcaggaggctgcccatgcatttcttcagtcatctacaaccaagaattctcagagcagtccctcggcagccttttgaagctgtgctagagcagaaagctgctattgttctcatctctcaacaaggaaaggttcaaactttgcctcttcaatttgaaagattttttttttatggtggtggggggagggattgcaatctgatactcaaagttaactttgaggatttggagtggtctcccagtttaagctgcagatcaaatcacagatgccctaacgcctgcatctcaaattttggctggctgctcgtgaagaaacgcctgcagaaagctgtaaatgccggcagtggcagtgagtgtgatggacaaggctaaagagaagactcatgaactttcggcacaagaaaccaaatctttactgagtgtggtggaagaatgcccaggtgagcacaggcacagtgccaggtgctgcagaggacctgagacaaagagtcactgcgccctcagagagtttagaatccagcactgaggaaaagagaggtcatggggagcacagtcctcctgacatcttaatctatctgccaacgctacatgccgtcaagccaaggaagaatttccttctcactgttgcttctctgaccaaggaagacataagcacaaccaatcaccagactgatgaaattccttccagtttcagaaaagattatcaccaatccctacattataaaattcatactaataaagcacaaacattgaattctaacattatatgctatgtga

SEQ ID NO: 463996 - DNA, 793 bp, Homo sapiens
tcagggtgtgtgtatgtgtgtgtgtgtgtgtttaactgagagtactgagatgatttactaccagggttgtcatgaagatgaaacaagcttggatgttctgttctgcagttacctaatatctcgcaatgagaaaggtttgcgtccagcgatggaggaaaggtcacagaacaatctgcagcaggtgaaatgaaaccgcagagcctccagagagcacatgaaccacgagaaaactctgtggggatcaccaggggatggaccagggaggctcaggactgggagatgagacaagcaccctcagaaggcgcagacttagctagattaggaaaaagaggcccagccaggcaggtggcacaagatgttagaggtggaagatatgaaggagttactgcatctgtggccttctcagtggagcccaagaacaagacttcagtaatcatttttcaatcagtacccacttggtgccaagaaacgagattcacaaatggagtaaacacagctcttgctgtgatgggcttacatggtagggggcagataaaggggactcaaaaagaagaagaaaaagaagaagaattcaataacagtcatcaccaaaagacagaaagagaggaagacagaatgtctgcattgagaaaatcttggtatcttatctctgggatgttattgatgatctgagtatagtgcaaaatcttaagtgaaatgaattggtggtttcagttccggatatggtatgcaaagaaaaaaaaaatttgctctttgaaattcaacgcttcctcgtctgtgcttcaggaagcca

SEQ ID NO: 463997 - DNA, 1992 bp, Homo sapiens
agtaaggttttggggatgctggcgaacactgatttgtgggtgatggtgttagatttcagcaggttgttccagtggctgttagataaaactggtttcaggttacacctggcagttccagcagccaggtctgcagagaatctgagagcagcccagggatgggcactcatgaaggagagtgatgctgcccacaggaagcaggccagtgctgagcagagagaaccacaagaaaagcagacaggtctgcccgcgtttgagctggtcagctcaaaccagatggagcctgggactgtgaccaaggagcgagtgaaggtcaaagccacacatggggctgaggggccaggtggccgccttatgagatcgaaggcgggaagctttggaacagggcaaaaaggggagcccagggtgaggggagagggccgagcagctcggatctctgatggctgagtggcctgttctgggtctgactaccctaccctggggcctgactctgccccgcccctcgcaacactcaacaaacgcttgtggaaggagtgaacaaatgacaagtcacgaaacctaaatacagagtcttcagctttggaggagactgaggtgcgggacatggaaaagaaggtcattctcttggagccccaacaatgaccaggagaaattcatttggcggtaaaaccacacgaaccctattacatcaccaagccctcaccgtttccagcacccagctattaaacatatggaaatgatgacaatttaaagcttataaataacattagcggtggcttggatttattgttgtggcctccggaagaacttgggcacagtgtaacttcctggggcccgaggttgttaatcggtgaattgttcatgaaggacagtgctcactgtgaaggtgggtgtcctgggatgctctgcctggcccgcgggagacaaggctatggtctgacatccctcagcctgtcctcattgtcctggctctgagaagaagctacaaaacacagtagaagaaaaagaaaacagtcttttaaagacttgtaatgagttgttaatgataaaagtaacacatgccaactggaaaaatgtgaattttttatctcagccaaaagtataaagatacttcgatttctttaaaaacttatggaaatctgttgttgtatgcatagattgttgaatacatctctgcttatttaaactcctgaaagtcttatcaatgaggtcaaaaggcaggaacaggttgtttgttgttgttggttatttgtctttttgagacagggttttgctctgtcaccaaggctggagtgcagtggcgcagtcacaactcattgcagcctccatctcctgggctcaagcaatcctcccacctcagcctctagagtagctaggactacaggtgcacaccaccatgcctggctaatttttttttttttggtagagatagtgtcttgctatgttgcccaggctggtcttgaactcctggcctcaagcgatccttccaacttggcctcccaaagcacaaggattacaggcatgagccattgcaccaagcagaaacgtgtttaaggctcttaaaaattattagaaaatattgctaacttttcttccagaaaggttttaccaatgcatgctttcatcagcaatgtgtaggaagtatttcattgcagcctcagcaatactgcatatattcatttcaaaaacatagccagcttgcaaaaaaatgtatttggtggtagcatttcattaataatgaagtcacagtttttctatgtactgatttctgacttctatgattctatttacttgaaactgtagaacatatatagagttttttggatatttctattacgtctatatgttgttttactttcccttatttttgacatgctgtatatattcatttattatgttattgtcagtcctcccccacaagaatataagctctgccaggttagggatttctgtcaattttgttcactgactcagaaaagcacctggcatcatatt

SEQ ID NO: 463998 - DNA, 3278 bp, Homo sapiens
atcggttaggagtcggctttatgtgggaagagagaaaaaaacttggtgaaatgctttctggactaattgaagaaaaatgtaaactacttgaaaaatttagccttattccaaaagagtatgaaggctatgaagtacagtcatctttagaggatgccagctttgagaaggcggcagcagaagcacgaagtttggaggcaacctgtgaaaagctgaacaggtccaattctgaacttgaggatgaaatcctctgtctagaaatagagttaaaagaagagaaatctaaacattctccacaagatgaactgatggcagatatttcaaaaaggatacaatctctagaagatgagtcaaaatccctcaaatcacaaatagctgaagccaaaatcatctgcaagattcttccaatgactgaagaacgacgggcgatagcaataaaagatgctttgagtgaaaattctcaacttcaggaaagccagaaacagcttttgcgagaagctgaagtatggaaagaacaagtgactgaacttaataaacagaaaataacatttgaagactccaaagctgctgtgcttgaagaagacacaacggatgatgataacttggaattagaagtgaacagtcaatcggaaaatggtgcttacttagatgatcctcccaaaggagctttgaagaaactgattcatgctgctaacttaaatgtttctttaaaagccttagaaggagaaagaaaccacattattattcagttatctgaagtggacaaaacaaaggaagagcttaccgagcatattaaaaatcttcagactcaacaagcatctttgcagtcagaaaacatatattttgaaatggaagaaaagatcagccatgtcactgaagagctggagacctatagaaagctagccaaagatcttgaagaagaattggagagaactgttcatttttatcaaaagcaggttatttcctacgagaaaaaaggacataataattggttggcagctcggactgctgaaagaaacctcaatgatttaaggaaagaaaatgctcacaacaaacaaaaattaactgaaacagagtttaaatctgaacttttagaaaaagatcctaatgcacttgatgtttcaaatacaacatttggcagagagcgttcgccatatggtccctcaccgttgggtcagccttcatctgaaacgagagcttttctctctcctcaaactttgttggaggatccactcagactctcacctgtgcttccagggggaggaggaagcccaagcagcccagggaatcctctggaccatcagattaccaataaaagaggagaaccaagctgtgataggtcaactgatgctcacagggctccttctgacactgggtccctctcatctccatgggaacaggaccgtaggatgatgtttcctccaccaggacaatcatatcctgattcagctcttcctccacaaagggaagacagattttattctaattctgatagactgtctggaccagcagaactcagaagttttaatatgccttgtttggataaaatggatgggtcaatgccttcagaaatggaatccactagaaatgatgccaaagatgatcctggtcatttaaatgtgcctgattcatctctccctgccgaaaatgaagcaactggccccggctttattcctccacctcttgctgcaatcagtggtccattgtttccagtggatacaaggggcctgttcacgagaagaggacctcctttcccccaacctcctccaggaaccatgtttggagcttcacgaggttattttctatcaagggatttcccaggtccaccacatgctccatttgcaatgagaaacatctatccacagaggggtttacctccttactttcatccaagacctggattttaccccaaccccacattctgaaggtagaagcaagttcccttgagggttgattccaccttcaaaggagcctgctactgaacatccagaaccacagcaagaaatctgacaatatttttgctttcttcaaaagcaactttgactgatctcattttcagtttaagtaactgctgttacttaagtgattacacttttctcaaattgaagtttaatggaattacagttctcaggacagtattttgtaaataaagatggtttaaacatgaaaaaaacaaaaacaaaatgtatagtgatgtagaaacatgtttgaaagatatacaatacagataagtttgttaggatggtgcaattaagtgtgttttcccatgtgatttccattttatagaattttcacttcattttgtgataataattaattaaaacaattaaaattcatgttttatctctcagttcaaacagatcttccttccaagaaaaccttccccttttatgttcagaaagactttcttgtaatagaaaatctgcaccaaaaataaaactcaacaatgacaattatgttttttaaggatttcacttttgaaaaataaatattacttcactttctttttaaaaattatttgttaaatgttatttatttgtacttataaataatttatttttgaactattttgtaattacttttactgagtaattattttcattggaatgttaagttatgcttagcatttatattttatagttaacttttacttgatgttttataatgtttataaatgttcatattttatagtattaatatttattttgatttttttaaatcataaattttcaacattttaaattgattgtttttgtcatttttctctcgtaataaatcattgtttatctatagctcaaatcacagttaatggtttggactatttccaaatctccaaatttcaggatgtctctaatatgcaaacagataaatgtggctttctgcatgtctgtataagaacataattaaggaatttaaattttatcaaaatttacttctcgatgtcttcttacgaagctcattcccttattcccatttctgctctaccagaagccttttcaatatcaagttattctcacacatattcaagtttgagaatctgctgcagtaataggtcattgaagacttttaagcaagagagggggataataggttaaaccttttagaaggaatgctctgttagctgtgcagaagagggcagagcattttaactttgcaatgcaaatgggaccattgtgataacatggcagcagaaattacgagatgagagatgcaaagatatcaaataatatttggaatttggatgaagaattattttcatagctatttgatacttttaattc

SEQ ID NO: 463999 - DNA, 728 bp, Homo sapiens
acaaatgctaaacaggcatatgaaaatgtgctcaacatcattgatcatcaaagaaatgcaactccaaactacaatgagatatcatcagctctgtaactctgagtttgaaaagatacaaatcacaatggaaattctggccaagcatagtcctgttggagcagaatggggcagagcagaaacaacgcaggatttttctgatgggtgcctgtggcctctgactacttactggggcctattcattcaaggaagcagaggtgaaaaagagcatgttagtgaccacctcgtttcatggtcttcttacagaccattctctgggagtctcaccctccttacccaaagtggcccatcactttgtagtttcttgaacaaatatgagagatgctgttgccagccaaaatgctacaaccattttacaggaaactagacgacatgaaggctgacacatcaagtgagagaagcaaacactgagagggaaagtccctaagtccttaataacctcactgactgtgctggtcctggaaacaactgttttctggactctcagagcaagaaaggaattatcaagccatttccaactggggttttttgttaccagcagtccaatacattctaactgataaactacctcaaagaactattgcaaagattaagggggaaaggtctgtatatagggctgtccagtggacacctccgtgataataaaaatgttccgtgtctacactgtacaa

SEQ ID NO: 464000 - DNA, 3099 bp, Homo sapiens
ggcggggtggggaggtagaagggtgagagcagcctttcccagcatcgtcctttaagatgcgacagaaacaggtcccacctgagccagcaggaatgcggcacccagtggctggctctgcagtcttgatgctcgccggcaccttcagggtgaaggacgccctgtcggaggcccagaaccagggaggagaggtgctgggaggtccccctctgggagagccagcacaggagctaaccagtcagaggagaaggcggctcgtggaggagttcatgctcttggccaacatggcagtggcccacaagatccaccgcgccttccccgagcaggccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccggcccatgcaggcagtagcactggccctgacacccagccctgaaagctcggggactgcaggacaaacagcttcaggggctgtggccccagctgggacgggctatgcgctggtccctagagactctcgatgggaggatggacgttgcctccttgaacaaagacccacaggctccttggcttctgcttgtgtctccagcagacagcgtctgcagcccctggtccaacaaaaccgcaggcggcctcctcctcttcctcctcctcattgtcctcctcgaccaccaccacctcctccttccaccacctcctccttctcctcctccgctgtcgcctcctcctcctcctcctcctcctcctcctcctcctcctcctccgctgtcgcctcctcctcctcctcctcctcctcctccgctgtctgtccacacatcgctgccgacggtgaggctgtgggtggtgccagccttccaggcctggctgggcagctctgggcttgtcaggctctgacccatcccgtcccgcagatggcactgtacttctgctcggggctgctgcaggacccagcgcagttccggcactacgcgctcaatgtgcccctgtacacacacttcacctcgcccatccgccgctttgccgacgtcctggtgcaccgcctcctggctgccgcgttagaagctgcatggagcccacagccagccctggacacagccgggaggagggcgctgacctcgaagggccgctttctgctgccctgggagctgggtgcttggggctatagggagcgactagacatggcgcccgataccctgcagaaacaggcggaccactgtaacgaccgccgcatggcgtccaagcgcgtgcaggagctcagtaccagtctcttctttgctgttctggtcaaggagcccagggcagtgccaggaggtgccatggctgcagcactgtccctgcaggagagtggccccctggagtcagaagccatggtgatgggcatcctgaagcaagccttcgacgtgctggtgctgcgctacggcgtgcagaagcgcatctactgcaacgcactggccctgcggtcccaccacttccagaaggtgggcaagaagccggaactcacgctggtctgggagcctgaggacatggagcaggagccagcacagcagggcattcttcctggagggggcccccattacagacaggcgagcagaggcttccagaggccgaaggaggggccaggggtcctgctgcagggatggaggcagagctgcgcctcgacatcaggccctgccatccttgtcccctcacggctgggctctgcacaggtcatcaccatcttcagcctggtggaggtggtcctgcaggcagagtccacagccctcaagtacagcgccatcctgaagcggccaggcacccagggccacctgggccctgagaaggaggaggaggagtctgacggtgagcccgaggactcaagcaccagctgagctccaccagccgcctgccccgcctgccccgcctgcctgtcccgccacactggctttaggacctgttgacacggaggggggtttttaatttggtttttaacaactcaggggtttgtttttatttttatttaatttttgcagctcaacttttaaacaaactgcaggggagagggtggggctggaaggaaggctgaggcctggtcagcagtgaccccagcagagcaggccccagtcctcctgggaggctggccccccttttttctgggccctactgccctcctctgcccaggaaatgggggggtttcagcaactcagtgtcacagaataaaatcaagtgtggagtgccatctggtgtgtagggcgcctctgggaagcctgggcagcagaatgccccttgcacccagggcaagggacccagttcaggcttcacccctcgctgctgagccgatgtcaacacctggaactttcctgtcagttccaacacgattcagagctggctgcctggcagatgattgatactggagtctcattctgcctgattaaaaatggaattagtatgcaacactgagagcgcccccatcaccctgacgaatgtgactgtgtctgacgaatgtgactgtgtccaaccctgcccccacttcctctctgcaccagctccgcagggcctggtgggagtcatgggtcctgtgataccccctcccctcagttcctcaagcagcactctgtgaggtcctgtgcccagctctggtgtgagtgggtgccccggcagcaccaagggagcctggacagaggagccggcctgggcctgggggaggggaggagggccctccagtgccttccaaaccaggaggggaaactggctgctggtgacacagcctgggtgacacggatcccacctgcctcagtcccgagcagagctggctggccactgggcagtcccttccccagccagcctgaccccagcctgtactccttccccctccgtgggggaagctccgtggcttggcgtccccgagagctgccagaaactaggatgaaagccatggtgagcacggcctctgttcccctgcaccatttcctggggtgtccggattaacaagctcatttgatctgg

SEQ ID NO: 464001 - DNA, 784 bp, Homo sapiens
tttcctttcatgaagtcttcctgcccacagctctcgcctgcactgccgcagagtctctatccagcacatctgccatggggcatctgcatcacagcccagtcctggagataggtggtcaggtcatttctcacacagaacgctatgtcaccctgtttgcctctatcatcctcaaatgtgactacaccacctctgcccagctccaggacgtggtggtgacatggcgcttcaagtccttctgcaaggaccctatctttgactactactcagcgtcataccaggcagctttatccctgggccaggacccatccaatgactgcaacgacaaccagcgggaagttcgcatagtggcccagcggcgggggcagaatgagcccgtgctgggggtagattaccggcagcgcaagatcaccatccagaaccgagcagatctcatgataaatgaagtgatgtggtgggaccatggagtgtattactgcaccaaaagagctccaggggacacatcaggagaccccgataaggaagtaaagctcatcgtcctacgtaagtgctactggagctttctattcagtcaccctcactgccgtaacacttttactcacaggaaaaaaaaaaaaaaaccagaaataagcaagcctaaactggctgacagtgatcttcatcatcctgggagccctcctcctcctgctgctgattggagtgtgctggtgccagtgctgtcctcagtattgctgctgctatatccgctgtccctgctgtcctgcccactgctgctgtcctgaggaag

SEQ ID NO: 464002 - DNA, 1682 bp, Homo sapiens
gccactgcactccagcctggcgacagagcaagactgcgtctcaaaaaaaaaaaaaaaaaaaaggctggagtgcaacggcacaatctcggctcaccgcaacctccgcctcccgggttcaagcgattctgctgcctcagcctcctgagtagctgggattacaggcatgtgccaccacgcccggctaattttgtatttttagtacagatagggtttctccatattggtcaggctggtctcgaactcccaacctcaggtgatccgcatgcctcagcctcccaaagttctgggattacaggcatgagccaccgcacccggccatttgtatgtaattttctatatttattgaaatgcattttaagtaatatgaaagcatttttctccttacaatggaaaaaccaacttgattttacatttatttatataacctgacttaattctatgtaagtcaagtgaaaaaggaaacaactgctctgtggaatcaacctgaagatgtctaatttttcctctgatgccaccagacttaaagcagttcacgatcctctctacaaagaagtatatttaggttctccctctccctctccctctccctctccccacggtctccctctgatgccgagccgaagctggactgtactgctgccatctcggctcactgcagcctccctgcctgattctcctgcctcagcctgcccagtgcctgcgattgcaggtgcgcgccgccacgcctgactggttttcgtatttttttggtggagacggggtttcgctgtgttggccaggctggtctccagctcctaaccgcgagtgatccgccagccttggcctcccgaggtgccaggatggcagacggagtcgcgttcactcagtgctcaatggtgcccaggctggagtgcagtggcatgatctcggctcgctacaacctccacctcccagctgcctgccttggccccccaaagtgccgagattgcagcctctgcctggccaccaccccgtctgggaagtgaggagcgtctctgcctggccgcccatcgtctgggatgtgaggagcctctctgactggctgcccagtctggaaagtgaggagcgtctctgcccggccgccatcccatctaggaagtgaggagcgtctctgccaggccgcccatcgtctgagatgtggggagcgcctctgccctgccgccccgtctgggatgtgaggagcgtctctgcccggctgacccgtctgagaagtgaggagaccctctgcctggcaaccgccccgtctgagaacccaaagactagaattccatttctaaacccagcccagcagccggaagtcatgaagcagtcaacctgcctggacatccagctacgctctgctgcgccattctatccacccatcaagactcccctcccttctactgataaccctcctaaaagccaactgggattgaattactcctctgccaagaaccctctgctgcaccttatccaaggcccaccataaaatgatgccagcccacctcacccaaaacctcttccagaaagtcccagctccaccctggttctctcctccacagatgtcagacctgtatgtggtctgatggctctctcagcctccttcattctctccccatttctgccacattttccccaataaatcttgtgtgtgtctaattccattttggtgtctgcatctcaga

SEQ ID NO: 464003 - DNA, 3945 bp, Homo sapiens
gccaggcggctgcccgccatctccccagtgggatgggtcgctagctatctcacgcaggtcactaagtcggcatttatttcctgataggagatggcgttacaagggatcctgtgcacacagggcagctttacttcagctgtgattaggattatctacgatctacactctcatgccatccccccaccttctgccacccccatcttaaaatgggtcccccagaatcagatctggagactacaattcacttgtcagttatatatcaataaagtgctcccaggagaaaacggaaaggggatgaggggaacagaacagaaatggggaaaaagccaagcacagagtacagaaaatcgtttctcctataccccacacagaaacaaagccctgtttcctggccacatcccgtgggctgctttcagagaggcccttcacactcagggctgctctcagggaacagaagggctcgatttgccagccgttgtcgcgggaacccgggccaatccgtggcctctagttaatacttgagcgcattcaagcctcccccaagaaaaaaatgaaaatagccagcaaggagggaaaggcagccagggacgtcccccttccacttcagaagagcagtagaaaccgtcacctccctataggacaacaaatcacccccataaacacccaccagccacctctcgccccttctcacagttctggtggtttagctatttctctcctcaaatgcacggaaaactgtgatttggttctctacaaatgacactttctgtttttgtgtttgtttttcaaaataccttggcataactcatacaatgagattagaatttgttggtgaactatttttcagctcagtaacctatttttttaattgtggtaaaaataaaaccacataacataaagtgtaccatcttaaccatttttaagtgtacagttcagtagtactaaatatattcacattgctgtgagatacatctccagaactttctcatcttgcagaactgaaactctataactataaataactctcttttgccccttcccccagctcttggcaaccacccttctacttcctattatctacgatttgactaatttagatatctcatgtgagtagaattatacaatgtttttccttttgtgtctggcttgtttcacagagcataatgtcttcaaggttcatccacgctgcaccaagtgtcagaattcctctcccttttaaggctgaataatattccattgtatgtaaatgccacattttgtttatccattcatccactgatgaatatgtaggttgcttctacctcttggctcttgcaaataaccctgctatgaacatgagtgtgcaaataccttttcaagaccctgcttttaattcttttggatataggcccagaagtgagattctggatcataaggtagtcctagtttcaatttttttgaggaacaatgatactgtttcccatagcagtggcaccattctacatcctccaacaattcccagggttccaacttctccacatccctttcaacacttactgtctgttattgttgttgtttatagtagccactgtaatggttgggtaatgcctcagttgtggtcttgatttgcatttctctggtagttagtgatgttgagcatcttttcatatgctttttggccatttgtaactcagcaaccatttttaaaagtgttgatttttgaagctctgaaattgagttttcctgttttggggcaggccccaactgccacttttcacagaggaggtcccagtgaaaaagaggcagtttctgtttttgactttaacatatgactaaagtaaggtttctcagcctcatcacaattgacattttggttgaggaatgccccgtgcattgtagggagtttaccagcatccctggcctctagatgccagtagcattccggctcccctggtgacagccaaaaatatctccagacattaccaaatgtctccgggggaacaaaactgcccctggttgagagccactggattagagttttcaaactagcatgtttgagttggccaacgtgacaattttaaatttttgagacaacattaaaaattttgtagatatcacctaaaaattcagatttccagcttctcttgaggaagcagaggatacaggctatcttgggcctgcattgccccatggcaatatttggctgggctgagtagctactgccccacccaagtttgaggtggttccctcaatgtagcccataaaataaaaccattgtgaatgccagatacatctgcctctagtttatccagtgaaataattctgatttgtctgagttttcctactagctggagtgcaacggcacaatctcggctcaccgcaacctccgcctcccgggttcaagcgattctgctgcctcagcctcctgagtagctgggattacaggcatgtgccaccacgcccggctaattttgtatttttagtacagatagggtttctccatattggtcaggctggtctcgaactcccaacctcaggtgatccgcatgcctcagcctcccaaagttctgggattacaggcatgagccaccgcacccggccatttgtatgtaattttctatatttattgaaatgcattttaagtaatatgaaagcatttttctccttacaatggaaaaaccaacttgattttacatttatttatataacctgacttaattctatgtaagtcaagtgaaaaaggaaacaactgctctgtggaatcaacctgaagatgtctaatttttcctctgatgccaccagacttaaagcagttcacgatcctctctacaaagaagtatatttaggttctccctctccctctccctctccctctccccacggtctccctctgatgccgagccgaagctggactgtactgctgccatctcggctcactgcagcctccctgcctgattctcctgcctcagcctgcccagtgcctgcgattgcaggtgcgcgccgccacgcctgactggttttcgtatttttttggtggagacggggtttcgctgtgttggccaggctggtctccagctcctaaccgcgagtgatccgccagccttggcctcccgaggtgccaggatggcagacggagtcgcgttcactcagtgctcaatggtgcccaggctggagtgcagtggcatgatctcggctcgctacaacctccacctcccagctgcctgccttggccccccaaagtgccgagattgcagcctctgcctggccaccaccccgtctgggaagtgaggagcgtctctgcctggccgcccatcgtctgggatgtgaggagcctctctgactggctgcccagtctggaaagtgaggagcgtctctgcccggccgccatcccatctaggaagtgaggagcgtctctgccaggccgcccatcgtctgagatgtggggagcgcctctgccctgccgccccgtctgggatgtgaggagcgtctctgcccggctgacccgtctgagaagtgaggagaccctctgcctggcaaccgccccgtctgagaacccaaagactagaattccatttctaaacccagcccagcagccggaagtcatgaagcagtcaacctgcctggacatccagctacgctctgctgcgccattctatccacccatcaagactcccctcccttctactgataaccctcctaaaagccaactgggattgaattactcctctgccaagaaccctctgctgcaccttatccaaggcccaccataaaatgatgccagcccacctcacccaaaacctcttccagaaagtcccagctccaccctggttctctcctccacagatgtcagacctgtatgtggtctgatggctctctcagcctccttcattctctccccatttctgccacattttccccaataaatcttgtgtgtgtctaattccattttggtgtctgcatctcaga

SEQ ID NO: 464004 - DNA, 4647 bp, Homo sapiens
ggaaattagctctacccacttgcacagttaattgcagggcagctcccactccaattcccctgcaggccggaatcacagtctgcccctcccatgtgcaggcctttgtacaagctctctgggcaccacatgctctcgcagaggctgcctgtggcatgttttttgggtgctcctgaccagatgccctggacagtgccagaggcctttggattttctgagtgtgagtgggtggagccttcctctggtgcccccagcctactgctgctgctcctctcactggccctgcccaatacccacacacgtgcaaatgcacacatgcatcgtcctccccggggctgctgcagccccttgcagtgccaggagcacaccgggccctggactgaacaaaccgccttcccaggccctctttcttggcagctccgtgggccccaaagcctgacaggagtttctgggctgacaattaggctactgaaaaaggacaattcacaacaggcccacacagagaaggcctttcatgccgcacagagcccggcccagcagcctggggttcggtccaagtgtgctgagtgggtggtggagctgacagggcctgcagggttgctctggctggcagagcctctgtggttgagtccgtgggtggcagggtaggggggaggcgaggaagctgtctcatgggttacagaaaaccatcgtccttcccatgtggggctcttgtttctaatactgtaatcttaaatcattaatgaacccaagcttttcttggaatgtgtgaagtcggtgtttctgagtcatgagccatggaagaagaaaaagaaggaacaaatcacaggctcggggtttttatccctattagaagaaaaagtttccttcacagtgatttatgtctgcctctgcagatcatttttaaaagtgtttcagagactttcagaattatttttgtttgaatattagacttctgtctctgcaaaatgtataaccatatgctgtcaaccctggatattggctttggtagagtagacaccctgaattttttaacctagatgttaatcaagcattctgtctcaagacaacacaaaccttaactggagaaatgctgagagaataaggaacaggtttaggctcagggatacacaatatctgtcatcccagttacctccataaacccacgttagtaagaagtgaaactgaggcagatgggcacaggcttcaggggaggaagagaagggaggcaggacaagtggctgaaaccttcaacacagggctgagccctcaggcctgtttatgagtggtggagcgcaggcttggatgcagatggcctgggttcacatcctggctgtgccacttgctcactgctgtgtacctttgagcaagtaagttgacctctctgtgcatcagtttttgaatctgtaaagtaacagtaccgtcttacaggctagttttgaggactgaatgagtggatgtatacagtacactgagaaaagtgcctggcacatgttaggtgctcagtgttgctggagacaagagactgatttcagaacaaacggctggggctgtttttcatccagtagtaatccctctgttttatataggcagagagggttgacaggtctggtgaggtgcccacctaaaatcagaaaaggtcctttccagccacatcacaggattcagggagattatgtgatttattgtttatttaatttatttgtgccacgctgagttccacgcagggtctgagctgtcttccgtctgctttctctccatgttctgtggcttcttggtgaatgagattagggcaggaattggccccagttctggaagctggactggtcctatcagagcaatcccattctttgtgtgtttgcctgtacttgatgcattgctgttgcctttgattccctctgcctggcaggggtgacaggtggggggagggatttgtccacctgccattgtgtatatctgtgtctttttgaaaggcacctgctaacatgactctttttttcttttaagaaagcctctcttgtgctgaaaaactaaggccttatccagtggcaaagtcctctataggccagcccagtagtgacagccgagtcaggttattacaggcatttctgccacatctaaattccacaaagaagacatcagatggtggcctgagggtgcgtgtcattatatacaacaagggatgtggtttaaggacctcatccacccctccctgccccagctgctcccttgtgggacattcttatcctcatggtggccaggatgtgggtacacttcaggggactgaaagtctcttctgtagttgccaggcaccaggaaccccaggcagccagtgtgtaagcccaaccctgctgtcatctctggctccttcatctccctcccgcccacatccactctttctccagagttaccatccaagcacaagatgatcccatgctggttattcagtgctccagactcctgagggagacgccctgaagtcggtagacatcatgttggattgggacagtaacttgctgggtcacctccttcctgtcactttgcctcttctgcaaaatagaactgccacgcaccatcctcaccgtagtgccacaaatgtcaagtttatgtaaatgcaaactgcattcaggtctattctgttttcctttcaaacacagatactttaatggcttaaaccactgtgaccctgtaactctacagggtagcgttagttttttataattatcatcttgtgactgcacatgagagactcacaaagcacttgtggtccaactggactgcctccataacatgaggatcacacacagtcgataacgattagtgccaaggccaagaaaatgagcatccaatgacatctggaccaggaggaaagcacagggcactgggctggaagatgagctgtcccaagtggcccactccacccgagggatgccctccagttgacagtcccaggccttcccccagatagttgattgctcttgctctccatcccaaaatccctgcccaagttcatcataaagtgaatggaccgactcctctgcaggatggagtgattctgtcttagtctctttgttttaagattatggaccaatgctccaggaactttatatcttgtactgttgggtgaaaaataaagaggggaactctagctcaggagccattagccggtaccaagaaggaaaatggagcttgtcctgcagtcaggtgaacaagacagtgattttggtctgagtagaaccacatgcagttgagacaaaaaagctcaaaatgtttaaacagctgtaaatcctatgagcagtgaaaatgtccccaacatcctaggaggtttgtttttgttgttgtttaaactgtaatcactacaataaacatttttctatagaggatgaaaaatctaaatttgaacactgttgtctgtattctatgtaatggctatgagaatggtgagatttttgttttctcttaggaatgggaaattcatctatattccccttaaattttaaaaaatatattaaagaggaaattgtttgtgttctcccaatgaatagtaacctagtagaaattatttttcctattaaaaattattaacatgagatgtggtaaagtgttttctttttttcctcccaccaagatgaacttttccatatttaaaacggcatctcaagacagttggggagtgatttttatactagaaataagggatgactgcatagtcctacctggttcaatttataccctcttcaaaattctgttacttcttctgctaatactttgttctgtggaacgcttgctgtgctcctatagggcctaataggaagcttgatacacacttttagcaaacccatattagttactttctaaatgaatttgagccccttcccttgaatgtagacacttcaatatggatgcaaatgtttcatgatagaaatttgatgattatattacaaattccagtcgtacttgaagggaagcagtttggttggatgttgaacacaggaataaaattccacagcttcccaaggtctaagttagaacgttagttgcccccaaaagagggatttatttttaaagggaaaattcatttttaaaaatcagcaagctaatcaaccacggcagattttgaatcccagtcctgaccgggaagcaggaaaaagaattctcaaatgtactattaagaggtggctgtatatgtggagaatacaaattgattttaacattagaataaacacagcataatttgaaatgccaaccgaaaatacatatattgtctcccccaacctattgtgtatttgttgggtgaaccttgtcattgcgcctttcgaaggcagtggtggcgtgtgtgcctcacccacacattcacgacagatcctcgctggctgccatgttcgtttgtgagaaataaaggaatctgaaggtgattcgtcccatcgtgggcctgataaattaaaaatttgcatatgtctgacagtagttttgcagttctaggaaagcaaataagaaagtggaaagcatttaaattaagtgttgcctctaacaaagcttttagaaatggacaaatataaatgatattgattgatttcaattgattttttaaaaatgttttattctgtggagtttcggaagtgacccaaagctttgggggagcttgtgagc

SEQ ID NO: 464005 - DNA, 1773 bp, Homo sapiens
tgctccctcagtttggggccagctaggcccgctgggacagcaggacccagaacccaggtctgccgttgtcctcaagccctggactccagccccctgaccacagccagtttctggccaggctgctcatgaaaggccatgggcctggctggaacctgctgccttagagccaggcctcttcccgggggaggggcgtttgcccgttgccaggtgcccgggttccggccctggcactagcgacggccatgctgcatgtgctggcctcgctgcctttgctgctcctgctggtgacgtctgcctccacccacgcctggtcgagacccctctggtaccaggtggggctggacttgcagccctgggggtgtcagccaaagagtgtggagggctgtaggggtggcctgagctgtcctggctactggctgggccctggagcaagccgcatctaccccgtggctgcggtcatgatcaccaccacgatgctgatgatctgccgcaagatactgcaggggcggcggcgctcacaggccaccaagggtgagcatccgcaggtgaccactgagccctgcggaccctggaaacggcgggccccaatctcagaccacaccctgctccgtggggtcctgcacatgctggatgccctcctggtccacatcgaaggccacctacgtcatctagccacccagcggcaaatccaaataaaggggacttccacccagagtgggtgaccgaacatgtgcctctctttgcctgacagcctgaggtcctgggccaggtctgctctttccaggcctgtctggaccgtgtgtcccttttcagcttttagagtcagctgacttggtgtccaggacgggcgggcaggttcctgctttagaaaaaggcaacaacgttatgaattcaaaaatggaagtgaattaaaataatgagaaaagaaatgatgatacttttttttgaaaactttttttttaaattgacaaatactacaatactaaatccagaaaaataacataacttgtggcaacttcctgacatatttctaataccttggtcccctacatggtctggcttcttactctgaaggcctctacagaggacaaggattttgtgatttttgggggagatattttccatacagagaaaagatacttcagtcttcctcctaacatggttgaaatttgtgttttaattattggtagtttaggaaagttaaacttcctaatctgttgttgacggtgccatacaaatgttctggattgttgtaaaatttgagaaactgtcatcagccttctttcatataggaactatgaaatttggaagaattttccacagacgaggttctggctccacgcatttcaaaccttgttttccttccatggctcacagttttcccagcactgggtgccgtggggcatgtccttaaggcaataggactttgcacttctgtccttacccagcaggattttcctacgagccacattcctagtttattctagaacaagaccaataaactaactttacacaagggtggagcaaaccacataaatatgtccctcttaacctggtgtagaaagtaaaaaaaaaaaagttcctcttcaaagtttcccttcttgttaaagaataaattataagtgttacaaataatagtttcttttaaagactaacttcctttaagcctcctcactttgtgctaataactctttgttaagccctatcttatgtagctgttagatataaagaaataagtacattctgtgtccttgtactttaaccaaaatattt

SEQ ID NO: 464006 - DNA, 1367 bp, Homo sapiens
cctgccacataagcacacgattaatattaacaacgtggcttatgaaacaggagtctttaattcaagaaggaaaacaggaattcaccagaattgtgaaggacaccccagatcctgaagagaatgctggcaaacagcccccccaacttggggagagggttggagacgctgtgaaggacagacatcgtgaaaagctgcagacattctcccagacctgggatggagaacaggacaccatttttaatccaggcacgtatgaagccagccattccttggtgactcagcagcatggcagtgtaggcatttcagtcttaggccagagattagagcacctgctctggagtggggtaggggcctccatagccagaattgtggaaagcacctcagctgtagggctagaattgtgctttcctccattgcaagcctggggcaggaggagagctgctaagttgcactttctcctgggcagcaacacttgcagccaaggccagcttggcgacctggaactgatccacctgtgtcattgttgggtgccccactctgctctactgatactgtggtatgacagggccgcctctgctccactcccaggcagaaatccagacatttggagcacctgtttgcctggaccagcagactgagccaccccacccctcctggacacagatcatggtgaagtgaggctctctctgctccacacccaggcaaatctacaggcattcagagcatctgcttgtctggttcagcagcctgagccaccccagtcttcctggacatagactgtggttcaagggtatcctgtctgttccatgcccaggcagatttccaagcatctggaatggcaactcttctagattagaagtttaagccatctcccattcctgtgtagagaacatggagcccagatggtttcccagctgcatgcctaggcacaatcctgcattctcggtggctgccctctggattctcccttggcgctagtgtctgtgcctgccactgggggatctgtaggccaacctgctctgtttggccctgctctttgtggcccctgccccccagggctgagcagggagctcagaccactatatactccacaaaccagcttattgcctgaggcaatagagagcttctgccagtaaacaaggatcaagtatatacgcagctatgttggctgcagctggctttcacctataagcaccatctgtgggcttgtaggttgaactccacagcctgatataaaacctgccaaaagaagtgtatagggctatagaagcaaagcccaaaagccctacctagcattctctacagtcacactcattaagaagggagaaaaaggaaaaaggaaagaagaaataacattatagggaagg

SEQ ID NO: 464007 - DNA, 2406 bp, Homo sapiens
acccacagtgcctggcaacctagaccagtcagggacgcggcaggaaatggaagagcctccgcaagaggctctggctgaacccttgaaacatgaaagcccagccgctccctcaagtgctggccacactaagggccaggaagaagacgaccagaagaaccaggccgaaaggaaggcagataaccacactgctcacagaatagctgaccagactgccctaagagtgcctagccaggctgaatccagcatatttagccaagctaccaacggagtagctgaacaaaatgggcatagtacacctggtcaggctggccgcagagcatccaaccctgctgatgtttctgaccttagagcagatgatcaggttaatcaaacaccgtctgaacagactaaaggcaaggcatctagccaagctaataatgtacagcatgaacagagtgatggtcaggtgtctggcctgacggaggaaagaactgctgaacagactgaacgaagattacctacccaggctgagagaagaacttctgggcagattgatggtagactggctatgccatctgaccagagaggttccagacagaccgaccacagaatggcaggccagtctgagagaagagcttccgagcagatggaccgcagaatgtctggcgaggctgagcgaagaacttctgagcagattacacacagattatccaaactatctgagagaagaccttctgtgcagattgacagtgggtcatccgtcccatctgaccaaagtccttctgtacagattgacagtggatcgtccgtaccatctgaccaaagaccttccgtacagattgaccgcagaatgtcagggaaagttaggagaagaagttctgagaagactgactacagattggctggcctggctgacccaggaacttctgagcagactgacctcagattgtatggcctcgttgaccacaaaacatctgtaaagactcaccaccaagtgtacggccaagccactgaactagctgaacaccaggctattgaccaagctcatagtaatgctgatcaacctccagttgacaatgctcactacactgaatctgaccagactgaccacttagcagacagacaagctaatcataaagaccagctgtcttactatgaaacacgtggccagtctgaagacagaatatttccccagttaggcaacagcaaagaggacaaagaggctgactacagagtacaaccctgcaaatttgaggatagccaagtagacctcaattccaagccttcagttgaaatggaaactcagaatgcaaccactatcccaccctacaacccagttgatgccagattcaccagtaacttccaagcaaaagaccaagctcttttcccaagactcccctccatctcatccaaattgaactataccagcagtcaagaaaaaactcaagccatagtaaccaaatctgtttactaaggactttttggtggggggatttaaatttcaggatgaattttcagaaattgaccaaggaaagggttatcatatacgcaatcaaacttatagaaggttcccttctatagtttatgaagatccttaccaagtttcactccaatacatggaaaaacaccacattctgcaaatattccaggaatgtcagcgagtcatagatttggtcccttcacaatcccacatgtttttggaggttttattcattttttaaatttaaaaaaaattttcgtctgactgaatttattctaaaaactggtcttccagctctgatattctttcctcaccttggtcaattctgctgttaatgattctaactgtattagtcattcttgaagtgaattcttcaattccataagttcagtttggttctttcttaaaatggttatttcatctttcagttcctaaaatggatcattttattggattccttgggttgggtttcaactttctgctggatctcaatgatctttcttgccatccagattctgaattctgtctgtcatttcaatctggtttaaaaccattgctgggggactagtctgttaatttggaggtgcaggaaatgatgaaaaagagagacaaaatgtgaaatctacaaagaacgagcctctcttcagtattgtttacaatcatgtgtcaatactatgttctgttttccatctgaaaaaaaaatggttttgaatagacattagtggtgactctacctgaatgcattattaatttttaagtaaaaaatctatagaatatctatgtaaaatttacataacaattacagatatctctggataatcatacaaaaatatacacattatacttatgcatgcattgatatttcaatactcattcccctaaatctctgaataagtccacaaatcacaactagcaatttatatgtacttcttataaagcatataaat

SEQ ID NO: 464008 - DNA, 964 bp, Homo sapiens
taaaggaagagctctcaaggatggaaaaaaggggggtcaaagaggaaaactggggttcagaggtcccccttctgctcagtgacacagaagggaaagttcagaaagctgaagagatcagaaaaatgatattcccttgttcttctcaacaaaataacagagaagattatttgctgagggtggagggattgagagctttaaagaaactgataaagtttgaaagagtcattgaaggcaatgaaagaagagctgatcaaagtcaagttcaagaattgactgacaaggcaacacggagagccaggctgaggtttggagccatgagtctgctgttgcatgaatctgcaggctgtgttcccaaaacaccaaaggttcagtctaggtcctgctgctcacctcacagaaagccaatcactgagacaagagtatttccagagaagaaggctttaattaggtactgcagctgggaagatgggacgtcagtctcaaatccatctccctgaccaactaaaaccaggaacttatatagcagggaagaaatgtaacatgcaggaaaacaggaattagggaggggtagggaagaggagttggtcaacagaaagcaagtggtcagataggcaatcatgatgggtgaggggtctggaatgttgtccagatggagtgatctgtggttttggtttggctgcctctgacactttattccatgttgcctaatagttttaaaagcccctattttatagtcagtgcatctttctgtgggtccccagagaagggaagactgtgagagaaaagtgaacacagagccgtgcagaggaaagatgatacaaggagacacagggaaaagacagccatcaacaagccaaggagtgagtctctcacagccctcaggaggagctagctctgccaacaccttgatcttggacttctagcctctagaactgtaagaaaataaatgtctgttgtttaaatc

SEQ ID NO: 464009 - DNA, 2850 bp, Homo sapiens
gaagacttgtgttctcaacccacagctgctactgctacatttaaagacactgtagtgaacatttgccactgtgtgtgctgagtttttcaaaggtcagagcagattgaacctttgtggtttcattttccctgattttgatttttcttatggggaacctgtcttgctgcattcaaggtgactcgaagaagccttcccaaaggcgtgtgaaaaggcagccctactctactaccaaggtgacgtcagggagcacattcaatgagaatacaagaagatatgctgtgcacaccaaccagtgtaggagacctcatggctcccgggtaaagaagaagaggtacccacaagaagctccccatgaggacaccgtacacgacatcactaacgaggacgccacacacgacatcgctaacgaggatactgtacacgacatcgctaacgaggccgccgacaagggcatcgccaacgaggacgccgcccacggcatcgccagcgaggacgccgcccacggaatcgccagcgaggacgccgcccacggcatcgccagcgaggacgccgcccagggcatcgccagcgaggacgccgcccagggcatcgccagggaggacgccgcccagggcatcgccaaggaggacgccgcccagggcatcgccaaggagggcgccgcccagggcatcgccaaggaggacgccgcccacggcatcgccaacgaggactccgcccacggaatcgccagcgaggacgccgcccacggcatcgccagcgaggacgccgtccagggcatcgccaaggaggacgccgcccagggcatcgccaacgaggacgccgcccagggcatcgccaaggaggacgccgcccagggcatcgccaaggaggacgccgcccagggcatcgccaacgagggcgccgcccagggcatcgccaaagaggacgccgcccagggcatcgccaacgaggacgccgcccagggcatcgccaacgaggacgccgcccacggaatcgccagcgaggacgccgcccacggcatcgccagcgaggacgccgtccagggcatcgccaaggaggatgccgcccagggcatcgccaacgaggacgccgcccagggcatcgccaacgaggacgccgcccagggcatcgccaaagaggacgccgcccacggcatcgccaacgagctgtatacgacatcgctaacgaggacaccctacaagccgtcgctaacaagtacactgtacacaacatcgctaatgagggcactgtacaagacatcaccaatgagggcgctttatacgacattgctaatggcaccgacaaggcacgctaacgtggacgctgtacacgacattgctaatgaggacagcgtataagacatcgctagtaactatcgcaagaacaaaaaaccaaacaccgcatattctcactcatagatgggaattgaacaatgagatcacatggacacaggaaggggaatatcacactctggggactgttgtggggtggggggggagggatagcatcgggagatatacctaatgctagatgatgagttagtgggtgcagcgcaccagcgtggcacatgtatacatatgtaactaacctgcacaatgtgcacatgtaccctaaaacttaaagtatatatatataaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacaaggcacgctaacgaggatgctgtacacgacatcactaatgaggacagtgtacaagccatcactaatgaggacactgtatatggcatcgctaacgaggacactgtacaaggcattgctaacgaggacgctgtacacaacatcgctaatgaggacaccatataagacatcaccaatgaggatgctgtatatgacatcgctaatggcatccacaaggcatgctaacgaggacgctgtagacgacattgcttataaggacaccgtacaagacatcgctaacgaggacgctgtatacgacatcgctaatgaggacgttgtatatgacatcgctaatgaggatgctttacaagacatagctaatgaggttgctgtatatgacatcgctaatgaggacattgtatatgacatcgctaatgaggacgctctatacgacatcattaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgtaagacacttttctttgtcttgaagagaaatgttactttcctggcttctttccaatcagatgtagacatgaacatctgccagtgtgcattatcgatgtcatctgcagtttaatcaaatgtagacatgaacatctgccaatgtggactatttatgacatctgcaattcccttggtgtggtgctattgattggcagcctctcaccaacccatgccaggcacactggggtgtggtagatggcagcatccacgatccactgcaatgcagaggtgtttccctccacagcagttttcccccatggattaagagttgtgaaactgccaatctagatacactttaaagataaattctgtgggaaaaggtcttgtcttttccacaggtgtcttccgtgccagttttgggggacttcgacctttgactcaatcactataccccttcatattttctctctcaagttgtc

SEQ ID NO: 464010 - DNA, 435 bp, Homo sapiens
  misc_feature (2)..(3): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (11)..(11): n is a, c, g, or t
cnntntnantnactgacgccgctgggttggagtctccacgaccgagctggtctcggcaagtggtgcccaacacgggggctcgaacctgggtcgaatagtcgccagagcgatggttagaaaatgtggaactacactggaggacacccgagtactgttaaagcaatcctcatggtgagtaagaaggggagctcagaagcatcagggtaacaatgggacaagggtcgagcaggcatgaggcttatttgagtctgcttcgccatctcagaaaaggaggagtgaacgttagcactagctgacttacgcagctttttagtgcagtagagaaatattgccgctggtttccggaccgaggaactgtgaatgtagaggtctgggaaaaggtagcagcacactgaaaaaggcatataaggatggtgttggggatattcctataac

SEQ ID NO: 464011 - DNA, 1472 bp, Homo sapiens
  misc_feature (2)..(3): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (11)..(11): n is a, c, g, or t
cnntntnantnactgacgccgctgggttggagtctccacgaccgagctggtctcggcaagtggtgcccaacacgggggctcgaacctgggtcgaatagtcgccagagcgatggttagaaaatgtggaactacactggaggacacccgagtactgttaaagcaatcctcatggccaaaaccagcggccaatttggatatcatcaagacacctgaaacttcatcatgagccagatgctgaggaagagattttgggaggaacccaaggacctcccacttgcagccatgttgagactgacaataagtccacctttcctgcttgtagtgggtcatttaaaacttgatctccctaatcatcatgggacttgtcaagaatgtagattgttttcttgtgtgaattcttccttgtataatactgatcattctattttagcggtaagaacccaagaaggagtatggatacctgtaaagctttctggtccttgggaagcctctccttctgtgcatattattactgaaattcttcaaaagattctgagatgctctcagtgtttcattgctactttaattttaatcattatgggattgattgctgtcacagctactgccgcggcagctggagttgctttgcatttcacagtacaaacagcagactatgtaaataattggcagaaaaattctactttgctgtggaattcccaaactaatatggaccagaaactagctaatcaaatcaattatctccaacaaactgtaatgtggctaggagattgagtagttagtctagaatatagaatgcagttacaatgtgattggaatacttctgatttttgcattactcctcatctgtataatgaaagacagcatgagtgggaaagagttaagaaacatttgaaaggtcatactggaaatttactttagatattatgcaactgaaggaacaaatatttcaatcttctctggcacatctgacactaatgccaggaactgaagtgcttgaaggcgcttcagatggattagcagctattaacccattaaaatggatcaagacacttggaggctctgcaatttgaatgatgactgtgcttttaattggtgttgtttgtctttgtatatcaaattgaaatacaaatgaaattggtcatttgtacatctgcaaatgtggatcacgaatcctgcgagaagtagcctactgtgacaaagctgcctatgcctttatcactttgcaaaaacagaaaggttaattcccaaatattaggggattttccagataactttttgctagaatttggttttgttatttaatgtcatctgtgtggtctaagaatatgctctgcataaattcaagtttttaaaacttactgacatttattttttggcccagcatatagtttaattttgggggatgttatgtgtgcatttgaaaaaaatgtgttttctctcttgttgagtgttctgtaaatgacaataaggtc

SEQ ID NO: 464012 - DNA, 1530 bp, Homo sapiens
ggaccgaagatttctaactcagcttaaattacatggaattagtatcatagcatagccaagaaacacagctaccaggagccagagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagaggccacacgatggtggatgacggccctggtttgtggaccttggtggtctacggtcacgttgtactgcccaccattttccaatgggaaaagcgcaggctgtggcctccagcgaggggcctcggtacctacaagtgtgacctcaatccactctttctccagcaacatcatggaataagtccatcaaaaccacctcaccctcaacgcggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagaaaacacttgtgagtgagcaaatgaaaggtaggcctaattttgaactgaattttctttttgtttttccctgatcctctgcaattgctgtcacagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggtaagcccagaagacaaagcagtgctcacacttagcaagtgttggttttgtgtagtgagattggttttcatgtacttacatcagagaaatgaagataggccctagtgctgagtttccatgagccagctctgccatgaagtagggcgagtgctcgtggaacgtggggaaggtggggaggaaggtcaggagccagcagcataggtgtcacctcctggctctgtaactgttgggagactgtggtccagtcactccctcatggtaagatttcgtcatctataaaagaagggattcagcctgggaattcagtttcttaagaaattaaatatcttccttctgcttgtggagacaatttttctttttctttttctcccctcccctcccctcctttctttttt

SEQ ID NO: 464013 - DNA, 5804 bp, Homo sapiens
ccatgcgcagggcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaatgctgagatgcagccgtctgcggctctgagggtggccgcgtgccagagcatcactggatggtgatgtaggaccctgaactgggacagtcctcagccggtctctgccgcttttcctccttccagcggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagac

SEQ ID NO: 464014 - DNA, 5855 bp, Homo sapiens
ccatgcgcagggcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaactaaggcgtttaatgtctctttccttgtcgtggtgctttaataaacatctgtgctgagatgcagccgtctgcggctctgagggtggccgcgtgccagagcatcactggatggtgatgtaggaccctgaactgggacagtcctcagccggtctctgccgcttttcctccttccagcggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagac

SEQ ID NO: 464015 - DNA, 5414 bp, Homo sapiens
tgtcatatatatggtcttgcgctccgtggctggagtgcagtggcacgatctcagctcactgcagcctccacctcctgggttcaagtgatcttcccacctcagcctcccaagtagctgggactacaggtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagac

SEQ ID NO: 464016 - DNA, 5627 bp, Homo sapiens
ccatgcgcagggcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgtgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagac

SEQ ID NO: 464017 - DNA, 4514 bp, Homo sapiens
ctgggcggcgccccacctctggacaggggcgcagcaccgggctgccctccctgcaaagcctgaggtcatgttgtccacagtggtcgtggtccacagcccagtaagtggcagctgtgcagcccttttttcccccaggagggtctcccgtgatcctggggacccaccctcagtccccctgcgatctagggcagggctggcgcctggaggggaagggcagggaacagggaggacagcttgcttcttcttcagtatattttagggggatacagggagatgcagccagctgagaagtaatggttttctctcctaagctaaggcgtttaatgtctctttccttgtcgtggtgctttaataaacatctgtgctgagatgcagccgtctgcggctctgagggtggccgcgtgccagagcatcactggatggtgatgtaggaccctgaactgggacagtcctcagccggtctctgccgcttttcctccttccagcggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagac

SEQ ID NO: 464018 - DNA, 5769 bp, Homo sapiens
ccatgcgcagggcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagacaaaaaaaaaacagaacaacaaacaaaagaaaacaacaccacaaaaaaaaaaaagaaacgagagacacaaaaatcatccgcaaacaaaa

SEQ ID NO: 464019 - DNA, 3348 bp, Homo sapiens
aacctgaaatgctgatagtctgaatctagagtatcccccacggacatcagctggaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccaagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagac

SEQ ID NO: 464020 - DNA, 3015 bp, Homo sapiens
gtagattgggtatagaagaacccttgaaatgactgccttttctggttgctgtcatctgaaagccctatccgagaaccatatgtagagtcagattctcatcccagaagcagtagcctggtgaagagccacttgcccacatctaaaggatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagac

SEQ ID NO: 464021 - DNA, 1644 bp, Homo sapiens
gccaaaagaaggtcagtctatgagaaagagagaataaggccctttcgatagtctaacacatacatctttttaatatattaatgacagtggtatagaaagaatatgaataaatgcctatcacagtaacctaatcagagtaaaacaatacataatatctaaaagaatatagttgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagac

SEQ ID NO: 464022 - DNA, 2043 bp, Homo sapiens
ccatgcgcagggcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaagtaaaattcctgttaattcctcacatcatttcctataatctgaatatcattctgtgtgagaccagtttccccttatgtttgattagaaagtgtgcaagacagctgggcgcggtggctcacgcctgtaatcccagcactttgggaggctgaggtgggcggatcacttgaggtcaggagttcaagaccaccctggccaacatggtgaatcctcgttctactgaaaataccaaaattggctgcacgtgctggcatgcacctgtaatcccagctactcgggaggctgaggcaggagaattgcttgaatccaggaggcggaggttgcattgagctgagatcatgccactgcacaccagcctgggccacagagtgagactccatctcaaaaaaaaaa

SEQ ID NO: 464023 - DNA, 1919 bp, Homo sapiens
ccatgcgcagggcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaagtaaaattcctgttaattcctcacatcatttcctataatctgaatatcattctgtgtgagaccagtttccccttatgtttgattagaaagtgtgcaagacagctgggcgcggtggctcacgcctgtaatcccagcactttgggaggctgaggtgggcggatcacttgaggtcaggagttcaagaccaccctggccaacatggtgaatcctcgttctactgaaaataccaaaattggctgcacacccagaccaatattggtctgcaca

SEQ ID NO: 464024 - DNA, 2372 bp, Homo sapiens
ccatgcgcagggcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagtgcatataacctacagcaagcgagcatgcagctggctgcacggactccggaggcgggagtaccgggcttcaactcgtaaactcaccagtcggcttctctgtacctcaagtttcttcatctgtgaaatggagataatcgaatttagtattttgaaaagattgagttaatacatgttaaacacatgaaaaaaaa

SEQ ID NO: 464025 - DNA, 5340 bp, Homo sapiens
gcggcgggctgggtgtttgcaatacaaaggcggccacgcgcggcgccgctcggtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagac

SEQ ID NO: 464026 - DNA, 5681 bp, Homo sapiens
ccatgcgcagggcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagac

SEQ ID NO: 464027 - DNA, 5601 bp, Homo sapiens
ccatgcgcagggcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagac

SEQ ID NO: 464028 - DNA, 5627 bp, Homo sapiens
ccatgcgcagggcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaagaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagac

SEQ ID NO: 464029 - DNA, 4953 bp, Homo sapiens
ctcctgtcagggctgcgcgcaataatcgctggacctgggaggtggaggttgcagggtagctgcgattcttgctgctgcactccagccctggtgccagagccatagcgtgtttacccacaccgaggagaacgagaacacgaatggcggagatcattcatcatctgctttcctcctgtgtagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagac
